US008937220B2

(12) United States Patent
Emmanuel et al.

(10) Patent No.: US 8,937,220 B2
(45) Date of Patent: Jan. 20, 2015

(54) ISOLATED POLYNUCLEOTIDES AND POLYPEPTIDES, AND METHODS OF USING SAME FOR INCREASING PLANT YIELD, BIOMASS, VIGOR AND/OR GROWTH RATE OF A PLANT

(75) Inventors: Eyal Emmanuel, Rechovot (IL); Alex Diber, Rishon-LeZion (IL); Sarah R. Pollock, Tel-Aviv (IL); Hagai Karchi, Moshav Sitriya (IL)

(73) Assignee: Evogene Ltd., Rechovot (IL)

( * ) Notice: Subject to any disclaimer, the term of this patent is extended or adjusted under 35 U.S.C. 154(b) by 0 days.

(21) Appl. No.: 13/254,183

(22) PCT Filed: Mar. 1, 2010

(86) PCT No.: PCT/IB2010/050871
§ 371 (c)(1),
(2), (4) Date: Sep. 1, 2011

(87) PCT Pub. No.: WO2010/100595
PCT Pub. Date: Sep. 10, 2010

(65) Prior Publication Data
US 2012/0060234 A1 Mar. 8, 2012

Related U.S. Application Data

(60) Provisional application No. 61/231,349, filed on Aug. 5, 2009, provisional application No. 61/202,459, filed on Mar. 2, 2009, provisional application No. 61/282,183, filed on Dec. 28, 2009.

(51) Int. Cl.
C12N 15/82 (2006.01)
C12N 15/87 (2006.01)
C07K 14/415 (2006.01)

(52) U.S. Cl.
CPC .......... *C07K 14/415* (2013.01); *C12N 15/8261* (2013.01)
USPC .......................................... 800/290; 800/278

(58) Field of Classification Search
None
See application file for complete search history.

(56) References Cited

U.S. PATENT DOCUMENTS

| 3,791,932 | A | 2/1974 | Schuurs et al. |
| 3,839,153 | A | 10/1974 | Schuurs et al. |
| 3,850,578 | A | 11/1974 | McConnell |
| 3,850,752 | A | 11/1974 | Schuurs et al. |
| 3,853,987 | A | 12/1974 | Dreyer |
| 3,867,517 | A | 2/1975 | Ling |
| 3,879,262 | A | 4/1975 | Schuurs et al. |
| 3,901,654 | A | 8/1975 | Gross |
| 3,935,074 | A | 1/1976 | Rubenstein et al. |
| 3,984,533 | A | 10/1976 | Uzgiris |
| 3,996,345 | A | 12/1976 | Ullman et al. |
| 4,034,074 | A | 7/1977 | Miles |
| 4,098,876 | A | 7/1978 | Piasio et al. |
| 4,666,828 | A | 5/1987 | Gusella |
| 4,683,202 | A | 7/1987 | Mullis |
| 4,801,531 | A | 1/1989 | Frossard |
| 4,879,219 | A | 11/1989 | Wands et al. |
| 4,943,674 | A | 7/1990 | Houck et al. |
| 4,945,050 | A | 7/1990 | Sanford et al. |
| 5,011,771 | A | 4/1991 | Bellet et al. |
| 5,187,267 | A | 2/1993 | Comai et al. |
| 5,192,659 | A | 3/1993 | Simons |
| 5,268,463 | A | 12/1993 | Jefferson |
| 5,272,057 | A | 12/1993 | Smulson et al. |
| 5,281,521 | A | 1/1994 | Trojanowski et al. |
| 5,296,462 | A | 3/1994 | Thomashow |
| 5,316,931 | A | 5/1994 | Donson et al. |
| 5,356,816 | A | 10/1994 | Thomashow |
| 5,399,680 | A | 3/1995 | Zhu et al. |
| 5,464,765 | A | 11/1995 | Coffee et al. |
| 5,466,785 | A | 11/1995 | De Framond |
| 5,495,070 | A | 2/1996 | John |
| 5,504,200 | A | 4/1996 | Hall et al. |
| 5,521,708 | A | 5/1996 | Beretta |
| 5,569,597 | A | 10/1996 | Grimsley et al. |
| 5,597,718 | A | 1/1997 | John et al. |
| 5,604,121 | A | 2/1997 | Hilder et al. |
| 5,608,142 | A | 3/1997 | Barton et al. |
| 5,608,144 | A | 3/1997 | Baden et al. |
| 5,608,149 | A | 3/1997 | Barry et al. |
| 5,608,152 | A | 3/1997 | Kridl et al. |
| 5,620,882 | A | 4/1997 | John |
| 5,659,026 | A | 8/1997 | Baszczynski et al. |
| 5,693,507 | A | 12/1997 | Daniell et al. |
| 5,859,330 | A | 1/1999 | Bestwick et al. |

(Continued)

FOREIGN PATENT DOCUMENTS

| AU | 2005229157 | 10/2005 |
| AU | 2005234725 | 12/2005 |

(Continued)

OTHER PUBLICATIONS

Sasaki, Direct GenBank sequence submission, Oct. 25, 2004, GenBank Accession No. BAF27672.1.*
Patent Examination Report Dated Jun. 27, 2013 From the Australian Government, IP Australia Re. Application No. 2012216482.
Matz et al. "Gossypium Hirsutum GHDEL65 (ghde165) mRNA, Complete CDS", GenBank Nucleotide, GenBank Accession No. AF336280, Mar. 15, 2001.
International Preliminary Report on Patentability Dated Jul. 4, 2013 From the International Bureau of WIPO Re. Application No. PCT/IB2011/055854.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.

(Continued)

*Primary Examiner* — Cathy Kingdon Worley
*Assistant Examiner* — Mykola Kovalenko

(57) ABSTRACT

Provided are isolated polynucleotides which comprise a nucleic acid sequence at least 80% identical to SEQ ID NO: 3487, or 7; isolated polypeptides which comprise an amino acid sequence at least 80% homologous to SEQ ID NO: 246, and and methods of using same for increasing a yield, biomass, growth rate, vigor, and/or oil content, of a plant.

12 Claims, 3 Drawing Sheets

(56) References Cited

U.S. PATENT DOCUMENTS

| | | |
|---|---|---|
| 5,880,100 A | 3/1999 | Ogiso et al. |
| 5,961,466 A | 10/1999 | Anbar |
| 5,981,834 A | 11/1999 | John et al. |
| 6,080,914 A | 6/2000 | Conner |
| 6,084,153 A | 7/2000 | Good et al. |
| 6,094,198 A | 7/2000 | Shashua |
| 6,167,151 A | 12/2000 | Albeck et al. |
| 6,201,541 B1 | 3/2001 | Shalom et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,442,419 B1 | 8/2002 | Chu et al. |
| 6,472,588 B1 | 10/2002 | Haigler et al. |
| 6,670,528 B1 | 12/2003 | Shinozaki et al. |
| 6,701,081 B1 | 3/2004 | Dwyer et al. |
| 6,720,477 B2 | 4/2004 | Da Costa e Silva et al. |
| 6,765,607 B2 | 7/2004 | Mizusawa et al. |
| 6,801,257 B2 | 10/2004 | Segev et al. |
| 6,850,862 B1 | 2/2005 | Chidichimo et al. |
| 6,965,690 B2 | 11/2005 | Matsumoto |
| 7,072,504 B2 | 7/2006 | Miyano et al. |
| 7,214,786 B2 | 5/2007 | Kovalic et al. |
| 7,292,719 B2 | 11/2007 | Arnon |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2001/0046316 A1 | 11/2001 | Miyano et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1* | 6/2004 | La Rosa et al. ............ 800/278 |
| 2004/0172684 A1 | 9/2004 | Kovalic et al. |
| 2004/0181830 A1 | 9/2004 | Kovalic et al. |
| 2004/0236225 A1 | 11/2004 | Murphy et al. |
| 2005/0096515 A1 | 5/2005 | Geng |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalik et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0196120 A1 | 8/2008 | Wu et al. |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0125258 A1 | 5/2013 | Emmanuel et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |

(56) References Cited

FOREIGN PATENT DOCUMENTS

| WO | WO 2008/122980 | 10/2008 |
|---|---|---|
| WO | WO 2009/009142 | 1/2009 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |

OTHER PUBLICATIONS

Notice of Allowance Dated Nov. 19, 2012 From the US Patent and Trademark Office Re. U.S. Appl. No. 13/450,547.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7O18 Genomic Sequence, Complete Sequence", GenBank Accession No. AC011437, Oct. 30, 2002.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Examiner's Report Dated Jan. 10, 2012 From the Australian Government, IP Australia Re. Application No. 2005234725.
Official Action Dated Dec. 12, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics, 7(3): 225-242, 2006.
Examination Report Dated Jun. 11, 2012 From the Instituto Mexicano de la Propiedad Industrial Re. Application No. MX/a/2011/007294 and Summary in English.
Examiner's Report Dated Jan. 13, 2012 From the Australian Government, IP Australia Re. Application No. 2011239323.
Response Dated Dec. 22, 2011 to Official Action of Aug. 22, 2011 From the US Patent and Trademark Office Re. U.S. Appl. No. 12/457,199.
Supplementary European Search Report and the European Search Opinion Dated Jan. 2, 2012 From the European Patent Office Re. Application No. 09807983.3.
Translation of Decision of Rejection Dated Dec. 9, 2011 From the State Intellectual Property Office of the People's Republic of China Re.: Application No. 200580027481.4.
Adachi et al. "*Oryza sativa Japonica* Group cDNA Clone:J023021L06, Full Insert Sequence", Database Embase [Online], XP002665608, Retrieved From EBI, Database Accession No. AK099270, Jul. 19, 2003.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 31, 2012 From the Thai Patent Office, Department of Intellectual Property Office Re. Application No. 0901000235.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.
International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.
International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA Aug. 30-Sep. 3, 2006, XP031235634, p. 953-956, Aug. 30, 2006. p. 953, § 2, 3.
Aksenov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.1.

(56) References Cited

OTHER PUBLICATIONS

Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs. 4, 5.
Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Kaczmarek et al. "Optical Excitation Methods in Active Dynamic Thermography in Medical Diagnostics", Proceedings of the SPIE—The International Society for Optical Engineering SPIE, XP002519609, 5566(1): 120-126, 2004. p. 121, Last §, p. 123, First §, Fig.3.
Lipari et at "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig.5.
Restriction Official Action Dated Feb. 1, 2012 From the US Patent and Trademark Office Re. U.S. Appl. No. 12/669,975.
International Search Report and the Written Opinion Dated Aug. 22, 2011 From the International Searching Authority Re: Application No. PCT/IB2010/56023.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA PNAS, 101(20): 7833-7838, May 18, 2004.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examiner's Report Dated Jan. 31, 2012 From the Australian Government, IP Australia Re. Application No. 2006281018.
Office Action Dated Jan. 2, 2012 From the Israel Patent Office Re. Application No. 206118 and Its Translation Into English.
Restriction Official Action Dated Feb. 13, 2012 From the US Patent and Trademark Office Re. U.S. Appl. No. 12/594,853.
Invitrogen "SuperScript®Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
International Preliminary Report on Patentability Dated Feb. 21, 2013 From the International Bureau of WIPO Re. Application No. PCT/IB2011/051843.
Official Action Dated Feb. 8, 2013 From the US Patent and Trademark Office Re. Application No. 12/594,853.
Supplementary European Search Report and the European Search Opinion Dated Feb. 14, 2013 From the European Patent Office Re. Application No. 10785834.2.
Translation of Office Action Dated Jan. 4, 2012 From the State Intellectual Property Office of the People's Republic of China Re. Application No. 200880109464.9.
Translation of Office Action Dated Jan. 17, 2012 From the State Intellectual Property Office of the People's Republic of China Re. Application No. 201110104274.1.
Translation of Office Action Dated Dec. 31, 2011 From the State Intellectual Property Office of the People's Republic of China Re. Application No. 200910217137.1.
Translation of Office Action Dated Feb. 25, 2013 From the State Intellectual Property Office of the People's Republic of China Re. Application No. 200910217137.1.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Examiner's Report Dated Mar. 15, 2012 From the Australian Government, IP Australia Re. Application No. 2011239323.
International Preliminary Report on Patentability Dated Mar. 14, 2013 From the International Bureau of WIPO Re. Application No. PCT/IB2011/053697.
Restriction Official Action Dated Apr. 4, 2013 From the US Patent and Trademark Office Re. U.S. Appl. No. 13/125,047.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
Communication Pursuant to Rule 55 EPC Dated Mar. 16, 2012 From the European Patent Office Re. Application No. 11190921.4.
Restriction Official Action Dated Apr. 11, 2012 From the US Patent and Trademark Office Re. U.S. Appl. No. 12/834,106.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Official Action Dated Apr. 10, 2012 From the US Patent and Trademark Office Re. U.S. Appl. No. 12/669,975.
Communication Pursuant to Article 94(3) EPC Dated Apr. 3, 2012 From the European Patent Office Re. : Application No. 06766224.7.
Communication Pursuant to Article 94(3) EPC Dated Dec. 8, 2008 From the European Patent Office Re.: Application No. 04734072.4.
Examination Report Dated Mar. 23, 2013 From the Government of India, Patent Office, Intellectual Property Building Re. Application No. 2570/CHEN/2008.
Invitation to Pay Additional Fees Dated May 8, 2012 From the International Searching Authority Re. Application No. PCT/IB11/53697.
Translation of Office Action Dated Apr. 9, 2012 From the State Intellectual Property Office of the People's Republic of China Re. Application No. 200880017707.6.
Office Action Dated Apr. 1, 2013 From the State Intellectual Property Office of the People's Republic of China Re. Application No. 200880127757.X and Its Translation Into English.
Communication Pursuant to Article 94(3) EPC Dated May 8, 2013 From the European Patent Office Re. Application No. 08776651.5.
Official Action Dated May 14, 2012 From the US Patent and Trademark Office Re. U.S. Appl. No. 12/457,199.
International Search Report and the Written Opinion Dated May 12, 2013 From the International Searching Authority Re. Application No. PCT/IL2013/050172.
Official Action Dated May 8, 2013 From the US Patent and Trademark Office Re. U.S. Appl. No. 13/125,047.

(56) References Cited

OTHER PUBLICATIONS

Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [Medicago Truncatula]", Database NCBI[Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in *Arabidopsis*", The Plant Cell, 24: 4555-4576, Nov. 2012.
Official Action Dated May 20, 2013 From the US Patent and Trademark Office Re. U.S. Appl. No. 13/059,231.
Patent Examination Report Dated May 31, 2013 From the Australian Government, IP Australia Re. Application No. 2008278654.
Hirner et al. "*Arabidopsis* LHT1 is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From *Arabidopsis*", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Communication Pursuant to Article 93(3) EPC Dated Jun. 15, 2012 From the European Patent Office Re. Application No. 11154193.4.
Communication Pursuant to Article 94(3) EPC Dated Jun. 21, 2012 From the European Patent Office Re. Application No. 11154213.0.
Official Action Dated Jun. 13, 2012 From the US Patent and Trademark Office Re. U.S. Appl. No. 12/594,853.
Blast "Blast Results", 1 P.
Communication Pursuant to Article 94(3) EPC Dated May 29, 2013 From the European Patent Office Re. Application No. 09823171.5.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
*Arabidopsis* Genome Initiative "Analysis of the Genome Sequence of the Flowering Plant *Arabicopsis thaliana*" Nature, 408: 796-815, Dec. 14, 2000.
Ciddi et al. "Elicitation of *Taxus* Sp. Cell Cultures for Production of Taxol", Biotechnology Letters, 17(12): 1343-1346, Dec. 1995.
Kikuchi et al. "*Oryza sativa* Japonica Group cDNA Clone:J023131O04, Full Insert Sequence", GenBank Database Accession No. AK072531, Jul. 2, 2013.
Lurin et al. "Genome-Wide Analysis of *Arabidopsis* Pentatricopeptide Repeat Proteins Reveals Their Essential Role in Organelle Biogenesis", The plant Cell, 16:2089-2103, Aug. 2004.
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Pursuant to Article 94(3) EPC DAted Jul. 13, 2012 From the European Patent Office Re. Application No. 11172514.9.

Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Applicant-Initiated Interview Summary Dated Aug. 6, 2012 From the US Patent and Trademark Office Re. U.S. Appl. No. No. 12/669,975.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes a bHLH Protein That Regulates Trichome Development in *Arabidopsis* Through Interaction With GL1 and TTG1", Genetics, 156: 1349-1362, Nov. 2000.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Invitation to Pay Additional Fees Dated Dec. 18, 2008 From the International Searching Authority Re.: Application No. PCT/IL08/01024.
Advisory Action Before the Filing of an Appeal Brief Dated Aug. 5, 2011 From the US Patent and Trademark Office Re. U.S. Appl. No. 12/083,978.
Communication Pursuant to Article 94(3) EPC Dated Mar.8, 2011 From the European Patent Office Re.: Application No. 06809784.9.
Communication Pursuant to Article 94(3) EPC Dated Nov. 8, 2010 From the European Patent Office Re.: Application No. 04734072.4.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC Dated Mar. 14, 2011 From the European Patent Office Re. Application No. 07849616.3.
Communication Pursuant to Article 94(3) EPC Dated Nov. 19, 2010 From the European Patent Office Re.: Application No. 06809784.9.
Communication Pursuant to Article 94(3) EPC Dated Nov. 27, 2009 From the European Patent Office Re.: Application No. 06809784.9.
Communication Pursuant to Article 94(3) EPC Dated Jun. 29, 2011 From the European Patent Office Re. Application No. 08738191.9.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Communication Pursuant to Rule 70(2) EPC and Reference to Rule 39(1) EPC Dated Sep. 13, 2010 From the European Patent Office Re.: Application No. 09163033.5.

(56) References Cited

OTHER PUBLICATIONS

Communication Pursuant to Rules 70(2) and 70a(2) EPC Dated May 24, 2011 From the European Patent Office Re. Application No. 09750276.9.
Communication Relating to the Results of the Partial International Search Dated Jul. 8, 2009 From the International Searching Authority Re.: Application No. PCT/IL2008/001657.
Communiciation Pursuant to Rules 70(2) and 70a(2) EPC Dated Aug. 30, 2010 From the European Patent Office Re. Application No. 08738191.9.
Decision on Granting a Patent for Invention Dated Dec. 7, 2010 From the Rospatent, Federal State Institution, Federal Institute for Industrial Property of the Federal Service for Intellectual Property, Patents and Trademarks of the Russian Federation Re. Application No. 2008120395 and Its Translation Into English.
European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Nov. 13, 2007 From the Government of India, Patent Office Re.: Application No. 3482/CHENP/2005.
Examination Report Dated Feb. 17, 2010 From the Instituto Mexicano de la Propriedad Industrial Re. Application No. PA/a/2005/012565 and Its Summary in English.
Examination Report Dated Apr. 19, 2011 From the Instituto Mexican de la Propriedad Industrial Re. Application No. MX/a/2008/002262 and Its Summary Into English.
Examination Report Dated Sep. 22, 2010 From the Instituto Mexicano de la Propriedad Industrial Re. Application No. MX/a/2008/005280 and Its Summary Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 13, 2011 From the Australian Government, IP Australia Re.: Application No. 2005252469.
Examiner's Report Dated Dec. 17, 2009 From the Australian Government, IP Australia Re.: Application No. 2005252469.
Examiner's Report Dated Dec. 20, 2010 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Examiner's Report Dated Mar. 31, 2011 From the Australian Government, IP Australia Re.: Application No. 2005252469.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jan. 14, 2010 From the International Bureau of WIPO Re.: Application No. PCT/IL2008/000489.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Sep. 7, 2010 From the International Searching Authority Re. Application No. PCT/IB10/50871.
International Search Report and the Written Opinion Dated Feb. 17, 2010 From the International Searching Authority Re.: Application No. PCT/IL09/00508.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB10/56023.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Grant Dated Jan. 14, 2011 From the Instituto Mexicano de la Propriedad Industrial Re. Application No. MX/a/2008/005280.
Office Action Dated Feb. 3, 2011 From the Israel Patent Office Re.: Application No. 172135 and Its Translation Into English.
Office Action Dated Aug. 4, 2010 From the Israel Patent Office Re.: Application No. 172135 and Its Translation Into English.

(56) References Cited

OTHER PUBLICATIONS

Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation into English.
Office Action Dated Jan. 22, 2010 From the State Intellectual Property Office of the People's Republic of China Re.: Application No. 200580027481.4 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jul. 8, 2011 From the US Patent and Trademark Office Re. Application No. 12/083,978.
Official Action Dated Jun. 8, 2010 From the US Patent and Trademark Office Re.: U.S. Appl. No. 11/629,411.
Official Action Dated May 10, 2011 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Requisition by the Examiner Dated Jun. 15, 2011 From the Canadian Intellectual Property Office Re. Application No. 2,526,440.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexicano de la Propriedad Industrial Re. Application No. MX/a/2008/002262 and its Summary Into English.
Response Dated Jan. 4, 2010 to Official Action of Sep. 2, 2009 From the US Patent and Trademark Office Re.: U.S. Appl. No. 11/629,411.
Response Dated Dec. 5, 2010 to Office Action of Aug. 4, 2010 From the Israel Patent Office Re.: Application No. 172135.
Response Dated Jul. 6, 2011 to Examiner's Report of Dec. 20, 2010 From the Australian Government, IP Australia Re. Application No. 2005234725.
Response Dated Jun. 6, 2011 to Official Action of May 10, 2011 From the US Patent and Trademark Office Re. U.S. Appl. No. 12/457,199.
Response Dated Jan. 7, 2010 to Communication Pursuant to Article 94(3) EPC of Sep. 9, 2009 From the European Patent Office Re.: Application No. 04734072.4.
Response Dated Mar. 8, 2011 to Examiner's Report of Jan. 13, 2011 From the Australian Government, IP Australia Re.: Application No. 2005252469.
Response Dated Feb. 9, 2011 to Communication Pursuant to Article 94(3) EPC of Nov. 19, 2010 From the European Patent Office Re.: Application No. 06809784.9.
Response Dated Jun. 9, 2011 to Examiner's Report of Dec. 20, 2011 From the Australian Government, IP Australia Re. Application No. 2005234725.
Response Dated Mar. 9, 2011 to Office Action of Nov. 11, 2010 From the Israel Patent Office Re. Application No. 206118.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009 From the Australian Government, IP Australia Re.: Application No. 2005252469.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Response Dated Oct. 14, 2010 to Office Action of Jun. 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated May 17, 2010 to Office Action of Jan. 22, 2010 From the State Intellectual Property Office of the People's Republic of China Re.: Application No. 200580027481.4.
Response Dated Jan. 19, 2011 to Supplementary European Search Report and the European Search Opinion of Jul. 1, 2010 From the European Patent Office Re. Application No. 07849616.3.
Response Dated Jul. 20, 2011 to Examination Report of May 25, 2011 From the Government of India, Patent Office Re.: Application No. 158/CHENP/2007.
Response Dated Apr. 21, 2011 to Communication Pursuant to Article 94(3) EPC of Nov. 8, 2010 From the European Patent Office Re.: Application No. 04734072.4.
Response Dated Sep. 21, 2010 to Notice of Allowance of Apr. 16, 2010 From the US Patent and Trademark Office Re.: U.S. Appl. No. 11/629,411.
Response Dated Feb. 22, 2010 to Official Action of Oct. 22, 2009 From the US Patent and Trademark Office Re.: U.S. Appl. No. 11/990,386.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Mar. 23, 2011 to Official Action of Nov. 23, 2010 From the US Patent and Trademark Office Re. U.S. Appl. No. 12/083,978.

(56) References Cited

OTHER PUBLICATIONS

Response Dated Feb. 24, 2011 to Communciation Pursuant to Rules 70(2) and 70a(2) EPC of Aug. 30, 2011 From the European Patent Office Re. Application No. 08738191.9.
Response Dated Mar. 24, 2011 to Examination Report of Nov. 3, 2010 From the Government of India, Patent Office Re.: Application No. 158/CHENP/2007.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Response Dated Jul. 25, 2011 to Examiner's Report of Jul. 21, 2011 From the Australian Government, IP Australia Re. Application No. 2005234725.
Response Dated Jun. 29, 2010 to Examination Report of Feb. 17, 2010 From the Instituto Mexicano de la Propriedad Industrial Re. Application No. PA/a/2005/012565.
Response Dated May 31, 2010 to Office Action of Jan. 31, 2010 From the Israel Patent Office Re.: Application No. 172135.
Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated May 6, 2011 From the European Patent Office Re. Application No. 09750276.9.
Supplementary European Search Report and the European Search Opinion Dated Aug. 11, 2010 From the European Patent Office Re. Application No. 08738191.9.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Notice of Payment of the Restoration Fee for Unity of Invention Dated Mar. 20, 2009 From the State Intellectual Property Office of the People's Republic of China Re.: Application No. 200580027481.4.
Translation of Notification of the First Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.
Translation of Office Action Dated Oct. 19, 2010 From the State Intellectual Property Office of the People's Republic of China Re. Application No. 200680038391.X.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/Il04/00431.
Written Opinion Dated Aug. 27, 2008 From the International Searching Authority Re.: Application No. PCT/IL06/00947.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA, Aug. 30-Sep. 3, 2006, XP031235634, p. 953-956, Aug. 30, 2006. p. 953, § 2, 3.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Apse et al. "Engineering Salt Tolerance in Plants", Current Opinion in Biotechnology, XP003018468, 13(2): 146-150, Apr. 1, 2002.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5—col. 2, Line 6, Fig.1.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis Thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Gardiner et al. "*Zea mays* PCO131392 mRNA Sequence", Database EMBL/GenBank/DDBJ, EBI Database Accession No. AY107021, XP002542347, May 28, 2002. 96.5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.

(56) References Cited

OTHER PUBLICATIONS

Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.
Hattori et al. "An Acetohydroxy Acid Synthase Mutant Reveals a Single Site Involved in Multiple Herbicide Resistance", Molecular and General Genetics, 246: 419-425, 1995. Abstract!
Hill et al. "Functional Analysis of Conserved Histidines in ADP-Glucose Pyrophosphorylase From *Escherichia coli*", Biochemical and Biophysical Research Communications, 244(2): 573-577, 1998.
Holmström et al. "Drought Tolerance in Tobacco", Nature, 379: 683-684, 1996. Abstract!
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Ji et al. "*Gossypium hirsutum* Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Jiao et al.
Katavic et al. "Utility of the *Arabidopsis* FAE1 and Yeast SLC1-1 Genes for Improvement in Erucic Acid and Oil Content in Rapeseed", Biochemical Society Transaction, 28(6): 935-937, Dec. 2000.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Keskin et al. "A New, Structurally Nonredundant, Diverse Data Set of Protein-Protein Interfaces and Its Implications", Protein Science, 13: 1043-1055, 2004.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et at "Molecular Cloning of Low-Temperature-Inducible Ribosomal Proteins From Soybean", Journal of Experimental Botany, 55(399): 1153-1155, 2004.
Kirkness et al. "*Lycopersicon esculentum* Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Liu et al. "Root-Specific Expression of a Western White Pine PR10 Gene is Mediated by Different Promoter Regions in Transgenic Tobacco", Plant Molecular Biology, 52: 103-120, 2003.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig.1.
McConnell et al. "Role of Piiabulosa and Piiavoluta in Determining Radial Patterning in Shoots", Nature, 411(6338): 709-713, Jun. 7, 2001.
Merriam-Webster "Exogenous Definition", Merrian-Webster On-Line Dictionary, 2010.
Moderhak et al. "Problems of 3D Breast Imaging", Gdansk University of Technology, Department of Biomedical Engineering, 2 P.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL[Online], Retreieved From EBI Accession No. EMBL, Database Accession No. AY453393, 2004.
Payne et al. "Heterologous MYB Genes Distinct From GL1 Enhance Trichome Production When Overexpressed in *Nicotiana tabacum*", Development, 126: 671-682, 1999.
Pilon-Smits et al. "Improved Performance of Transgenic Fructan-Accumulating Tobacco under Drought Stress", Plant Physiology, 107: 125-130, 1995.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaCl Tolerance in *Arabidopsis*", Plant Physiology, 130: 951-963, 2002. Abstract!
Saez-Vasquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Smart et al. "MIP Genes Are Down-Regulated Under Drought Stress in *Nicotiana glauca*", Plant and Cell Physiology, XP002455682, 42(7): 686-693, 2001. p. 686, Reference to Database Entry AF290618, p. 692, 1-h col., § 2.
Smart et al. "*Nicotiana glauca* Putative Delta TIP (MIP2) mRNA, Complete Cds", Database EMBL [Online], Retrieved From EBI Accession No. EMBL: AF290618, XP002455682, Database Accession No. AF290618.
Sunkar et al. "Small RNAs as Big Players in Plant Abiotic Stress Responses and Nutrient Deprivation", Trends in Plant Science, XP022148764, 12(7): 301-309, Jul. 1, 2007.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.

(56) References Cited

OTHER PUBLICATIONS

Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Tarczynski et al. "Stress Protection of Transgenic Tobacco by Production of the Osmolyte Mannitol", Science, 259: 508-510, 1993. Abstract!
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218814, XP002455680, Database Accession No. AW218814, May 21, 2001. Abstract.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, XP002455681, Database Accession No. AW218815. Abstract.
Van der Hoeven et al. "EST312975 Tomato Root During/After Fruit Set, Cornell University *Solanum lycopersicum* cDNA Clone cLEX14O20 5-, mRNA Sequence", GenBank, GenBank Accession No. AW622177.1.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
van Haaren et al. "A Functional Map of the Fruit-Specific Promoter of the Tomato 2A11 Gene", Plant Molecular Biology, 21: 625-640, 1993. Abstract!
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004.
Wang et al. "Control of Plant Trichome Development by a Cotton Fiber MYB Gene", The Plant Cell, 16: 2323-2334, Sep. 2004. GenEmbl Database, Accession No. AY641990.
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Wells "Additivity of Mutational Effects in Proteins", Biochemistry, 29 (37): 8509-8517, 1990.
Wing et al. "An Integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.

Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yamada et al. "*Arabidopsis thaliana* Clone RAFL,14-87-A16 (R20399) Unknown Protein (At1g60770) mRNA, Complete Cds", GenBank Accession No. BT002876, Retrieved From the Internet, Jan. 21, 2010.
Yamada et al. "*Arabidopsis thaliana*Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Yanagisawa et al. "Diversity and Similarity Among Recognition Sequences of Dof Transcription Factors", The Plant Journal, 17(2): 209-214, 1999.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Zabrouskov et al. "Oxidative Metabolism and the Physiological Age of Seed Potatoes are Affected by Increased Alpha-Linolenate Content", Physiologia Plantarum, 116: 172-185, 2002.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
International Preliminary Report on Patentability Dated Sep. 15, 2011 From the International Bureau of WIPO Re. Application No. PCT/IB2010/050871.
Official Action Dated Aug. 22, 2011 From the US Patent and Trademark Office Re. U.S. Appl. No. 12/457,199.
Johansson et al. "The Role of Aquaporins in Cellular and Whole Plant Water Balance," Biochimica et Biophysica Acta 1465: 324-342, 2000.
Whisstock et al. "Prediction of Protein Function from Protein Sequence and Structure," Quarterly Reviews of Biophysics 36 (3): 307-340, Aug. 2003.
European Search Report and the European Search Opinion Dated Oct. 6, 2011 From the European Patent Office Re. Application No. 11172514.9.
Response Dated Oct. 3, 2011 to Examiner's Report of Jun. 24, 2011 From the Australian Government, IP Australia Re. Application No. 2006281018.
Response Dated Oct. 4, 2011 to Official Action of Jul. 8, 2011 From the US Patent and Trademark Office Re. U.S. Appl. No. 12/083,978.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA PNAS, XP002967292, 97(14): 7969-7974, Jul. 5, 2000.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus *Solanum lycopersicum* cDNA Clone cLEC80A19 5-end, mRNA Sequence", GenBank: BI923254.1, GenDank Accession No. BI923254, Oct. 17, 2001.
European Search Report and the European Search Opinion Dated Nov. 2, 2011 From the European Patent Office Re. Application No. 10194223.3.

(56) References Cited

OTHER PUBLICATIONS

Examiner's Report Dated Oct. 19, 2011 From the Australian Government, IP Australia Re. Application No. 2006281018.
Examiner's Report Dated Oct. 28, 2011 From the Australian Goverment, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Response Dated Dec. 19, 2011 to Examiner's Report of Oct. 19, 2011 From the Australian Government, IP Australia Re. Application No. 2006281018.
Response Dated Jun. 29, 2011 to Communication Pursuant to Article 94(3) EPC of Mar. 8, 2011 From the European Patent Office Re.: Application No. 06809784.9.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Official Action Dated Dec. 21, 2011 From the US Patent and Trademark Office Re. U.S. Appl. No. 12/810,855.
Davletova et al. "The Zinc-Finger Protein Zat12 Plays a Central Role in Reactive Oxygen and Abiotic Stress Signaling in *Arabidopsis*", Plant Physiology, 139: 847- 856, Oct. 2005.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
Examination Report Dated Mar. 13, 2013 From the Instituto Mexican de la Propiedad Industrial Re. Application No. PA/a/2005/009380 and Its Summary in English.

Requisition—Sequence Listing Dated May 8, 2013 From the Canadian Intellectual Property Office Re. Application No. 2,753,616.
Response Dated Sep. 25, 2011 to Examiner's Report of Jun. 30, 2011 From the Australian Government, IP Australia Re. Application No. 2006307457.
Official Action Dated Sep. 19, 2011 From the US Patent and Trademark Office Re. U.S. Appl. No. 12/810,855.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Bautista et al. "*Arabidopsis thaliana* At5g06690 mRNA, Complete Cds", Unpublished, The Salk Institute for Biological Studies, La Jolla, CA, USA, GenBank: BT029447, Nov. 15, 2006.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM PL: BT022032.1, Database Accession No. BT022032, May 4, 2005.
Matsumoto et al. "*Hordeum vulgare* Subsp. *vulgare*, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig. S6, p. 1844-1845.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Yanagisawa et al. "Metabolic Engineering With Dof1 Transcription Factor in Plants: Improved Nitrogen Assimilation and Growth Under

(56) References Cited

OTHER PUBLICATIONS

Low-Nitrogen Conditions", Proc. Natl. Acad. Sci. USA, PNAS, 101(20): 7833-7838, May 18, 2004.
Translation of Office Action Dated Sep. 13, 2012 From the State Intellectual Property Office of the People's Republic of China Re. Application No. 200910217137.1.
Restriction Official Action Dated Nov. 13, 2012 From the US Patent and Trademark Office Re. U.S. Appl. No. 12/992,902.
Backhaus et al. "Nucleotide Sequence of A cDNA for a P2 60S Acidic Ribosomal Protein From *Parthenium argentatum*", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Response Dated Oct. 18, 2011 to Official Action of Sep. 19, 2011 From the US Patent and Trademark Office Re. U.S. Appl. No. 12/810,855.
Communication Under Rule 71(3) EPC Dated Nov. 19, 2012 From the European Patent Office Re. Application No. 08738191.9.
Patent Examination Report Dated Dec. 12, 2012 From the Australian Government, IP Australia Re. Application No. 2008236316.
International Search Report and the Written Opinion Dated Dec. 6, 2011 From the International Searching Authority Re. Application No. PCT/IB2011/051843.
Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government, IP Australia Re. Application No. 2008278654.
Official Action Dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TIG, 14(6): 248-250, Jun. 1998.
Smith et al. "The Challenges of Genome Sequence Annotation or "The Devil is in the Details"", Nature Biotechnology, 15: 1222-1223, Nov. 1997.
Applicant-Initiated Interview Summary Dated Dec. 20, 2013 From the US Patent and Trademark Office Re. U.S. Appl. No. 13/125,047.
Examination Report Dated May 23, 2013 From the Instituto Mexicano de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.

Substantive Examination Report Dated Jul. 31, 2013 From the Intellectual Property Office of the Philippines, Bureau of Patents Re. Application No. 1/2009/501930.
Communication Pursuant to Article 94(3) EPC Dated Oct. 9, 2013 From the European Patent Office Re. Application No. 08869158.9.
Communication Pursuant to Article 94(3) EPC Dated Aug. 20, 2013 From the European Patent Office Re. Application No. 11172514.9.
International Search Report and the Written Opinion Dated Sep. 1, 2013 From the International Searching Authority Re. Application No. PCT/IB2013/054374.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Official Action Dated Sep. 16, 2013 From the US Patent and Trademark Office Re. U.S. Appl. No. 13/125,047.
Official Action Dated Sep. 20, 2013 From the US Patent and Trademark Office Re. U.S. Appl. No. 12/669,975.
Supplementary European Search Report and the European Search Opinion Dated Oct. 15, 2013 From the European Patent Office Re. Application No. 10840687.7.
Translation of Office Action Dated Aug. 28, 2013 From the State Intellectual Property Office of the People's Republic of China Re. Application No. 200880109464.9.
Bennetzen et al. "*Setaria italica* Strain Yugul SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
Clontech "Genome Walker™ Universal Kit User Manual", Clontech Laboratories Inc., Cat. No. 638904, PT3042-1 (PR742239), p. 1-30, Apr. 25, 2007.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and is Used for the Same Purpose, Abstract, Sequence.
NCBI "Predicted: Nudix Hydrolase 16, Mitochondrial-Like [*Setaria italica*]", Database NCBI [Online], NCBI Reference Sequence: XP_004955808, Jun. 26, 2013.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propicdad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 *Arabidopsis* Genes Under Drought, Cold and High-Salinity Stresses Using a Full-Length cDNA Microarray", The Plant Journal, 31(3): 279-292, 2002.

(56) References Cited

OTHER PUBLICATIONS

Tobias et al. "Structure of the Cinnamyl-Alcohol Dehydrogenase Gene Family in Rice and Promoter Activity of a Member Associated With Lignification", Planta, 220: 678-688, 2005.
Requisition by the Examiner Dated Aug. 27, 2013 From the Canadian Intellectual Property Office Re. Application No. 2,526,440.
Notice of Allowance Dated Nov. 15, 2013 From the US Patent and Trademark Office Re. U.S. Appl. No. 12/669,975.
Advisory Action Before the Filing of an Appeal Brief Dated Nov. 19, 2013 From the US Patent and Trademark Office Re. U.S. Appl. No. 12/834,106.
International Search Report and the Written Opinion Dated Nov. 19, 2013 From the International Searching Authority Re. Application No. PCT/IL2013/050725.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Examination Report Dated Dec. 16, 2013 From the Government of India, Patent Office, Intellectual Property Building Re. Application No. 2570/CHENP/2008.
Li et al. "Dehydration-Induced Protein RD22-Like Protein [*Gossypium hirsutum*]", NCBI Database [Online], GenBank: AAL67991.1, GenBank Accession No. AAL67991, Dec. 4, 2002.
Examination Report Dated Oct. 1, 2013 From the Instituto Mexicano de la Propiedad Industrial Re. Application No. MX/a/2010/000975 and Its Translation Into English.
International Preliminary Report on Patentability Dated Nov. 14, 2013 From the International Bureau of WIPO Re. Application No. PCT/IL2012/050154.
Applicant-Initiated Interview Summary Dated Nov. 20, 2013 From the US Patent and Trademark Office Re. U.S. Appl. No. 13/125,047.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
International Search Report and the Written Opinion Dated Aug. 6, 2012 From the International Searching Authority Re. Application No. PCT/IB11/53697.
Daniell et al. "*Solanum bulbocastanum* Chloroplast, Complete Genome", GenBank NCBI, Accession No. NC_007943, Mar. 26, 2010. p. 1, Source, p. 10-11, Nucleotides 46590-47195, Gene 'RPS4'.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:IIV067703, Database Accession No. IIV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99.6% Identity to Present SEQ ID No. 7 Over 488 Nucleotides. Abstract, Sequence.
La Rosa et al. "*Oryza sativa* Nucleotide Sequence SEQ ID No. 31205", Database Geneseq [Online], X0002678024, Retrieved From EBI Accession No. GSN:ANL17203, Database Accession No. ANL17203, Dec. 28, 2007. Sequence.
Communication Pursuant to Article 94(3) EPC Dated Jul. 10, 2014 From the European Patent Office Re. Application No. 10748403.2.
Patent Examination Report Dated Sep. 10, 2014 From the Australian Government, IP Australia Re. Application No. 2010220157.

\* cited by examiner

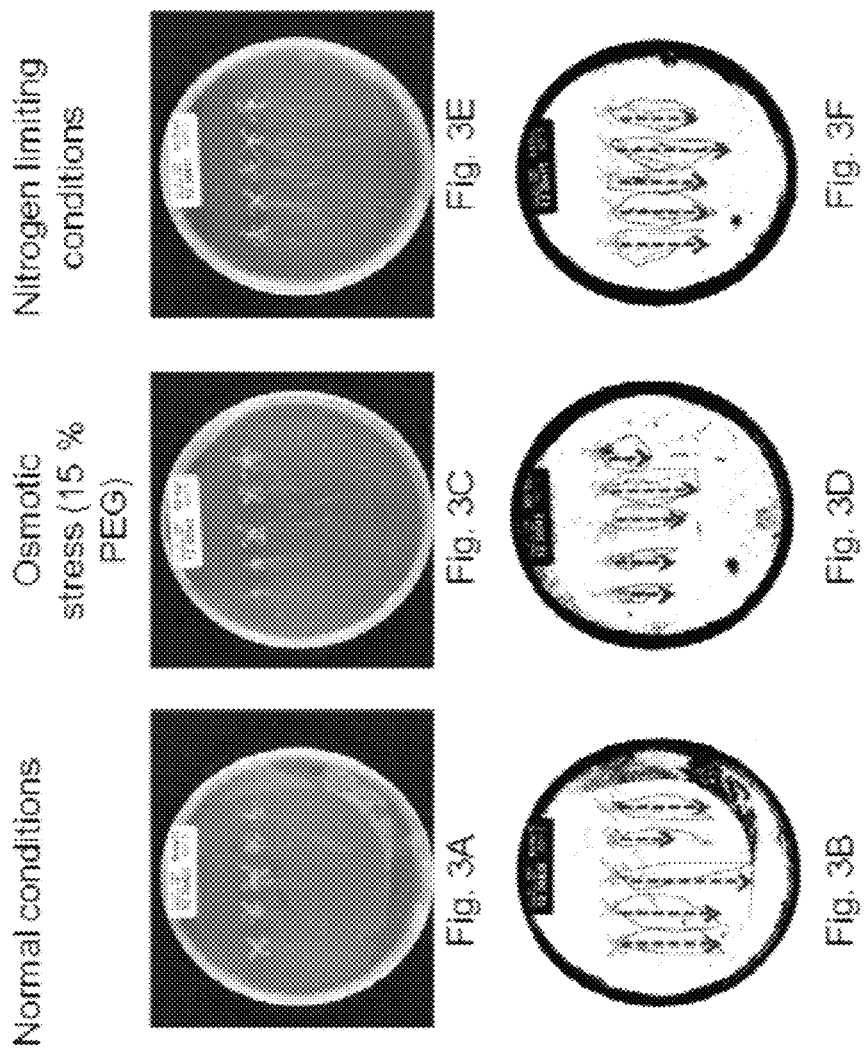

ISOLATED POLYNUCLEOTIDES AND POLYPEPTIDES, AND METHODS OF USING SAME FOR INCREASING PLANT YIELD, BIOMASS, VIGOR AND/OR GROWTH RATE OF A PLANT

RELATED APPLICATIONS

This application is a National Phase of PCT Patent Application No. PCT/IB2010/050871 having International filing date of Mar. 1, 2010, which claims the benefit of priority of U.S. Provisional Patent Application Nos. 61/282,183 filed on Dec. 28, 2009, 61/231,349 filed on Aug. 5, 2009 and 61/202,459 filed on Mar. 2, 2009. The contents of the above applications are all incorporated herein by reference.

FIELD AND BACKGROUND OF THE INVENTION

The present invention, in some embodiments thereof, relates to isolated polynucleotides and polypeptides which can increase the yield (e.g., biomass, grain quantity and/or quality), growth rate, vigor, abiotic stress tolerance (ABST), water use efficiency (WUE), nitrogen use efficiency (NUE) and/or fertilizer use efficiency (FUE) of a plant.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn night's, can lead to photoinhibition of photosynthesis (disruption of photosynthesis). In addition, chilling may lead to yield losses and lower product quality through the delayed ripening of maize.

Suboptimal nutrient (macro and micro nutrient) affect plant growth and development through the whole plant life cycle. One of the essential macronutrients for the plant is Nitrogen. Nitrogen is responsible for biosynthesis of amino acids and nucleic acids, prosthetic groups, plant hormones, plant chemical defenses, and the like. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Additional important macronutrients are Phosphorous (P) and Potassium (K), which have a direct correlation to yield and general plant tolerance.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, oils and metabolites used in industrial processes. The ability to increase plant yield, whether through increase dry matter accumulation rate, modifying cellulose or lignin composition, increase stalk strength, enlarge meristem size, change of plant branching pattern, erectness of levees, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

SUMMARY OF THE INVENTION

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 3487, 1-239, 467-1973, 3481-3486, 3488-3674, 3738 or 3739, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 3487, 1-239, 467-1973, 3481-3486, 3488-3674, and 3738-3739, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least 80% identical to SEQ ID NO: 246, 240-245, 247-465, 1974-3480, 3675-3736 or 3737, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 246, 240-245, 247-465, 1974-3480, and 3675-3737, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided an isolated polynucleotide comprising a nucleic acid sequence at least 80% identical to SEQ ID NO: 3487, 1-239, 467-1973, 3481-3486, 3488-3674, 3738 or 3739, wherein said nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising the nucleic acid sequence selected from the group consisting of SEQ ID NOs: 3487, 1-239, 467-1973, 3481-3486, 3488-3674, and 3738-3739.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 246, 240-245, 247-465, 1974-3480, 3675-3736 or 3737, wherein said nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 246, 240-245, 247-465, 1974-3480, and 3675-3737.

According to an aspect of some embodiments of the present invention there is provided a nucleic acid construct comprising the isolated polynucleotide of claim 5, 6, 7 or 8, and a promoter for directing transcription of said nucleic acid sequence in a host cell.

According to an aspect of some embodiments of the present invention there is provided an isolated polypeptide comprising an amino acid sequence at least 80% homologous to SEQ ID NO: 246, 240-245, 247-465, 1974-3480, 3675-3736 or 3737, wherein said amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polypeptide comprising the amino acid sequence selected from the group consisting of SEQ ID NOs: 246, 240-245, 247-465, 1974-3480, and 3675-3737.

According to an aspect of some embodiments of the present invention there is provided a plant cell exogenously expressing the polynucleotide of claim 5, 6, 7 or 8 or the nucleic acid construct of claim 9.

According to an aspect of some embodiments of the present invention there is provided a plant cell exogenously expressing the polypeptide of claim 10 or 11.

According to some embodiments of the invention, the nucleic acid sequence is as set forth in SEQ ID NO: 3487, 1-239, 467-1973, 3481-3486, 3488-3674, 3738 or 3739.

According to some embodiments of the invention, the polynucleotide consists of the nucleic acid sequence selected from the group consisting of SEQ ID NOs: 3487, 1-239, 467-1973, 3481-3486, 3488-3674, and 3738-3739.

According to some embodiments of the invention, the nucleic acid sequence encodes an amino acid sequence at least 80% homologous to SEQ ID NO: 246, 240-245, 247-465, 1974-3480, 3675-3736 or 3737.

According to some embodiments of the invention, the nucleic acid sequence encodes the amino acid sequence selected from the group consisting of SEQ ID NOs: 246, 240-245, 247-465, 1974-3480, and 3675-3737.

According to some embodiments of the invention, the plant cell forms a part of a plant.

According to some embodiments of the invention, the abiotic stress is selected from the group consisting of salinity, drought, water deprivation, low temperature, high temperature, heavy metal toxicity, anaerobiosis, nutrient deficiency, nutrient excess, atmospheric pollution and UV irradiation.

According to some embodiments of the invention, the method further comprising growing the plant under the abiotic stress.

According to some embodiments of the invention, the method, further comprising growing the plant under nitrogen-limiting conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
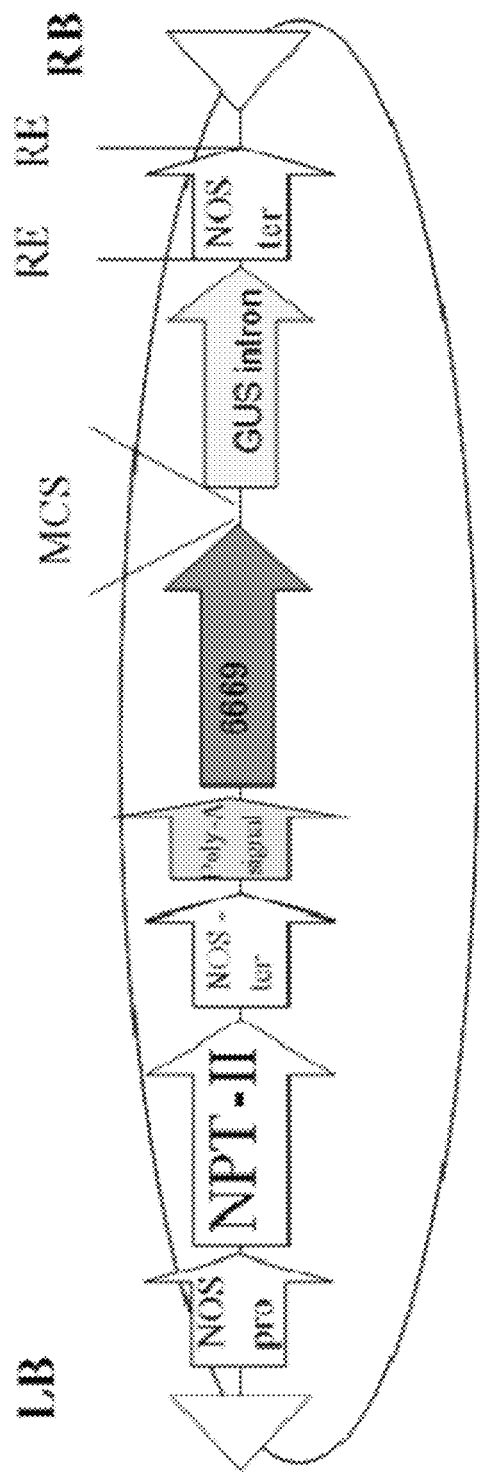
FIG. 1 is a schematic illustration of the modified pGI binary plasmid containing the new At6669 promoter (SEQ ID NO:4198) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUSintron reporter gene.

The present invention, in some embodiments thereof, relates to isolated polynucleotides and polypeptides which can increase yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polynucleotides and polypeptides which can be used in increasing yield, biomass, growth rate, vigor, oil content, fiber yield, fiber quality abiotic stress tolerance, and/or fertilizer use efficiency (e.g., nitrogen use efficiency) of a plant.

As shown in the Examples section which follows, the present inventors have employed a bioinformatic approach which combines clustering and assembly of sequences from databases of arabidopsis, rice, poplar, brachypodium, soybean, grape, castobean, sorghum and maize and other publicly available plant genomes, expressed sequence tags (ESTs), mRNA sequences, properitary ESTs sequences (Barley, Sorghum), protein and pathway databases, quantitative trait loci (QTL), single nucleotide polymorphism (SNPs) information with a digital expression profile ("electronic Northern Blot") and identified polynucleotides and polypeptides which can increase yield, growth rate, biomass, vigor, tolerance to abiotic stress, nitrogen use efficiency, water use efficiency and fertilizer use efficiency (SEQ ID NOs:1-239 for polynucleotides; SEQ ID NOs:240-465 for polypeptides; Table 1, Example 1). Orthologs from plant species which exhibit at least 80% homology to the identified polypeptides and polynucleotides were also identified (SEQ ID NO:467-1973 for polynucleotides; SEQ ID NOs:1974-3480 for polypeptides; Table 2, Example 1). Selected genes were cloned (Example 7, Tables 26-28), transformed into agrobacterium tumefaciens cells (Example 8) and further into arabidopsis plants (Example 9). Transgenic plants over-expressing the identified polynucleotides were found to exhibit increased seed yield, oil yield, dry weight, fresh weight, root coverage, root length, harvest index, growth rate, rosette area, biomass, oil percentage in seed and weight of 1000 seeds (Examples 10-11; Tables 29-36), and increased tolerance to abiotic stress conditions such as limiting nitrogen conditions (Example 11, Tables 37-38). Thus, the identified polynucleotides and polypeptides of the invention can be used to increase plant's yield, biomass (e.g., of grain or any harvestable plant part with economical value), vigor, growth rate, oil content, fiber yield, fiber quality, tolerance to abiotic stress, nitrogen use efficiency, water use efficiency and/or fertilizer use efficiency.

Thus, according to an aspect of some embodiments of the invention there is provided a method of increasing a yield, biomass, growth rate, vigor, oil content, fiber yield, fiber quality, water use efficiency, nitrogen use efficiency, fertilizer use efficiency and/or abiotic stress tolerance of a plant.

The method is effected by expressing within the plant an exogenous polynucleotide comprising a nucleic acid sequence at least 80% identical to SEQ ID NO: 3487, 1-239, 467-1973, 3481-3486, 3488-3674, 3738 or 3739, thereby increasing the yield, biomass, growth rate, vigor, oil content, fiber yield, fiber quality, water use efficiency, nitrogen use efficiency, fertilizer use efficiency and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

As used herein the phrase "fiber producing plant" refers to plants that share the common feature of having an elongated shape and abundant cellulose in thick cell walls, typically termed as secondary walls. Such walls may or may not be lignified, and the protoplast of such cells may or may be viable at maturity. Such fibers have many industrial uses, for example in lumber and manufactured wood products, paper, textiles, sacking and boxing material, cordage, brushes and brooms, filling and stuffing, caulking, reinforcement of other materials, and manufacture of cellulose derivatives.

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp.(e.g. sisal).

According to a preferred embodiment of this aspect of the present invention the fiber producing plant is cotton.

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80% or greater increase in plant yield, biomass, growth rate, vigor, oil content, fiber yield, fiber quality, water use efficiency, nitrogen use efficiency, fertilizer use efficiency and/or abiotic stress tolerance as compared to a native plant [i.e., a plant not modified with the biomolecules (polynucleotide or polypeptides) of the invention, e.g., a non-transformed plant of the same species which is grown under the same growth conditions as the transformed plant].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide comprises a nucleic acid which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 3487, 1-239, 467-1973, 3481-3486, 3488-3674, and 3738-3739.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 3487, 1-239, 467-1973, 3481-3486, 3488-3674, and 3738-3739.

According to some embodiments of the invention the exogenous polynucleotide consists of the nucleic acid sequence set forth in SEQ ID NO: 3487, 1-239, 467-1973, 3481-3486, 3488-3674, 3738 or 3739.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 246, 240-245, 247-465, 1974-3480, and 3675-3737.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO: 246, 240-245, 247-465, 1974-3480, 3675-3736 or 3737.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is:

$$1\ SDCU = n = 1\ N[(X_n - Y_n)/Y_n]2/N, \qquad \text{Formula I}$$

where $X_n$ refers to the frequency of usage of codon n in highly expressed plant genes, where $Y_n$ to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot)

jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs:37 and 43.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 3487, 1-239, 467-1973, 3481-3486, 3488-3674, and 3738-3739.

According to some embodiments of the invention the nucleic acid sequence is capable of increasing yield, biomass, growth rate, vigor, oil content, fiber yield, fiber quality, water use efficiency, nitrogen use efficiency, fertilizer use efficiency and/or abiotic stress tolerance of a plant.

According to some embodiments of the invention the isolated polynucleotide consists of a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 3487, 1-239, 467-1973, 3481-3486, 3488-3674, and 3738-3739.

According to some embodiments of the invention the isolated polynucleotide comprising the nucleic acid sequence selected from the group consisting of SEQ ID NOs: 3487, 1-239, 467-1973, 3481-3486, 3488-3674, and 3738-3739.

According to some embodiments of the invention the isolated polynucleotide is set forth by SEQ ID NO: 3487, 1-239, 467-1973, 3481-3486, 3488-3674, 3738 or 3739.

According to some embodiments of the invention the isolated polynucleotide consists of a nucleic acid sequence selected from the group of SEQ ID NOs: 3487, 1-239, 467-1973, 3481-3486, 3488-3674, and 3738-3739.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 246, 240-245, 247-465, 1974-3480, and 3675-3737.

According to some embodiments of the invention the amino acid sequence is capable of increasing yield, biomass, growth rate, vigor, oil content, fiber yield, fiber quality, water use efficiency, nitrogen use efficiency, fertilizer use efficiency and/or abiotic stress tolerance of a plant.

The invention provides an isolated polynucleotide comprising a nucleic acid sequence encoding a polypeptide which comprises the amino acid sequence selected from the group consisting of SEQ ID NOs: 246, 240-245, 247-465, 1974-3480, and 3675-3737.

The invention provides an isolated polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 246, 240-245, 247-465, 1974-3480, and 3675-3737.

According to some embodiments of the invention, the isolated polypeptide is selected from the group consisting of SEQ ID NOs: 246, 240-245, 247-465, 1974-3480, and 3675-3737.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the super-family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp., *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar, cotton and sorghum.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter capable of directing transcription of the exogenous polynucleotide in the plant cell. Further details of suitable transformation approaches are provided herein below.

According to some embodiments of the invention, there is provided a nucleic acid construct comprising the isolated polynucleotide of the invention, and a promoter for directing transcription of the nucleic acid sequence of the isolated polynucleotide in a host cell. According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. According to some embodiments of the invention, the promoter is a constitutive promoter, a tissue-specific, or an abiotic stress-inducible promoter.

Suitable constitutive promoters include, for example, CaMV 35S promoter (SEQ ID NO:4196; Odell et al., Nature 313:810-812, 1985); *Arabidopsis* At6669 promoter (SEQ ID NO:4195; see PCT Publication No. WO04081173A2); *Arabidopsis* new At6669 promoter (SEQ ID NO:4198); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1);107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al., Plant Mol Biol, 143).323-32 1990), napA (Stalberg, et al., Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al., The Plant Journal, 116(1): 53-62, 1998), Biz2 (EP99106056.7), Synthetic promoter (Vicente-Carbajosa et al., Plant J. 13: 629-640, 1998), rice prolamin NRP33, rice -globulin Glb-1 (Wu et al., Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorghum gamma-kafirin (PMB 32:1029-35, 1996); e.g., the Napin promoter (SEQ ID NO:4197)], embryo specific promoters [e.g., rice OSH1 (Sato et al., Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al., Mol. Gen Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et al., Plant Mol. Biol. 21:259-266, 1993), maize rab28 gene promoter (Busk et al., Plant J. 11:1285-1295, 1997) and maize Ivr2 gene promoter (Pelleschi et al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in E. coli (wherein the construct comprises an appropriate selectable marker and origin of replication) and be compatible with propagation in cells. The construct according to some embodiments of the invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) Agrobacterium-mediated gene transfer (e.g., T-DNA using Agrobacterium tumefaciens or Agrobacterium rhizogenes); see for example, Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The Agrobacterium system includes the use of plasmid vectors that contain defined DNA segments that integrate into the plant genomic DNA. Methods of inoculation of the plant tissue vary depending upon the plant species and the Agrobacterium delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the Agrobacterium delivery system in combination with vacuum infiltration. The Agrobacterium system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. For this reason it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotide is selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since yield (or other parameters affecting yield such as growth rate, biomass, vigor, content of seeds, oil content and the like), fiber yield and/or quality, water use efficiency, fertilizer use efficiency, nitrogen use efficiency and/or abiotic stress tolerance in plants can involve multiple genes acting additively or in synergy (see, for example, in Quesda et al., Plant Physiol. 130:951-063, 2002), the invention also envisages expressing a plurality of exogenous polynucleotides in a single host plant to thereby achieve superior effect on yield, fiber yield and/or quality, water use efficiency, fertilizer use efficiency, nitrogen use efficiency and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides can be effected by introducing different nucleic acid constructs, including different exogenous polynucleotides, into a plurality of plants. The regenerated transformed plants can then be cross-bred and resultant progeny selected for superior yield (e.g., growth rate, biomass, vigor, oil content), fiber yield and/or quality, water use efficiency, fertilizer use efficiency, nitrogen use efficiency and/or abiotic stress tolerance traits, using conventional plant breeding techniques.

According to some embodiments of the invention, the plant expressing the exogenous polynucleotide(s) is grown under non-stress or normal conditions (e.g., biotic conditions and/or conditions with sufficient water, nutrients such as nitrogen and fertilizer). Such conditions, which depend on the plant being grown, are known to those skilled in the art of agriculture, and are further, described hereinbelow.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, fiber yield and/or quality, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention can be screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Plant's growth rate, biomass, yield and/or vigor—Plant vigor can be calculated by the increase in growth parameters such as leaf area, fiber length, rosette diameter, plant fresh weight and the like per time.

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be also done by measuring plant biomass produced, rosette area, leaf size or root length per time (can be measured in $cm^2$ per day of leaf area).

Relative growth area can be calculated using Formula II.

Relative growth rate area=Regression coefficient of area along time course    Formula II Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

Seed yield can be expressed as thousand kernel weight (1000-weight), which is extrapolated from the number of filled seeds counted and their total weight. Hence, an increased 1000-weight may result from an increased seed size and/or seed weight (e.g., increase in embryo size and/or endosperm size). For example, the weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000    Formula III

The Harvest Index can be calculated using Formula IV

Harvest Index=Average seed yield per plant/Average dry weight    Formula IV

Since the transgenic plants of the invention have increased yield, it is likely that these plants exhibit an increased growth rate (during at least part of their life cycle), relative to the growth rate of corresponding wild type plants at a corresponding stage in their life cycle. The increased growth rate may be specific to one or more parts of a plant (including seeds), or may be throughout substantially the whole plant. A plant having an increased growth rate may also exhibit early flowering. Increased growth rate during the early stages in the life cycle of a plant may reflect enhanced vigor. The increase in growth rate may alter the harvest cycle (early maturing) of a plant allowing plants to be sown later and/or harvested sooner than would otherwise be possible. If the growth rate is sufficiently increased, it may allow for the sowing of further seeds of the same plant species (for example sowing and harvesting of rice plants followed by sowing and harvesting of further rice plants all within one conventional growing period). Similarly, if the growth rate is sufficiently increased, it may allow for the sowing of further seeds of different plants species (for example the sowing and harvesting of rice plants followed by, for example, the sowing and optional harvesting of soybean, potato or any other suitable plant). Harvesting additional times from the same rootstock in the case of some plants may also be possible. Altering the harvest cycle of a plant may lead to an increase in annual biomass production per area (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, high or low light conditions, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution with added salt), or by culturing the plants in a hyperosmotic growth medium [e.g., 50% Murashige-Skoog medium (MS medium) with added salt]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of chlorosis and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and PEG assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress experiments, the medium is supplemented for example with 50 mM, 100 mM, 200 mM NaCl or 15%, 20% or 25% PEG.

Drought tolerance assay—Soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as drought stress tolerant plants Cold stress tolerance—One way to analyze cold stress is as follows. Mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between control and transgenic plants, by measuring plant weight (wet and dry), and by comparing growth rates measured as time to flowering, plant size, yield, and the like.

Heat stress tolerance—One way to measure heat stress tolerance is by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

Water use efficiency (WUE)—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula V:

$$RWC = (FW - DW/TW - DW) \times 100 \quad \text{Formula V}$$

Plants that maintain high relative water content (RWC) compared to control lines are considered more tolerant to drought than those exhibiting reduced relative water content. A non limiting example in *Arabidopsis* is when water uptake by roots matches water loss by transpiration from leaves. Under these circumstances the plant is determined to be under equilibrium and the RWC is about 0.9. When the RWC of transgenic plants decreases significantly less as compared to wild type plants, the transgenic plants are considered more tolerant to drought [Gaxiola et al. PNAS Sep. 25, 2001 vol. 98 no. 20 11444-11449].

Fertilizer use efficiency—To analyze whether the transgenic plants are more responsive to fertilizers, plants are grown in agar plates or pots containing growth media with a limited amount of fertilizer (e.g., nitrogen, phosphate, potassium), essentially as described in Yanagisawa et al (Proc Natl Acad Sci USA. 2004; 101:7833-8). The plants are analyzed for their overall size, time to flowering, yield, protein content of shoot, grain and/or seed production. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots, oil content, etc. In this way, nitrogen use efficiency (NUE), phosphate use efficiency (PUE) and potassium use efficiency (KUE) are assessed, checking the ability of the transgenic plants which express the exogenous polynucleotide of the invention to thrive under nutrient restraining conditions. For example, to analyze whether the transgenic *Arabidopsis* plants are more responsive to phosphate, plants are grown in 250 mM (phosphate deficient conditions) or 1 mM (optimal phosphate concentration). To test the potassium use efficiency, *Arabidopsis* plants which express the exogenous polynucleotide of the invention are grown in 0.03 mM potassium (potassium deficient conditions) or 3 mM potassium (optimal potassium concentration) essentially as described by Watson et al. Plant Physiol. (1996) 111: 1077-1083.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Nitrogen use efficiency—To analyze whether the transgenic *Arabidopsis* plants are more responsive to nitrogen plant are grown in 0.75-1.5 mM (nitrogen deficient conditions) or 6-10 mM (optimal nitrogen concentration). Plants are allowed to grow for additional 20 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.2 mM or 0.05 mM. Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 25 seedlings (each one representing an independent transformation event) are carefully transferred to the nitrogen-limiting media. For constructs for which T2 seeds are available, different transformation events are analyzed. Usually, 25 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter are used as control.

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Thus, the present invention is of high agricultural value for promoting the yield, biomass, growth rate, vigor, water use efficiency, fertilizer use efficiency, nitrogen use efficiency and abiotic stress tolerance of commercially desired crops (e.g., biomass of vegetative organ such as poplar wood, or reproductive organ such as number of seeds or seed biomass).

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683, 202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identify Genes which Improve Yield and Agronomical Important Traits in Plants

The present inventors have identified polynucleotides which expression thereof in plants can increase yield, fiber yield, fiber quality, growth rate, vigor, biomass, growth rate, oil content, abiotic stress tolerance (ABST), nitrogen use efficiency (NUE), water use efficiency (WUE) and fertilizer use efficiency (FUE) of a plant, as follows.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes
  Arabidopsis genome [TAIR genome version 6 (Hypertext Transfer Protocol://World Wide Web (dot) arabidopsis (dot) org/)]
  Rice genome [IRGSP build 4.0 (Hypertext Transfer Protocol://rgp (dot) dna (dot) affrc (dot) go (dot) jp/IRGSP/)].
  Poplar [Populus trichocarpa release 1.1 from JGI (assembly release v1.0) (Hypertext Transfer Protocol://World Wide Web (dot) genome (dot) jgi-psf (dot) org/)]
  Brachypodium [JGI 4× assembly, Hypertext Transfer Protocol://World Wide Web (dot) brachpodium (dot) org)]
  Soybean [DOE-JGI SCP, version Glyma0 (Hypertext Transfer Protocol://World Wide Web (dot) phytozome (dot) net/)]
  Grape [French-Italian Public Consortium for Grapevine Genome Characterization grapevine genome (Hypertext Transfer Protocol://World Wide Web (dot) genoscope (dot) cns (dot) fr/)]
  Castobean [TIGR/J Craig Venter Institute 4× assembly [(Hypertext Transfer Protocol://msc (dot) jcvi (dot) org/r communis]
  Sorghum [DOE-JGI SCP, version Sbi1 [Hypertext Transfer Protocol://World Wide Web (dot) phytozome (dot) net/)].
  Partially assembled genome of Maize [Hypertext Transfer Protocol://maizesequence (dot) org/]

Expressed EST and mRNA Sequences were Extracted from the Following Databases:
  GeneBank versions 154, 157, 160, 161, 164, 165, 166 and 168 (Hypertext Transfer Protocol://World Wide Web (dot) ncbi (dot) nlm (dot) nih (dot) gov/dbEST/)
  RefSeq (Hypertext Transfer Protocol://World Wide Web (dot) ncbi (dot) nlm (dot) nih (dot) gov/RefSeq/).
  TAIR (Hypertext Transfer Protocol://World Wide Web (dot) arabidopsis (dot) org/).
Protein and Pathway Databases
  Uniprot [Hypertext Transfer Protocol://World Wide Web (dot) uniprot (dot) org/].
  AraCyc [Hypertext Transfer Protocol://World Wide Web (dot) arabidopsis (dot) org/biocyc/index (dot) jsp].
  ENZYME [Hypertext Transfer Protocol://expasy (dot) org/enzyme/].
Microarray Datasets were Downloaded from:
  GEO (Hypertext Transfer Protocol://World Wide Web.ncbi.nlm.nih.gov/geo/)
  TAIR (Hypertext Transfer Protocol://World Wide Web.arabidopsis.org/).
  Proprietary microarray data (WO2008/122980).
QTL and SNPs Information
  Gramene [Hypertext Transfer Protocol://World Wide Web (dot) gramene (dot) org/qt1/].
  Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:
  Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

To further investigate and identify putative orthologs of the yield, growth rate, vigor, biomass, growth rate, abiotic stress tolerance (ABST), nitrogen use efficiency (NUE) and fertilizer use efficiency (FUE) genes from other plant species, expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing to construct a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Overall, 239 genes were identified to have a major impact on plant yield, growth rate, vigor, biomass, growth rate, oil content, abiotic stress tolerance, nitrogen use efficiency, water use efficiency and fertilizer use efficiency when expression thereof is increased in plants. The identified genes, their curated polynucleotide and polypeptide sequences, as well as their updated sequences according to Genbank database are summarized in Table 1, hereinbelow.

TABLE 1

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polynucleotide SEQ ID NO: | Polypeptide SEQ ID NO: |
| --- | --- | --- | --- | --- |
| LYM1 | rice\|gb157.2\|AU058137 | rice | 1 | 240 |
| LYM2 | rice\|gb157.2\|AA750140 | rice | 2 | 241 |
| LYM3 | rice\|gb157.2\|AU032158 | rice | 3 | 242 |
| LYM4 | rice\|gb157.2\|AU082697 | rice | 4 | 243 |
| LYM5 | rice\|gb157.2\|AW155107 | rice | 5 | 244 |
| LYM6 | rice\|gb157.2\|AW155114 | rice | 6 | 245 |
| LYM7 | rice\|gb157.2\|BE039635 | rice | 7 | 246 |
| LYM8 | rice\|gb157.2\|BE040233 | rice | 8 | 247 |
| LYM9 | rice\|gb157.2\|BE040806 | rice | 9 | 248 |
| LYM10 | rice\|gb157.2\|BE230434 | rice | 10 | 249 |
| LYM12 | rice\|gb157.2\|BI807331 | rice | 11 | 250 |
| LYM13 | rice\|gb157.2\|BM037844 | rice | 12 | 251 |
| LYM14 | rice\|gb157.2\|BM038118 | rice | 13 | 252 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polynucleotide SEQ ID NO: | Polypeptide SEQ ID NO: |
|---|---|---|---|---|
| LYM15 | rice\|gb157.2\|CA761603 | rice | 14 | 253 |
| LYM16 | rice\|gb157.2\|U38074 | rice | 15 | 254 |
| LYM17 | rice\|gb157.2\|AU033038 | rice | 16 | 255 |
| LYM19 | rice\|gb157.2\|BE040457 | rice | 17 | 256 |
| LYM20 | rice\|gb157.2\|BF430570 | rice | 18 | 257 |
| LYM21 | rice\|gb157.2\|BI805660 | rice | 19 | 258 |
| LYM22 | rice\|gb157.2\|BI808357 | rice | 20 | 259 |
| LYM23 | rice\|gb157.2\|AA749984 | rice | 21 | 260 |
| LYM24 | rice\|gb157.2\|AF050674 | rice | 22 | 261 |
| LYM26 | barley\|gb157.3\|AJ431915 | barley | 23 | 262 |
| LYM30 | rice\|gb157.2\|AK100743 | rice | 24 | 263 |
| LYM31 | rice\|gb157.2\|AK101734 | rice | 25 | 264 |
| LYM32 | rice\|gb157.2\|AK106380 | rice | 26 | 265 |
| LYM34 | rice\|gb157.2\|AK107902 | rice | 27 | 266 |
| LYM35 | rice\|gb157.2\|AK107934 | rice | 28 | 267 |
| LYM36 | rice\|gb157.2\|AK108674 | rice | 29 | 268 |
| LYM37 | rice\|gb157.2\|AK111353 | rice | 30 | 269 |
| LYM38 | barley\|gb157.3\|AL508889 | barley | 31 | 270 |
| LYM40 | rice\|gb157.2\|AU082329 | rice | 32 | 271 |
| LYM41 | rice\|gb157.2\|AU096202 | rice | 33 | 272 |
| LYM42 | rice\|gb157.2\|AU097348 | rice | 34 | 273 |
| LYM43 | rice\|gb157.2\|AU101198 | rice | 35 | 274 |
| LYM44 | rice\|gb157.2\|AU172519 | rice | 36 | 275 |
| LYM49 | maize\|gb164\|AW331061 | maize | 37 | |
| LYM51 | barley\|gb157.3\|BE412472 | barley | 38 | 276 |
| LYM52 | barley\|gb157.3\|BE422132 | barley | 39 | 277 |
| LYM53 | maize\|gb164\|BE511332 | maize | 40 | 278 |
| LYM56 | barley\|gb157.3\|BF625411 | barley | 41 | 279 |
| LYM57 | rice\|gb157.2\|BI809626 | rice | 42 | 280 |
| LYM59 | barley\|gb157.3\|BI952737 | barley | 43 | |
| LYM61 | maize\|gb164\|BM079029 | maize | 44 | 281 |
| LYM62 | maize\|gb164\|BM348041 | maize | 45 | 282 |
| LYM66 | barley\|gb157.3\|BU974981 | barley | 46 | 283 |
| LYM67 | rice\|gb157.2\|CA763759 | rice | 47 | 284 |
| LYM68 | rice\|gb157.2\|CA767240 | rice | 48 | 285 |
| LYM69 | rice\|gb157.2\|CA997856 | rice | 49 | 286 |
| LYM73 | rice\|gb157.2\|CB683204 | rice | 50 | 287 |
| LYM74 | maize\|gb164\|CF075309 | maize | 51 | 288 |
| LYM79 | maize\|gb164\|AW191191 | maize | 52 | 289 |
| LYM82 | barley\|gb157.3\|AL507706 | barley | 53 | 290 |
| LYM83 | barley\|gb157.3\|BI952401 | barley | 54 | 291 |
| LYM84 | barley\|gb157.3\|BF622069 | barley | 55 | 292 |
| LYM86 | rice\|gb157.2\|AU031857 | rice | 56 | 293 |
| LYM88 | arabidopsis\|gb165\|AT2G37750 | arabidopsis | 57 | 294 |
| LYM89 | arabidopsis\|gb165\|AT5G67490 | arabidopsis | 58 | 295 |
| LYM90 | barley\|gb157.3\|AV927104 | barley | 59 | 296 |
| LYM91 | barley\|gb157.3\|BE060518 | barley | 60 | 297 |
| LYM93 | barley\|gb157.3\|BI955752 | barley | 61 | 298 |
| LYM99 | barley\|gb157.3\|BI947870 | barley | 62 | 299 |
| LYM95 | barley\|gb157.3\|BI959932 | barley | 63 | 300 |
| LYM100 | barley\|gb157.3\|AV912944 | barley | 64 | 301 |
| LYM102 | rice\|gb157.2\|CA760613 | rice | 65 | 302 |
| LYM103 | maize\|gb164\|CD963970 | maize | 66 | 303 |
| LYM105 | barley\|gb157.3\|AL507901 | barley | 67 | 304 |
| LYM106 | barley\|gb157.3\|BI954225 | barley | 68 | 305 |
| LYM110 | maize\|gb164\|BE552618 | maize | 69 | 306 |
| LYM111 | maize\|gb164\|AW053159 | maize | 70 | 307 |
| LYM119 | maize\|gb164\|AW498426 | maize | 71 | 308 |
| LYM120 | rice\|gb157.3\|BI795677 | rice | 72 | 309 |
| LYM122 | rice\|gb157.3\|BI118816 | rice | 73 | 310 |
| LYM125 | rice\|gb157.2\|AK108452 | rice | 74 | 311 |
| LYM126 | rice\|gb157.2\|AK108969 | rice | 75 | 312 |
| LYM127 | rice\|gb157.2\|AU172589 | rice | 76 | 313 |
| LYM128 | rice\|gb157.2\|AU172667 | rice | 77 | 314 |
| LYM129 | rice\|gb157.3\|BE230206 | rice | 78 | 315 |
| LYM130 | rice\|gb157.3\|BF430580 | rice | 79 | 316 |
| LYM131 | rice\|gb157.3\|CF309827 | rice | 80 | 317 |
| LYM132 | rice\|gb157.3\|BE229876 | rice | 81 | 318 |
| LYM134 | rice\|gb157.2\|BI809462 | rice | 82 | 319 |
| LYM136 | rice\|gb157.2\|AU093861 | rice | 83 | 320 |
| LYM137 | barley\|gb157.3\|AL501911 | barley | 84 | 321 |
| LYM140 | barley\|gb157.3\|BF623993 | barley | 85 | 322 |
| LYM141 | rice\|gb157.2\|CA761074 | rice | 86 | 323 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polynucleotide SEQ ID NO: | Polypeptide SEQ ID NO: |
|---|---|---|---|---|
| LYM142 | barley\|gb157.3\|CB866504 | barley | 87 | 324 |
| LYM143 | rice\|gb157.3\|BI306405 | rice | 88 | 325 |
| LYM144 | rice\|gb157.2\|BM420331 | rice | 89 | 326 |
| LYM145 | rice\|gb157.2\|AK073109 | rice | 90 | 327 |
| LYM148 | barley\|gb157.3\|AL500574 | barley | 91 | 328 |
| LYM149 | barley\|gb157.3\|AL509762 | barley | 92 | 329 |
| LYM152 | arabidopsis\|gb165\|AT5G57290 | arabidopsis | 93 | 330 |
| LYM153 | rice\|gb157.3\|AU066244 | rice | 94 | 331 |
| LYM156 | barley\|gb157.3\|BE421631 | barley | 95 | 332 |
| LYM157 | barley\|gb157.3\|BE454937 | barley | 96 | 333 |
| LYM159 | barley\|gb157.3\|BF259387 | barley | 97 | 334 |
| LYM160 | barley\|gb157.3\|BG300909 | barley | 98 | 335 |
| LYM161 | barley\|gb157.3\|BG344928 | barley | 99 | 336 |
| LYM162 | maize\|gb164\|BG462213 | maize | 100 | 337 |
| LYM164 | rice\|gb157.3\|BI805693 | rice | 101 | 338 |
| LYM165 | maize\|gb164\|CD439546 | maize | 102 | 339 |
| LYM166 | wheat\|gb164\|CJ547519 | wheat | 103 | 340 |
| LYM170 | rice\|gb157.2\|AU057403 | rice | 104 | 341 |
| LYM172 | rice\|gb157.2\|BE229411 | rice | 105 | 342 |
| LYM173 | rice\|gb157.3\|AA751564 | rice | 106 | 343 |
| LYM174 | sorghum\|gb161.crp\|AW284303 | sorghum | 107 | 344 |
| LYM175 | rice\|gb157.2\|AK060073 | rice | 108 | 345 |
| LYM176 | rice\|gb157.2\|BI305434 | rice | 109 | 346 |
| LYM178 | barley\|gb157.3\|BE421520 | barley | 110 | 347 |
| LYM179 | maize\|gb164\|BE051631 | maize | 111 | 348 |
| LYM107 | maize\|gb164\|AW497895 | maize | 112 | 349 |
| LYM109 | maize\|gb169.2\|CD984002 | maize | 113 | 350 |
| LYM112 | maize\|gb164\|CF038223 | maize | 114 | 351 |
| LYM113 | maize\|gb164\|AW257902 | maize | 115 | 352 |
| LYM115 | maize\|gb164\|CF646135 | maize | 116 | 353 |
| LYM116 | maize\|gb164\|AI964572 | maize | 117 | 354 |
| LYM117 | maize\|gb164\|AI739834 | maize | 118 | 355 |
| LYM118 | maize\|gb164\|CO518843 | maize | 119 | 356 |
| LYM121 | rice\|gb157.2\|AK103124 | rice | 120 | 357 |
| LYM123 | rice\|gb157.2\|AI978352 | rice | 121 | 358 |
| LYM135 | rice\|gb157.2\|AU101278 | rice | 122 | 359 |
| LYM138 | rice\|gb157.2\|BI805497 | rice | 123 | 360 |
| LYM146 | maize\|gb164\|AI770878 | maize | 124 | 361 |
| LYM147 | maize\|gb164\|AI901828 | maize | 125 | 362 |
| LYM154 | barley\|gb157.3\|AV836282 | barley | 126 | 363 |
| LYM155 | barley\|gb157.3\|BE412535 | barley | 127 | 364 |
| LYM180 | barley\|gb157.3\|AJ476822 | barley | 128 | 365 |
| LYM181 | barley\|gb157.3\|AL450622 | barley | 129 | 366 |
| LYM182 | barley\|gb157.3\|AL507048 | barley | 130 | 367 |
| LYM184 | barley\|gb157.3\|AV833284 | barley | 131 | 368 |
| LYM185 | barley\|gb157.3\|AV833969 | barley | 132 | 369 |
| LYM186 | barley\|gb157.3\|AV834971 | barley | 133 | 370 |
| LYM188 | barley\|gb157.3\|BE438660 | barley | 134 | 371 |
| LYM189 | barley\|gb157.3\|BF256192 | barley | 135 | 372 |
| LYM192 | barley\|gb157.3\|BF627356 | barley | 136 | 373 |
| LYM193 | barley\|gb157.3\|CB858276 | barley | 137 | 374 |
| LYM194 | barley\|gb157.3\|CB860975 | barley | 138 | 375 |
| LYM196 | maize\|gb164\|AI372352 | maize | 139 | 376 |
| LYM197 | maize\|gb164\|AI444704 | maize | 140 | 377 |
| LYM198 | maize\|gb164\|AI491323 | maize | 141 | 378 |
| LYM201 | maize\|gb164\|AI600670 | maize | 142 | 379 |
| LYM203 | maize\|gb164\|AI629486 | maize | 143 | 380 |
| LYM204 | maize\|gb164\|AI649791 | maize | 144 | 381 |
| LYM206 | maize\|gb164\|AI691210 | maize | 145 | 382 |
| LYM207 | maize\|gb164\|AI920398 | maize | 146 | 383 |
| LYM208 | maize\|gb164\|AI941717 | maize | 147 | 384 |
| LYM212 | maize\|gb164\|AW000408 | maize | 148 | 385 |
| LYM213 | maize\|gb164\|AW000438 | maize | 149 | 386 |
| LYM215 | maize\|gb164\|AW498464 | maize | 150 | 387 |
| LYM217 | maize\|gb164\|BE129928 | maize | 151 | 388 |
| LYM219 | maize\|gb164\|BE238495 | maize | 152 | 389 |
| LYM220 | maize\|gb164\|BG842756 | maize | 153 | 390 |
| LYM221 | maize\|gb164\|BI502603 | maize | 154 | 391 |
| LYM223 | maize\|gb164\|BM338985 | maize | 155 | 392 |
| LYM224 | maize\|gb164\|CA401086 | maize | 156 | 393 |
| LYM227 | maize\|gb164\|EC877515 | maize | 157 | 394 |
| LYM228 | maize\|gb164\|EC892599 | maize | 158 | 395 |
| LYM232 | rice\|gb157.3\|AA750121 | rice | 159 | 396 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polynucleotide SEQ ID NO: | Polypeptide SEQ ID NO: |
|---|---|---|---|---|
| LYM233 | rice\|gb157.3\|AA750182 | rice | 160 | 397 |
| LYM234 | rice\|gb157.3\|AA752388 | rice | 161 | 398 |
| LYM236 | rice\|gb157.3\|AF155334 | rice | 162 | 399 |
| LYM238 | rice\|gb157.3\|AK066551 | rice | 163 | 400 |
| LYM239 | rice\|gb157.3\|AU068651 | rice | 164 | 401 |
| LYM240 | rice\|gb157.3\|AU069131 | rice | 165 | 402 |
| LYM241 | rice\|gb157.3\|AU162998 | rice | 166 | 403 |
| LYM242 | rice\|gb157.3\|BE039711 | rice | 167 | 404 |
| LYM243 | rice\|gb157.3\|BE228686 | rice | 168 | 405 |
| LYM245 | rice\|gb157.3\|BF430828 | rice | 169 | 406 |
| LYM248 | rice\|gb157.3\|BQ906571 | rice | 170 | 407 |
| LYM249 | rice\|gb157.3\|C25903 | rice | 171 | 408 |
| LYM250 | rice\|gb157.3\|CA759158 | rice | 172 | 409 |
| LYM251 | rice\|gb157.3\|CA759241 | rice | 173 | 410 |
| LYM252 | rice\|gb157.3\|CA759659 | rice | 174 | 411 |
| LYM254 | rice\|gb157.3\|CB657978 | rice | 175 | 412 |
| LYM255 | rice\|gb157.3\|CF330913 | rice | 176 | 413 |
| LYM260 | rice\|gb157.3\|CI581223 | rice | 177 | 414 |
| LYM261 | rice\|gb157.3\|D41406 | rice | 178 | 415 |
| LYM263 | sorghum\|gb161.crp\|AI622410 | sorghum | 179 | 416 |
| LYM183 | barley\|gb157.3\|AL509795 | barley | 180 | 417 |
| LYM256 | rice\|gb157.3\|CI004090 | rice | 181 | 418 |
| LYM200 | maize\|gb164\|AI586731 | maize | 182 | 419 |
| LYM267 | maize\|gb164\|AW231521 | maize | 183 | 420 |
| LYM268 | rice\|gb157.2\|BI800054 | rice | 184 | 421 |
| LYM270 | maize\|gb164\|AI670268 | maize | 185 | 422 |
| LYM271 | maize\|gb164\|CF637107 | maize | 186 | 423 |
| LYM272 | rice\|gb157.2\|CA761620 | rice | 187 | 424 |
| LYM273 | rice\|gb157.2\|BM418692 | rice | 188 | 425 |
| LYM274 | rice\|gb157.2\|AK073201 | rice | 189 | 426 |
| LYM277 | rice\|gb157.2\|BM038097 | rice | 190 | 427 |
| LYM278 | barley\|gb157.3\|BLYTRAA | barley | 191 | 428 |
| LYM283 | rice\|gb157.2\|D23167 | rice | 192 | 429 |
| LYM284 | rice\|gb157.2\|BI306331 | rice | 193 | 430 |
| LYM285 | rice\|gb157.2\|CB631346 | rice | 194 | 431 |
| LYM287 | rice\|gb157.2\|AK102063 | rice | 195 | 432 |
| LYM288 | rice\|gb157.2\|BE040927 | rice | 196 | 433 |
| LYM289 | barley\|gb157.3\|AV925962 | barley | 197 | 434 |
| LYM290 | maize\|gb164\|AA979729 | maize | 198 | 435 |
| LYM291 | rice\|gb157.2\|BM037976 | rice | 199 | 436 |
| LYM293 | rice\|gb157.2\|AK059161 | rice | 200 | 437 |
| LYM38 | barley\|gb157.3\|AL508889 | barley | 201 | 438 |
| LYM42 | rice\|gb157.2\|AU097348 | rice | 202 | 439 |
| LYM51 | barley\|gb157.3\|BE412472 | barley | 203 | 276 |
| LYM52 | barley\|gb157.3\|BE422132 | barley | 204 | 277 |
| LYM56 | barley\|gb157.3\|BF625411 | barley | 205 | 279 |
| LYM59 | barley\|gb157.3\|BI952737 | barley | 206 | |
| LYM66 | barley\|gb157.3\|BU974981 | barley | 207 | 440 |
| LYM79 | maize\|gb164\|AW191191 | maize | 208 | 441 |
| LYM83 | barley\|gb157.3\|BI952401 | barley | 209 | 442 |
| LYM90 | barley\|gb157.3\|AV927104 | barley | 210 | 296 |
| LYM99 | barley\|gb157.3\|BI947870 | barley | 211 | 299 |
| LYM95 | barley\|gb157.3\|BI959932 | barley | 212 | 443 |
| LYM148 | barley\|gb157.3\|AL500574 | barley | 213 | 328 |
| LYM159 | barley\|gb157.3\|BF259387 | barley | 214 | 334 |
| LYM161 | barley\|gb157.3\|BG344928 | barley | 215 | 444 |
| LYM166 | wheat\|gb164\|CJ547519 | wheat | 216 | 445 |
| LYM175 | rice\|gb157.2\|AK060073 | rice | 217 | 446 |
| LYM109 | maize\|gb164\|CD984002 | maize | 218 | 447 |
| LYM112 | maize\|gb164\|CF038223 | maize | 219 | 448 |
| LYM116 | maize\|gb164\|AI964572 | maize | 220 | 354 |
| LYM117 | maize\|gb164\|AI739834 | maize | 221 | 449 |
| LYM154 | barley\|gb157.3\|AV836282 | barley | 222 | 450 |
| LYM155 | barley\|gb157.3\|BE412535 | barley | 223 | 451 |
| LYM180 | barley\|gb157.3\|AJ476822 | barley | 224 | 452 |
| LYM181 | barley\|gb157.3\|AL450622 | barley | 225 | 453 |
| LYM184 | barley\|gb157.3\|AV833284 | barley | 226 | 454 |
| LYM185 | barley\|gb157.3\|AV833969 | barley | 227 | 455 |
| LYM186 | barley\|gb157.3\|AV834971 | barley | 228 | 370 |
| LYM188 | barley\|gb157.3\|BE438660 | barley | 229 | 456 |
| LYM189 | barley\|gb157.3\|BF256192 | barley | 230 | 457 |
| LYM192 | barley\|gb157.3\|BF627356 | barley | 231 | 458 |
| LYM193 | barley\|gb157.3\|CB858276 | barley | 232 | 459 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Cluster Name | Organism | Polynucleotide SEQ ID NO: | Polypeptide SEQ ID NO: |
|---|---|---|---|---|
| LYM194 | barley\|gb157.3\|CB860975 | barley | 233 | 460 |
| LYM219 | maize\|gb164\|BE238495 | maize | 234 | 389 |
| LYM221 | maize\|gb164\|BI502603 | maize | 235 | 461 |
| LYM228 | maize\|gb164\|EC892599 | maize | 236 | 462 |
| LYM250 | rice\|gb157.3\|CA759158 | rice | 237 | 463 |
| LYM183 | barley\|gb157.3\|AL509795 | barley | 238 | 464 |
| LYM272 | rice\|gb157.2\|CA761620 | rice | 239 | 465 |

Table 1: Provided are the identified genes, their annotation, organism and polynucleotide and polypeptide sequence identifiers.

Example 2

Identification of Homologous Sequences that Increase Yield, Fiber Yield, Fiber Quality, Growth Rate, Biomass, Oil Content, Vigor, Abst, and/or Nue of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/ or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W. H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Table 2, hereinbelow, lists a summary of orthologous and homologous sequences of the polynucleotide sequences (SEQ ID NOs:1-239) and polypeptide sequences (SEQ ID NOs:240-465) presented in Table 1 above, which were identified from the databases using the NCBI BLAST software (e.g., using the Blastp and tBlastn algorithms) and needle (EMBOSS package) as being at least 80% homologous to the selected polynucleotides and polypeptides, and which are expected to increase plant yield, seed yield, oil yield, oil content, growth rate, fiber yield, fiber quality, biomass, vigor, ABST and/or NUE of a plant.

TABLE 2

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 467 | LYM2 H5 | brachypodium\|09v1\|DV480246 | 1974 | 241 | 89.1 | blastp |
| 468 | LYM2 H6 | maize\|gb170\|AW224918 | 1975 | 241 | 86.6 | blastp |
| 469 | LYM2 H7 | millet\|09v1\|EVO454PM002089 | 1976 | 241 | 87.6 | blastp |
| 470 | LYM2 H8 | sorghum\|09v1\|SB07G004285 | 1977 | 241 | 86.6 | blastp |
| 471 | LYM2 H4 | switchgrass\|gb167\|FE606998 | 1978 | 241 | 89.9 | blastp |
| 472 | LYM2 H5 | wheat\|gb164\|BM136811 | 1979 | 241 | 80.53 | tblastn |
| 473 | LYM4 H6 | barley\|gb157\|SOLEXA\|BE438934 | 1980 | 243 | 81.5 | blastp |
| 474 | LYM4 H7 | brachypodium\|09v1\|DV469575 | 1981 | 243 | 81.5 | blastp |
| 475 | LYM4 H2 | cenchrus\|gb166\|BM084020 | 1982 | 243 | 83 | blastp |
| 476 | LYM4 H8 | maize\|gb170\|AI600994 | 1983 | 243 | 82.2 | blastp |
| 477 | LYM4 H9 | maize\|gb170\|AW054478 | 1984 | 243 | 82.4 | blastp |
| 478 | LYM4 H10 | rice\|gb170\|OS05G13950 | 1985 | 243 | 94.7 | blastp |
| 479 | LYM4 H11 | sorghum\|09v1\|SB03G000920 | 1986 | 243 | 83.2 | blastp |
| 480 | LYM4 H5 | switchgrass\|gb167\|FL703533 | 1987 | 243 | 83 | blastp |
| 481 | LYM4 H6 | wheat\|gb164\|BE444991 | 1988 | 243 | 81.3 | blastp |
| 482 | LYM5 H16 | barley\|gb157\|SOLEXA\|BI953887 | 1989 | 244 | 90.9 | blastp |
| 483 | LYM5 H17 | brachypodium\|09v1\|DV474010 | 1990 | 244 | 91.3 | blastp |
| 484 | LYM5 H3 | cenchrus\|gb166\|EB655978 | 1991 | 244 | 88.19 | tblastn |
| 485 | LYM5 H4 | fescue\|gb161\|DT688132 | 1992 | 244 | 85.8 | blastp |
| 486 | LYM5 H5 | leymus\|gb166\|EG394968 | 1993 | 244 | 90.9 | blastp |
| 487 | LYM5 H18 | maize\|gb170\|AI783290 | 1994 | 244 | 92.1 | blastp |
| 488 | LYM5 H19 | maize\|gb170\|BG265158 | 1995 | 244 | 92.5 | blastp |
| 489 | LYM5 H20 | rice\|gb170\|OS02G46660 | 1996 | 244 | 87.8 | blastp |
| 490 | LYM5 H21 | sorghum\|09v1\|SB04G031180 | 1997 | 244 | 80.3 | blastp |
| 491 | LYM5 H22 | sorghum\|09v1\|SB06G027060 | 1998 | 244 | 90.9 | blastp |
| 492 | LYM5 H23 | sugarcane\|gb157.3\|CA118359 | 1999 | 244 | 91.7 | blastp |
| 493 | LYM5 H12 | switchgrass\|gb167\|FE641223 | 2000 | 244 | 93.3 | blastp |
| 494 | LYM5 H13 | switchgrass\|gb167\|FL708642 | 2001 | 244 | 92.5 | blastp |
| 495 | LYM5 H14 | wheat\|gb164\|BE414733 | 2002 | 244 | 90.6 | blastp |
| 496 | LYM5 H15 | wheat\|gb164\|BE431026 | 2003 | 244 | 91.3 | blastp |
| 497 | LYM5 H16 | wheat\|gb164\|CA613380 | 2004 | 244 | 90.9 | blastp |
| 498 | LYM7 H35 | b oleracea\|gb161\|AM057184 | 2005 | 246 | 81.2 | blastp |
| 499 | LYM7 H36 | barley\|gb157\|SOLEXA\|BE413128 | 2006 | 246 | 82.6 | blastp |
| 500 | LYM7 H37 | barley\|gb157\|SOLEXA\|BF627706 | 2007 | 246 | 95.7 | blastp |
| 501 | LYM7 H38 | brachypodium\|09v1\|DV468966 | 2008 | 246 | 94.2 | blastp |
| 502 | LYM7 H39 | brachypodium\|09v1\|DV474806 | 2009 | 246 | 82.6 | blastp |
| 503 | LYM7 H6 | bruguiera\|gb166\|BP945554 | 2010 | 246 | 81.2 | blastp |
| 504 | LYM7 H40 | canola\|gb161\|CD811653 | 2011 | 246 | 81.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 505 | LYM7 H41 | canola\|gb161\|CD838423 | 2012 | 246 | 81.2 | blastp |
| 506 | LYM7 H42 | cassava\|09v1\|CK652348 | 2013 | 246 | 82.6 | blastp |
| 507 | LYM7 H43 | castorbean\|09v1\|XM002532394 | 2014 | 246 | 82.6 | blastp |
| 508 | LYM7 H44 | cucumber\|09v1\|AM717859 | 2015 | 246 | 82.6 | blastp |
| 509 | LYM7 H9 | eucalyptus\|gb166\|CB967858 | 2016 | 246 | 81.2 | blastp |
| 510 | LYM7 H10 | kiwi\|gb166\|FG431017 | 2017 | 246 | 81.2 | blastp |
| 511 | LYM7 H11 | kiwi\|gb166\|FG521634 | 2018 | 246 | 82.6 | blastp |
| 512 | LYM7 H12 | liriodendron\|gb166\|FD494835 | 2019 | 246 | 82.6 | blastp |
| 513 | LYM7 H45 | maize\|gb170\|AI943908 | 2020 | 246 | 82.6 | blastp |
| 514 | LYM7 H46 | maize\|gb170\|AW282244 | 2021 | 246 | 88.4 | blastp |
| 515 | LYM7 H47 | maize\|gb170\|LLAI855232 | 2022 | 246 | 82.61 | tblastn |
| 516 | LYM7 H48 | maize\|gb170\|LLDN209190 | 2023 | 246 | 82.61 | tblastn |
| 517 | LYM7 H49 | millet\|09v1\|EVO454PM003641 | 2024 | 246 | 91.3 | blastp |
| 518 | LYM7 H50 | millet\|09v1\|EVO454PM019125 | 2025 | 246 | 81.2 | blastp |
| 519 | LYM7 H16 | oat\|gb164\|CN817490 | 2026 | 246 | 88.4 | blastp |
| 520 | LYM7 H17 | oat\|gb164\|CN819643 | 2027 | 246 | 82.6 | blastp |
| 521 | LYM7 H51 | poplar\|gb170\|BI069446 | 2028 | 246 | 81.2 | blastp |
| 522 | LYD97 H18 | poplar\|gb170\|BI123662 | 2029 | 246 | 81.2 | blastp |
| 523 | LYM7 H20 | rye\|gb164\|BE496021 | 2030 | 246 | 94.2 | blastp |
| 524 | LYM7 H21 | rye\|gb164\|BE587226 | 2031 | 246 | 81.2 | blastp |
| 525 | LYM7 H52 | sorghum\|09v1\|SB05G003875 | 2032 | 246 | 88.4 | blastp |
| 526 | LYM7 H53 | sugarcane\|gb157.3\|CA079082 | 2033 | 246 | 89.9 | blastp |
| 527 | LYM7 H54 | sugarcane\|gb157.3\|CA158782 | 2034 | 246 | 81.2 | blastp |
| 528 | LYM7 H25 | switchgrass\|gb167\|DN149707 | 2035 | 246 | 82.6 | blastp |
| 529 | LYM7 H26 | switchgrass\|gb167\|FE644021 | 2036 | 246 | 84.1 | blastp |
| 530 | LYM7 H27 | switchgrass\|gb167\|FE657215 | 2037 | 246 | 80 | blastp |
| 531 | LYM7 H28 | switchgrass\|gb167\|FE658413 | 2038 | 246 | 88.4 | blastp |
| 532 | LYM7 H29 | switchgrass\|gb167\|FL689692 | 2039 | 246 | 88.4 | blastp |
| 533 | LYM7 H30 | wheat\|gb164\|BE404350 | 2040 | 246 | 81.2 | blastp |
| 534 | LYM7 H31 | wheat\|gb164\|BE414371 | 2041 | 246 | 84.1 | blastp |
| 535 | LYM7 H32 | wheat\|gb164\|BE430017 | 2042 | 246 | 94.2 | blastp |
| 536 | LYM7 H33 | wheat\|gb164\|BE444058 | 2043 | 246 | 95.7 | blastp |
| 537 | LYM7 H34 | wheat\|gb164\|BE444789 | 2044 | 246 | 82.6 | blastp |
| 538 | LYM7 H35 | wheat\|gb164\|CA598363 | 2045 | 246 | 95.7 | blastp |
| 539 | LYM8 H7 | arabidopsis lyrata\|09v1\|JGIAL008627 | 2046 | 247 | 80.2 | blastp |
| 540 | LYM8 H8 | arabidopsis lyrata\|09v1\|JGIAL021400 | 2047 | 247 | 83.3 | blastp |
| 541 | LYM8 H1 | arabidopsis\|gb165\|AT3G03110 | 2048 | 247 | 80.6 | blastp |
| 542 | LYM8 H2 | arabidopsis\|gb165\|AT5G17020 | 2049 | 247 | 82.9 | blastp |
| 543 | LYM8 H9 | brachypodium\|09v1\|GT774368 | 2050 | 247 | 95.6 | blastp |
| 544 | LYM8 H10 | castorbean\|09v1\|EE255045 | 2051 | 247 | 84.2 | blastp |
| 545 | LYM8 H11 | chestnut\|gb170\|SRR006295S0059698 | 2052 | 247 | 85.7 | blastp |
| 546 | LYM8 H12 | cucumber\|09v1\|GD174631 | 2053 | 247 | 84.5 | blastp |
| 547 | LYM8 H13 | lotus\|09v1\|BP043858 | 2054 | 247 | 83.8 | blastp |
| 548 | LYM8 H14 | lotus\|09v1\|BP071708 | 2055 | 247 | 83.6 | blastp |
| 549 | LYM8 H15 | maize\|gb170\|AA030709 | 2056 | 247 | 92.1 | blastp |
| 550 | LYM8 H16 | maize\|gb170\|AI621522 | 2057 | 247 | 92.2 | blastp |
| 551 | LYM8 H17 | medicago\|09v1\|BE205102 | 2058 | 247 | 83.5 | blastp |
| 552 | LYM8 H18 | medicago\|09v1\|BM779128 | 2059 | 247 | 83.9 | blastp |
| 553 | LYM8 H19 | poplar\|gb170\|BI127444 | 2060 | 247 | 84.8 | blastp |
| 554 | LYM8 H20 | poplar\|gb170\|BU837911 | 2061 | 247 | 85 | blastp |
| 555 | LYM8 H21 | rice\|gb170\|OS03G64080 | 2062 | 247 | 99.72 | tblastn |
| 556 | LYM8 H22 | solanum phureja\|09v1\|SPHBG128228 | 2063 | 247 | 83.2 | blastp |
| 557 | LYM8 H23 | sorghum\|09v1\|SB01G000490 | 2064 | 247 | 93.9 | blastp |
| 558 | LYM8 H24 | sorghum\|09v1\|SB02G009800 | 2065 | 247 | 89 | blastp |
| 559 | LYM8 H6 | soybean\|gb168\|BE205102 | 2066 | 247 | 82.98 | tblastn |
| 560 | LYM8 H7 | soybean\|gb168\|BE823809 | 2067 | 247 | 81.6 | blastp |
| 561 | LYM8 H25 | tomato\|09v1\|BG128228 | 2068 | 247 | 83.33 | tblastn |
| 562 | LYM9 H0 | lolium\|09v1\|AU245599 | 2069 | 248 | 80.1 | blastp |
| 563 | LYM10 H1 | antirrhinum\|gb166\|AJ786992 | 2070 | 249 | 89.9 | blastp |
| 564 | LYM10 H207 | apple\|gb171\|CN443929 | 2071 | 249 | 91.3 | blastp |
| 565 | LYM10 H208 | apple\|gb171\|CN489763 | 2072 | 249 | 91.3 | blastp |
| 566 | LYM10 H209 | apple\|gb171\|CN874192 | 2073 | 249 | 87 | blastp |
| 567 | LYM10 H210 | arabidopsis lyrata\|09v1\|JGIAL017989 | 2074 | 249 | 85.5 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 568 | LYM10 H211 | arabidopsis lyrata\|09v1\|JGIAL025614 | 2075 | 249 | 91.3 | blastp |
| 569 | LYM10 H212 | arabidopsis lyrata\|09v1\|JGIAL029470 | 2076 | 249 | 91.3 | blastp |
| 570 | LYM10 H7 | arabidopsis\|gb165\|AT3G48570 | 2077 | 249 | 85.5 | blastp |
| 571 | LYM10 H8 | arabidopsis\|gb165\|AT4G24920 | 2078 | 249 | 91.3 | blastp |
| 572 | LYM10 H9 | arabidopsis\|gb165\|AT5G50460 | 2079 | 249 | 91.3 | blastp |
| 573 | LYM10 H10 | artemisia\|gb164\|EX980216 | 2080 | 249 | 88.4 | blastp |
| 574 | LYM10 H11 | b juncea\|gb164\|EVGN00323614690486 | 2081 | 249 | 85.5 | blastp |
| 575 | LYM10 H12 | b juncea\|gb164\|EVGN00357611620134 | 2082 | 249 | 81.16 | tblastn |
| 576 | LYM10 H13 | b juncea\|gb164\|EVGN00407015981886 | 2083 | 249 | 91.3 | blastp |
| 577 | LYM10 H14 | b juncea\|gb164\|EVGN01046711722157 | 2084 | 249 | 91.3 | blastp |
| 578 | LYM10 H15 | b juncea\|gb164\|EVGN01350404310247 | 2085 | 249 | 91.3 | tblastn |
| 579 | LYM10 H16 | b juncea\|gb164\|EVGN01826229072660 | 2086 | 249 | 91.3 | blastp |
| 580 | LYM10 H17 | b juncea\|gb164\|EVGN10412810992898 | 2087 | 249 | 86.3 | blastp |
| 581 | LYM10 H18 | b juncea\|gb164\|EVGN19578802581818 | 2088 | 249 | 81.2 | blastp |
| 582 | LYM10 H19 | b oleracea\|gb161\|AM059639 | 2089 | 249 | 91.3 | blastp |
| 583 | LYM10 H20 | b oleracea\|gb161\|EH414574 | 2090 | 249 | 91.3 | blastp |
| 584 | LYM10 H21 | b oleracea\|gb161\|EH427198 | 2091 | 249 | 81.7 | blastp |
| 585 | LYM10 H22 | b rapa\|gb162\|BG544908 | 2092 | 249 | 91.3 | blastp |
| 586 | LYM10 H23 | b rapa\|gb162\|DY010003 | 2093 | 249 | 91.3 | blastp |
| 587 | LYM10 H24 | b rapa\|gb162\|EE524434 | 2094 | 249 | 91.3 | tblastn |
| 588 | LYM10 H25 | b rapa\|gb162\|L35825 | 2095 | 249 | 91.3 | blastp |
| 589 | LYM10 H26 | banana\|gb167\|DN239748 | 2096 | 249 | 94.2 | blastp |
| 590 | LYM10 H27 | banana\|gb167\|ES432517 | 2097 | 249 | 95.7 | blastp |
| 591 | LYM10 H28 | banana\|gb167\|FL649789 | 2098 | 249 | 95.7 | blastp |
| 592 | LYM10 H29 | banana\|gb167\|FL658161 | 2099 | 249 | 94.2 | blastp |
| 593 | LYM10 H213 | barley\|gb157SOLEXA\|AJ433765 | 2100 | 249 | 100 | blastp |
| 594 | LYM10 H214 | barley\|gb157SOLEXA\|BE412470 | 2101 | 249 | 100 | blastp |
| 595 | LYM10 H215 | barley\|gb157SOLEXA\|BF254576 | 2102 | 249 | 98.6 | blastp |
| 596 | LYM10 H216 | barley\|gb157SOLEXA\|BF257015 | 2103 | 249 | 100 | blastp |
| 597 | LYM10 H34 | bean\|gb167\|CA907476 | 2104 | 249 | 92.75 | tblastn |
| 598 | LYM10 H35 | bean\|gb167\|CA907483 | 2105 | 249 | 94.2 | blastp |
| 599 | LYM10 H217 | beech\|gb170\|SRR006293S0011456 | 2106 | 249 | 92.8 | blastp |
| 600 | LYM10 H218 | beech\|gb170\|SRR006294S0008365 | 2107 | 249 | 88.4 | blastp |
| 601 | LYM10 H219 | brachypodium\|09v1\|DV469126 | 2108 | 249 | 100 | blastp |
| 602 | LYM10 H220 | brachypodium\|09v1\|GT803631 | 2109 | 249 | 92.8 | blastp |
| 603 | LYM10 H38 | bruguiera\|gb166\|BP941922 | 2110 | 249 | 95.7 | blastp |
| 604 | LYM10 H39 | bruguiera\|gb166\|BP944773 | 2111 | 249 | 95.7 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 605 | LYM10 H40 | cacao\|gb167\|CU471529 | 2112 | 249 | 94.2 | blastp |
| 606 | LYM10 H41 | cacao\|gb167\|CU480597 | 2113 | 249 | 84.1 | blastp |
| 607 | LYM10 H42 | cacao\|gb167\|CU493298 | 2114 | 249 | 89.9 | blastp |
| 608 | LYM10 H43 | canola\|gb161\|CD813231 | 2115 | 249 | 91.3 | tblastn |
| 609 | LYM10 H44 | canola\|gb161\|CD817528 | 2116 | 249 | 91.3 | tblastn |
| 610 | LYM10 H45 | canola\|gb161\|CD820075 | 2117 | 249 | 91.3 | tblastn |
| 611 | LYM10 H46 | canola\|gb161\|CD824239 | 2118 | 249 | 91.3 | tblastn |
| 612 | LYM10 H47 | canola\|gb161\|CD838062 | 2119 | 249 | 86.3 | blastp |
| 613 | LYM10 H48 | canola\|gb161\|CD840808 | 2120 | 249 | 91.3 | blastp |
| 614 | LYM10 H49 | canola\|gb161\|CN732434 | 2121 | 249 | 91.3 | tblastn |
| 615 | LYM10 H50 | canola\|gb161\|DW999288 | 2122 | 249 | 91.3 | blastp |
| 616 | LYM10 H51 | canola\|gb161\|EE434176 | 2123 | 249 | 84.1 | blastp |
| 617 | LYM10 H52 | canola\|gb161\|EE464036 | 2124 | 249 | 87 | blastp |
| 618 | LYM10 H221 | cassava\|09v1\|CK642225 | 2125 | 249 | 94.2 | blastp |
| 619 | LYM10 H222 | cassava\|09v1\|DV455717 | 2126 | 249 | 94.2 | blastp |
| 620 | LYM10 H223 | cassava\|09v1\|FF380389 | 2127 | 249 | 94.2 | blastp |
| 621 | LYM10 H224 | castorbean\|09v1\|EG664279 | 2128 | 249 | 92.8 | blastp |
| 622 | LYM10 H225 | castorbean\|09v1\|XM002509459 | 2129 | 249 | 91.3 | blastp |
| 623 | LYM10 H58 | catharanthus\|gb166\|EG560643 | 2130 | 249 | 91.3 | blastp |
| 624 | LYM10 H59 | catharanthus\|gb166\|FD416462 | 2131 | 249 | 91.3 | blastp |
| 625 | LYM10 H60 | catharanthus\|gb166\|FD420164 | 2132 | 249 | 92.8 | blastp |
| 626 | LYM10 H61 | centaurea\|gb166\|EH747070 | 2133 | 249 | 87 | blastp |
| 627 | LYM10 H62 | centaurea\|gb166\|EH788831 | 2134 | 249 | 89.9 | blastp |
| 628 | LYM10 H226 | chestnut\|gb170\|SRR006295S0002470 | 2135 | 249 | 95.7 | blastp |
| 629 | LYM10 H227 | chestnut\|gb170\|SRR006295S0013318 | 2136 | 249 | 92.8 | blastp |
| 630 | LYM10 H228 | cichorium\|gb171\|FL673304 | 2137 | 249 | 85.51 | tblastn |
| 631 | LYM10 H63 | citrus\|gb166\|CF417520 | 2138 | 249 | 91.3 | blastp |
| 632 | LYM10 H64 | coffea\|gb157.2\|DV666460 | 2139 | 249 | 91.3 | blastp |
| 633 | LYM10 H65 | coffea\|gb157.2\|DV676797 | 2140 | 249 | 89.86 | tblastn |
| 634 | LYM10 H66 | cotton\|gb164\|BE052198 | 2141 | 249 | 94.2 | blastp |
| 635 | LYM10 H67 | cotton\|gb164\|BQ404833 | 2142 | 249 | 95.7 | blastp |
| 636 | LYM10 H68 | cotton\|gb164\|BQ407407 | 2143 | 249 | 92.8 | blastp |
| 637 | LYM10 H69 | cotton\|gb164\|CK640593 | 2144 | 249 | 95.7 | blastp |
| 638 | LYM10 H70 | cotton\|gb164\|DT052759 | 2145 | 249 | 88 | blastp |
| 639 | LYM10 H71 | cotton\|gb164\|DT574061 | 2146 | 249 | 80.7 | blastp |
| 640 | LYM10 H72 | cowpea\|gb166\|FF386543 | 2147 | 249 | 94.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 641 | LYM10H73 | cowpea\|gb166\|FF389357 | 2148 | 249 | 94.2 | tblastn |
| 642 | LYM10H74 | cryptomeria\|gb166\|BP174192 | 2149 | 249 | 89.9 | blastp |
| 643 | LYM10H75 | cryptomeria\|gb166\|BP174931 | 2150 | 249 | 88.6 | blastp |
| 644 | LYM10H229 | cucumber\|09v1\|AM715093 | 2151 | 249 | 88.41 | tblastn |
| 645 | LYM10H230 | cucumber\|09v1\|AM720495 | 2152 | 249 | 98.6 | blastp |
| 646 | LYM10H231 | cucumber\|09v1\|DN909507 | 2153 | 249 | 95.7 | blastp |
| 647 | LYM10H76 | cycas\|gb166\|CB091499 | 2154 | 249 | 88.4 | blastp |
| 648 | LYM10H77 | cynara\|gb167\|GE589284 | 2155 | 249 | 88.4 | blastp |
| 649 | LYM10H78 | dandelion\|gb161\|DY811008 | 2156 | 249 | 88.41 | tblastn |
| 650 | LYM10H79 | dandelion\|gb161\|DY839599 | 2157 | 249 | 89.86 | tblastn |
| 651 | LYM10H80 | eucalyptus\|gb166\|CD669252 | 2158 | 249 | 92.8 | blastp |
| 652 | LYM10H232 | fern\|gb171\|DK961389 | 2159 | 249 | 88.4 | blastp |
| 653 | LYM10H81 | fescue\|gb161\|DT702292 | 2160 | 249 | 100 | tblastn |
| 654 | LYM10H82 | fescue\|gb161\|DT704458 | 2161 | 249 | 100 | tblastn |
| 655 | LYM10H233 | flax\|09v1\|EU829193 | 2162 | 249 | 92.8 | blastp |
| 656 | LYM10H234 | gerbera\|09v1\|AJ761193 | 2163 | 249 | 89.9 | blastp |
| 657 | LYM10H235 | gerbera\|09v1\|AJ765913 | 2164 | 249 | 84.1 | blastp |
| 658 | LYM10H83 | ginger\|gb164\|DY368424 | 2165 | 249 | 95.65 | tblastn |
| 659 | LYM10H84 | ginger\|gb164\|DY382125 | 2166 | 249 | 94.2 | blastp |
| 660 | LYM10H85 | grape\|gb160\|BQ793552 | 2167 | 249 | 91.3 | blastp |
| 661 | LYM10H86 | grape\|gb160\|CA809997 | 2168 | 249 | 91.3 | blastp |
| 662 | LYM10H87 | iceplant\|gb164\|AI943423 | 2169 | 249 | 88.4 | blastp |
| 663 | LYM10H88 | ipomoea\|gb157.2\|BJ553479 | 2170 | 249 | 89.86 | tblastn |
| 664 | LYM10H89 | ipomoea\|gb157.2\|CB329955 | 2171 | 249 | 88.41 | tblastn |
| 665 | LYM10H90 | ipomoea\|gb157.2\|CJ751960 | 2172 | 249 | 88.4 | blastp |
| 666 | LYM10H236 | jatropha\|09v1\|GO247649 | 2173 | 249 | 94.2 | blastp |
| 667 | LYM10H91 | kiwi\|gb166\|FG397070 | 2174 | 249 | 89.9 | blastp |
| 668 | LYM10H92 | kiwi\|gb166\|FG477805 | 2175 | 249 | 95.7 | blastp |
| 669 | LYM10H93 | lettuce\|gb157.2\|DW047717 | 2176 | 249 | 88.4 | blastp |
| 670 | LYM10H94 | lettuce\|gb157.2\|DW051281 | 2177 | 249 | 89.9 | blastp |
| 671 | LYM10H95 | lettuce\|gb157.2\|DW080235 | 2178 | 249 | 82.61 | tblastn |
| 672 | LYM10H96 | lettuce\|gb157.2\|DW101958 | 2179 | 249 | 88.4 | blastp |
| 673 | LYM10H97 | lettuce\|gb157.2\|DW123456 | 2180 | 249 | 88.41 | tblastn |
| 674 | LYM10H237 | liquorice\|gb171\|FS242287 | 2181 | 249 | 94.2 | blastp |
| 675 | LYM10H98 | liriodendron\|gb166\|FD495465 | 2182 | 249 | 95.7 | blastp |
| 676 | LYM10H99 | liriodendron\|gb166\|FD500844 | 2183 | 249 | 94.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 677 | LYM10H238 | lolium\|09v1\|AU247819 | 2184 | 249 | 98.6 | blastp |
| 678 | LYM10H239 | lotus\|09v1\|CB827059 | 2185 | 249 | 92.8 | blastp |
| 679 | LYM10H240 | lotus\|09v1\|DN652280 | 2186 | 249 | 89.9 | blastp |
| 680 | LYM10H102 | lovegrass\|gb167\|DN482980 | 2187 | 249 | 98.6 | blastp |
| 681 | LYM10H241 | maize\|gb170\|AI001340 | 2188 | 249 | 97.1 | blastp |
| 682 | LYM10H242 | maize\|gb170\|AI665512 | 2189 | 249 | 98.6 | blastp |
| 683 | LYM10H243 | maize\|gb170\|AI677195 | 2190 | 249 | 97.1 | blastp |
| 684 | LYM10H244 | maize\|gb170\|LLAI619401 | 2191 | 249 | 97.1 | blastp |
| 685 | LYM10H245 | maize\|gb170\|LLCF003156 | 2192 | 249 | 81.16 | tblastn |
| 686 | LYM10H246 | maize\|gb170\|LLDQ245943 | 2193 | 249 | 98.6 | blastp |
| 687 | LYM10H247 | maize\|gb170\|W21637 | 2194 | 249 | 98.6 | blastp |
| 688 | LYM10H109 | marchantia\|gb166\|BJ844102 | 2195 | 249 | 87 | blastp |
| 689 | LYM10H248 | medicago\|09v1\|AA660461 | 2196 | 249 | 94.2 | blastp |
| 690 | LYM10H249 | medicago\|09v1\|AW287868 | 2197 | 249 | 94.2 | blastp |
| 691 | LYM10H250 | medicago\|09v1\|LLBQ138650 | 2198 | 249 | 85.5 | blastp |
| 692 | LYM10H112 | melon\|gb165\|AM715093 | 2199 | 249 | 94.2 | tblastn |
| 693 | LYM10H113 | melon\|gb165\|AM720495 | 2200 | 249 | 98.55 | tblastn |
| 694 | LYM10H114 | melon\|gb165\|DV631710 | 2201 | 249 | 95.7 | blastp |
| 695 | LYM10H251 | millet\|09v1\|CD724432 | 2202 | 249 | 98.6 | blastp |
| 696 | LYM10H252 | monkeyflower\|09v1\|DV208117 | 2203 | 249 | 91.3 | blastp |
| 697 | LYM10H116 | nuphar\|gb166\|CD472502 | 2204 | 249 | 97.1 | blastp |
| 698 | LYM10H253 | oak\|gb170\|SRR006307S0013335 | 2205 | 249 | 94.2 | blastp |
| 699 | LYM10H254 | oak\|gb170\|SRR006307S0023745 | 2206 | 249 | 92.75 | tblastn |
| 700 | LYM170H117 | oil palm\|gb166\|EL684180 | 2207 | 249 | 92.8 | blastp |
| 701 | LYM10H118 | onion\|gb162\|BQ580148 | 2208 | 249 | 97.1 | blastp |
| 702 | LYM10H119 | papaya\|gb165\|EX279251 | 2209 | 249 | 89.9 | blastp |
| 703 | LYM10H255 | peanut\|gb171\|EE124530 | 2210 | 249 | 94.2 | blastp |
| 704 | LYM10H256 | peanut\|gb171\|EE126680 | 2211 | 249 | 94.2 | blastp |
| 705 | LYM10H257 | peanut\|gb171\|EG028825 | 2212 | 249 | 81.2 | blastp |
| 706 | LYM10H258 | peanut\|gb171\|EG373993 | 2213 | 249 | 94.2 | blastp |
| 707 | LYM10H259 | pepper\|gb171\|CA516679 | 2214 | 249 | 91.3 | blastp |
| 708 | LYM10H260 | pepper\|gb171\|GD053770 | 2215 | 249 | 89.9 | blastp |
| 709 | LYM10H261 | petunia\|gb171\|AF049933 | 2216 | 249 | 87 | blastp |
| 710 | LYM10H262 | petunia\|gb171\|EB174381 | 2217 | 249 | 87 | blastp |
| 711 | LYM10H263 | physcomitrella\|10v1\|AW145358 | 2218 | 249 | 81.2 | blastp |
| 712 | LYM10H264 | physcomitrella\|10v1\|BG361572 | 2219 | 249 | 81.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 713 | LYM10 H133 | pine\|gb157.2\|AL750813 | 2220 | 249 | 91.3 | blastp |
| 714 | LYM10 H134 | pine\|gb157.2\|AW064895 | 2221 | 249 | 91.3 | blastp |
| 715 | LYM10 H135 | pine\|gb157.2\|AW226488 | 2222 | 249 | 89.9 | blastp |
| 716 | LYM10 H265 | poplar\|gb170\|BI127745 | 2223 | 249 | 92.8 | blastp |
| 717 | LYM10 H266 | poplar\|gb170\|BU824190 | 2224 | 249 | 92.8 | blastp |
| 718 | LYM10 H267 | poplar\|gb170\|BU862632 | 2225 | 249 | 92.8 | blastp |
| 719 | LYM10 H139 | poppy\|gb166\|FE965009 | 2226 | 249 | 88.4 | blastp |
| 720 | LYM10 H140 | poppy\|gb166\|FE966430 | 2227 | 249 | 92.8 | blastp |
| 721 | LYM10 H141 | potato\|gb157.2\|BG350890 | 2228 | 249 | 91.3 | blastp |
| 722 | LYM10 H142 | potato\|gb157.2\|BG589211 | 2229 | 249 | 89.86 | tblastn |
| 723 | LYM10 H143 | potato\|gb157.2\|BG592598 | 2230 | 249 | 89.86 | tblastn |
| 724 | LYM10 H144 | potato\|gb157.2\|BQ516058 | 2231 | 249 | 91.3 | blastp |
| 725 | LYM10 H145 | prunus\|gb167\|BU039566 | 2232 | 249 | 92.8 | blastp |
| 726 | LYM10 H146 | prunus\|gb167\|BU046783 | 2233 | 249 | 87 | blastp |
| 727 | LYM10 H147 | radish\|gb164\|EV526354 | 2234 | 249 | 91.3 | tblastn |
| 728 | LYM10 H148 | radish\|gb164\|EV528390 | 2235 | 249 | 91.3 | blastp |
| 729 | LYM10 H149 | radish\|gb164\|EV536273 | 2236 | 249 | 91.3 | blastp |
| 730 | LYM10 H150 | radish\|gb164\|EV545751 | 2237 | 249 | 91.3 | tblastn |
| 731 | LYM10 H151 | radish\|gb164\|EV548721 | 2238 | 249 | 91.3 | blastp |
| 732 | LYM10 H152 | radish\|gb164\|EV550488 | 2239 | 249 | 91.3 | blastp |
| 733 | LYM10 H153 | radish\|gb164\|EV567397 | 2240 | 249 | 85.5 | blastp |
| 734 | LYM10 H154 | radish\|gb164\|EW713425 | 2241 | 249 | 89.9 | blastp |
| 735 | LYM10 H155 | radish\|gb164\|FD570559 | 2242 | 249 | 89.9 | blastp |
| 736 | LYM10 H268 | rice\|gb170\|OS06G44374 | 2243 | 249 | 95.7 | blastp |
| 737 | LYM10 H157 | rose\|gb157.2\|BI978198 | 2244 | 249 | 91.3 | tblastn |
| 738 | LYM10 H158 | rose\|gb157.2\|EC589842 | 2245 | 249 | 92.75 | tblastn |
| 739 | LYM10 H159 | safflower\|gb162\|EL393855 | 2246 | 249 | 88.41 | tblastn |
| 740 | LYM10 H160 | safflower\|gb162\|EL511136 | 2247 | 249 | 89.9 | blastp |
| 741 | LYM10 H269 | senecio\|gb170\|CO553399 | 2248 | 249 | 88.4 | blastp |
| 742 | LYM10 H161 | sesame\|gb157.2\|BU669069 | 2249 | 249 | 91.3 | tblastn |
| 743 | LYM10 H270 | solanum phureja\|09v1\|SPHAI483617 | 2250 | 249 | 89.9 | blastp |
| 744 | LYM10 H271 | solanum phureja\|09v1\|SPHBG127130 | 2251 | 249 | 91.3 | blastp |
| 745 | LYM10 H272 | sorghum\|09v1\|SB04G005280 | 2252 | 249 | 98.6 | blastp |
| 746 | LYM10 H273 | sorghum\|09v1\|SB10G026000 | 2253 | 249 | 97.1 | blastp |
| 747 | LYM10 H164 | soybean\|gb168\|AA660461 | 2254 | 249 | 94.2 | blastp |
| 748 | LYM10 H165 | soybean\|gb168\|AW472512 | 2255 | 249 | 92.8 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 749 | LYM10 H166 | soybean\|gb168\|BU544187 | 2256 | 249 | 94.2 | blastp |
| 750 | LYM10 H167 | spikemoss\|gb165\|DN838422 | 2257 | 249 | 85.51 | tblastn |
| 751 | LYM10 H168 | spruce\|gb162\|CO216979 | 2258 | 249 | 91.3 | blastp |
| 752 | LYM10 H169 | spruce\|gb162\|CO217020 | 2259 | 249 | 91.3 | blastp |
| 753 | LYM10 H170 | spurge\|gb161\|DV112655 | 2260 | 249 | 84.1 | blastp |
| 754 | LYM10 H171 | spurge\|gb161\|DV120263 | 2261 | 249 | 86.5 | blastp |
| 755 | LYM10 H172 | strawberry\|gb164\|CO380171 | 2262 | 249 | 91.3 | tblastn |
| 756 | LYM10 H173 | strawberry\|gb164\|EX664646 | 2263 | 249 | 92.8 | blastp |
| 757 | LYM10 H274 | sugarcane\|gb157.3\|CA072778 | 2264 | 249 | 97.1 | blastp |
| 758 | LYM10 H275 | sugarcane\|gb157.3\|CA087927 | 2265 | 249 | 98.6 | blastp |
| 759 | LYM10 H276 | sugarcane\|gb157.3\|CA103056 | 2266 | 249 | 98.6 | blastp |
| 760 | LYM10 H177 | sunflower\|gb162\|BU015373 | 2267 | 249 | 89.86 | tblastn |
| 761 | LYM10 H178 | sunflower\|gb162\|CD849625 | 2268 | 249 | 88.4 | blastp |
| 762 | LYM10 H179 | sunflower\|gb162\|CD851122 | 2269 | 249 | 88.41 | tblastn |
| 763 | LYM10 H180 | switchgrass\|gb167\|DN145554 | 2270 | 249 | 98.6 | blastp |
| 764 | LYM10 H181 | switchgrass\|gb167\|FE633347 | 2271 | 249 | 97.1 | blastp |
| 765 | LYM10 H182 | switchgrass\|gb167\|FE639131 | 2272 | 249 | 98.6 | blastp |
| 766 | LYM10 H183 | switchgrass\|gb167\|FL720694 | 2273 | 249 | 95.7 | blastp |
| 767 | LYM10 H184 | tamarix\|gb166\|EG968743 | 2274 | 249 | 85.5 | blastp |
| 768 | LYM10 H185 | tamarix\|gb166\|EG969152 | 2275 | 249 | 88.4 | blastp |
| 769 | LYM10 H277 | tea\|gb171\|FF682807 | 2276 | 249 | 95.7 | blastp |
| 770 | LYM10 H186 | *thellungiella*\|gb167\|BI698898 | 2277 | 249 | 91.3 | blastp |
| 771 | LYM10 H187 | *thellungiella*\|gb167\|EC599088 | 2278 | 249 | 91.3 | blastp |
| 772 | LYM10 H188 | tobacco\|gb162\|CV020564 | 2279 | 249 | 81.8 | blastp |
| 773 | LYM10 H189 | tobacco\|gb162\|CV021149 | 2280 | 249 | 80.8 | blastp |
| 774 | LYM10 H190 | tobacco\|gb162\|CV021577 | 2281 | 249 | 91.3 | tblastn |
| 775 | LYM10 H191 | tobacco\|gb162\|EB426093 | 2282 | 249 | 91.3 | tblastn |
| 776 | LYM10 H192 | tobacco\|gb162\|EB447225 | 2283 | 249 | 89.9 | blastp |
| 777 | LYM10 H278 | tomato\|09v1\|AI483617 | 2284 | 249 | 89.9 | blastp |
| 778 | LYM10 H279 | tomato\|09v1\|BG127130 | 2285 | 249 | 91.3 | tblastn |
| 779 | LYM10 H195 | *triphysaria*\|gb164\|EX988147 | 2286 | 249 | 81.6 | blastp |
| 780 | LYM10 H196 | walnuts\|gb166\|CB304079 | 2287 | 249 | 98.6 | blastp |
| 781 | LYM10 H197 | wheat\|gb164\|BE423226 | 2288 | 249 | 100 | tblastn |
| 782 | LYM10 H198 | wheat\|gb164\|BE423858 | 2289 | 249 | 100 | tblastn |
| 783 | LYM10 H199 | wheat\|gb164\|BE445139 | 2290 | 249 | 98.55 | tblastn |
| 784 | LYM10 H200 | wheat\|gb164\|BE604834 | 2291 | 249 | 98.55 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 785 | LYM10 H201 | wheat\|gb164\|BF473482 | 2292 | 249 | 100 | tblastn |
| 786 | LYM10 H202 | wheat\|gb164\|BF474814 | 2293 | 249 | 98.55 | tblastn |
| 787 | LYM10 H203 | wheat\|gb164\|BI479895 | 2294 | 249 | 98.55 | tblastn |
| 788 | LYM10 H204 | wheat\|gb164\|CA619357 | 2295 | 249 | 86.96 | tblastn |
| 789 | LYM10 H205 | wheat\|gb164\|CA619965 | 2296 | 249 | 91.3 | tblastn |
| 790 | LYM10 H206 | wheat\|gb164\|CA627315 | 2297 | 249 | 83.8 | blastp |
| 791 | LYM10 H207 | wheat\|gb164\|DR737205 | 2298 | 249 | 85.51 | tblastn |
| 792 | LYM13 H3 | brachypodium\|09v1\|GT794488 | 2299 | 251 | 80.6 | blastp |
| 793 | LYM13 H4 | maize\|gb170\|T12684 | 2300 | 251 | 84.5 | blastp |
| 794 | LYM13 H5 | sorghum\|09v1\|SB01G049950 | 2301 | 251 | 84.5 | blastp |
| 795 | LYM13 H3 | switchgrass\|gb167\|FE634401 | 2302 | 251 | 84.53 | tblastn |
| 796 | LYM14 H1 | aquilegia\|gb157.3\|DR927713 | 2303 | 252 | 81.1 | blastp |
| 797 | LYM14 H31 | arabidopsis lyrata\|09v1\|JGIAL009556 | 2304 | 252 | 80.7 | blastp |
| 798 | LYM14 H32 | arabidopsis lyrata\|09v1\|JGIAL020254 | 2305 | 252 | 80.4 | blastp |
| 799 | LYM14 H2 | arabidopsis\|gb165\|AT3G11320 | 2306 | 252 | 80.4 | blastp |
| 800 | LYM14 H3 | arabidopsis\|gb165\|AT5G05820 | 2307 | 252 | 80.4 | blastp |
| 801 | LYM14 H4 | artemisia\|gb164\|EY034514 | 2308 | 252 | 81.7 | blastp |
| 802 | LYM14 H33 | brachypodium\|09v1\|GT762844 | 2309 | 252 | 96 | blastp |
| 803 | LYM14 H7 | canola\|gb161\|DY024685 | 2310 | 252 | 81.1 | blastp |
| 804 | LYM14 H34 | cassava\|09v1\|CK650018 | 2311 | 252 | 80.1 | blastp |
| 805 | LYM14 H35 | castorbean\|09v1\|EG659029 | 2312 | 252 | 80.43 | tblastn |
| 806 | LYM14 H8 | centaurea\|gb166\|EH712821 | 2313 | 252 | 80.1 | blastp |
| 807 | LYM14 H36 | cichorium\|gb171\|EH688253 | 2314 | 252 | 80.7 | blastp |
| 808 | LYM14 H11 | cotton\|gb164\|AA659984 | 2315 | 252 | 80.43 | tblastn |
| 809 | LYM14 H37 | cucumber\|09v1\|DN910737 | 2316 | 252 | 80.75 | tblastn |
| 810 | LYM14 H12 | ginger\|gb164\|DY358976 | 2317 | 252 | 83.3 | blastp |
| 811 | LYM14 H13 | iceplant\|gb164\|AI822835 | 2318 | 252 | 80.75 | tblastn |
| 812 | LYM14 H14 | lettuce\|gb157.2\|DW158376 | 2319 | 252 | 82.3 | tblastn |
| 813 | LYM14 H15 | leymus\|gb166\|CD809180 | 2320 | 252 | 95 | blastp |
| 814 | LYM14 H38 | maize\|gb170\|AI783260 | 2321 | 252 | 93.8 | blastp |
| 815 | LYM14 H39 | maize\|gb170\|AI941675 | 2322 | 252 | 95.1 | blastp |
| 816 | LYM14 H18 | melon\|gb165\|AM713763 | 2323 | 252 | 80.5 | tblastn |
| 817 | LYM14 H40 | monkeyflower\|09v1\|GO959633 | 2324 | 252 | 80.12 | tblastn |
| 818 | LYM14 H41 | monkeyflower\|09v1\|GR111000 | 2325 | 252 | 80.12 | tblastn |
| 819 | LYM14 H19 | papaya\|gb165\|EX261125 | 2326 | 252 | 81.1 | blastp |
| 820 | LYM14 H20 | radish\|gb164\|EW723681 | 2327 | 252 | 81.37 | tblastn |
| 821 | LYM14 H42 | solanum phureja\|09v1\|SPHBG628013 | 2328 | 252 | 80.1 | blastp |
| 822 | LYM14 H43 | sorghum\|09v1\|SB01G038730 | 2329 | 252 | 96 | blastp |
| 823 | LYM14 H44 | sorghum\|09v1\|SB02G044050 | 2330 | 252 | 86 | blastp |
| 824 | LYM14 H23 | soybean\|gb168\|AW560935 | 2331 | 252 | 80.1 | blastp |
| 825 | LYM14 H25 | spikemoss\|gb165\|FE434307 | 2332 | 252 | 81.06 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 826 | LYM14 H45 | sugarcane\|gb157.3\|CA079818 | 2333 | 252 | 84.2 | blastp |
| 827 | LYM14 H46 | sugarcane\|gb157.3\|CA150518 | 2334 | 252 | 93.85 | tblastn |
| 828 | LYM14 H29 | sunflower\|gb162\|EL484937 | 2335 | 252 | 80.75 | tblastn |
| 829 | LYM14 H30 | switchgrass\|gb167\|DN143407 | 2336 | 252 | 95.4 | blastp |
| 830 | LYM14 H47 | tomato\|09v1\|BG628013 | 2337 | 252 | 80.1 | blastp |
| 831 | LYM14 H31 | wheat\|gb164\|BE416003 | 2338 | 252 | 83.6 | blastp |
| 832 | LYM15 H4 | brachypodium\|09v1\|DV476162 | 2339 | 253 | 80.2 | blastp |
| 833 | LYM15 H2 | pseudoroegneria\|gb167\|FF343970 | 2340 | 253 | 82 | blastp |
| 834 | LYM15 H3 | wheat\|gb164\|BE213295 | 2341 | 253 | 81.4 | blastp |
| 835 | LYM15 H4 | wheat\|gb164\|BE496833 | 2342 | 253 | 81.4 | blastp |
| 836 | LYM16 H9 | barley\|gb157SOLEXA\|BE421507 | 2343 | 254 | 90.9 | blastp |
| 837 | LYM16 H10 | brachypodium\|09v1\|DV475217 | 2344 | 254 | 92.7 | blastp |
| 838 | LYM16 H3 | fescue\|gb161\|DT691110 | 2345 | 254 | 93.9 | blastp |
| 839 | LYM16 H11 | lolium\|09v1\|AU246876 | 2346 | 254 | 84.1 | blastp |
| 840 | LYD199 | maize\|gb170\|BI423687 | 2347 | 254 | 82.9 | blastp |
| 841 | LYM16 H12 | maize\|gb170\|LLFL254633 | 2348 | 254 | 81.1 | tblastn |
| 842 | LYM16 H5 | pseudoroegneria\|gb167\|FF355494 | 2349 | 254 | 92.1 | blastp |
| 843 | LYM16 H6 | rye\|gb164\|BE494944 | 2350 | 254 | 90.24 | tblastn |
| 844 | LYM16 H7 | wheat\|gb164\|BE216981 | 2351 | 254 | 91.5 | blastp |
| 845 | LYM16 H8 | wheat\|gb164\|BE416071 | 2352 | 254 | 90.9 | blastp |
| 846 | LYM16 H9 | wheat\|gb164\|BE418113 | 2353 | 254 | 91.5 | blastp |
| 847 | LYM17 H6 | barley\|gb157SOLEXA\|BE602651 | 2354 | 255 | 83.3 | blastp |
| 848 | LYM17 H7 | sugarcane\|gb157.3\|CA152022 | 2355 | 255 | 80.3 | blastp |
| 849 | LYM17 H3 | wheat\|gb164\|BE406565 | 2356 | 255 | 85.6 | blastp |
| 850 | LYM17 H4 | wheat\|gb164\|BE429209 | 2357 | 255 | 85.6 | blastp |
| 851 | LYM17 H5 | wheat\|gb164\|BE490714 | 2358 | 255 | 86.4 | blastp |
| 852 | LYM17 H6 | wheat\|gb164\|BQ803198 | 2359 | 255 | 85.6 | blastp |
| 853 | LYM19 H10 | barley\|gb157SOLEXA\|AL506367 | 2360 | 256 | 86 | blastp |
| 854 | LYM19 H11 | brachypodium\|09v1\|DV476339 | 2361 | 256 | 87.2 | blastp |
| 855 | LYM19 H3 | leymus\|gb166\|EG387247 | 2362 | 256 | 84.8 | blastp |
| 856 | LYM19 H5 | pseudoroegneria\|gb167\|FF352256 | 2363 | 256 | 86.9 | blastp |
| 857 | LYM19 H12 | sorghum\|09v1\|SB05G009990 | 2364 | 256 | 82.6 | blastp |
| 858 | LYM19 H7 | switchgrass\|gb167\|FE603507 | 2365 | 256 | 83.6 | blastp |
| 859 | LYM19 H8 | wheat\|gb164\|BE398692 | 2366 | 256 | 82.7 | blastp |
| 860 | LYM19 H9 | wheat\|gb164\|BE585979 | 2367 | 256 | 86.28 | tblastn |
| 861 | LYM19 H10 | wheat\|gb164\|BU672325 | 2368 | 256 | 81.4 | blastp |
| 862 | LYM20 H9 | barley\|gb157SOLEXA\|AL450927 | 2369 | 257 | 86.3 | blastp |
| 863 | LYM20 H10 | brachypodium\|09v1\|DV479896 | 2370 | 257 | 89.1 | blastp |
| 864 | LYM20 H11 | castorbean\|09v1\|XM002519056 | 2371 | 257 | 80 | blastp |
| 865 | LYM20 H12 | maize\|gb170\|AI857236 | 2372 | 257 | 90.1 | blastp |
| 866 | LYM20 H5 | pseudoroegneria\|gb167\|FF343142 | 2373 | 257 | 89 | blastp |
| 867 | LYM20 H13 | sorghum\|09v1\|SB01G009140 | 2374 | 257 | 89.7 | blastp |
| 868 | LYM20 H14 | sugarcane\|gb157.3\|CA072511 | 2375 | 257 | 83.9 | blastp |
| 869 | LYM20 H8 | switchgrass\|gb167\|FE654910 | 2376 | 257 | 84.5 | blastp |
| 870 | LYM20 H9 | wheat\|gb164\|BE411982 | 2377 | 257 | 88.6 | blastp |
| 871 | LYM21 H1 | banana\|gb167\|FF557436 | 2378 | 258 | 80.9 | blastp |
| 872 | LYM21 H2 | banana\|gb167\|FF559448 | 2379 | 258 | 80.9 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 873 | LYM21 H27 | barley\|gb157SOLEXA\|BE437461 | 2380 | 258 | 88.2 | blastp |
| 874 | LYM21 H28 | brachypodium\|09v1\|DV488150 | 2381 | 258 | 95.5 | blastp |
| 875 | LYM21 H29 | brachypodium\|09v1\|GT760558 | 2382 | 258 | 97.3 | blastp |
| 876 | LYM21 H5 | cenchrus\|gb166\|EB655115 | 2383 | 258 | 91.8 | blastp |
| 877 | LYM21 H6 | fescue\|gb161\|DT680631 | 2384 | 258 | 90 | blastp |
| 878 | LYM21 H7 | kiwi\|gb166\|FG405276 | 2385 | 258 | 81.8 | blastp |
| 879 | LYM21 H8 | leymus\|gb166\|CN465770 | 2386 | 258 | 88.2 | blastp |
| 880 | LYM21 H30 | lolium\|09v1\|AU250288 | 2387 | 258 | 90 | blastp |
| 881 | LYM21 H9 | lovegrass\|gb167\|DN480337 | 2388 | 258 | 92.7 | blastp |
| 882 | LYM21 H31 | maize\|gb170\|AI586459 | 2389 | 258 | 93.6 | blastp |
| 883 | LYM21 H32 | millet\|09v1\|EVO454PM000432 | 2390 | 258 | 95.5 | blastp |
| 884 | LYM21 H33 | millet\|09v1\|EVO454PM000947 | 2391 | 258 | 91.8 | blastp |
| 885 | LYM21 H12 | pineapple\|gb157.2\|CO731607 | 2392 | 258 | 82.73 | tblastn |
| 886 | LYM21 H34 | rice\|gb170\|OS02G47320 | 2393 | 258 | 87.27 | tblastn |
| 887 | LYM21 H35 | sorghum\|09v1\|SB02G006170 | 2394 | 258 | 93.6 | blastp |
| 888 | LYM21 H36 | sorghum\|09v1\|SB06G027500 | 2395 | 258 | 95.5 | blastp |
| 889 | LYM21 H37 | sugarcane\|gb157.3\|BQ529660 | 2396 | 258 | 93.6 | blastp |
| 890 | LYM21 H38 | sugarcane\|gb157.3\|BQ535381 | 2397 | 258 | 92.7 | blastp |
| 891 | LYM21 H39 | sugarcane\|gb157.3\|CA118830 | 2398 | 258 | 87.3 | blastp |
| 892 | LYM21 H19 | switchgrass\|gb167\|DN151016 | 2399 | 258 | 93.6 | blastp |
| 893 | LYM21 H20 | switchgrass\|gb167\|FL722429 | 2400 | 258 | 94.5 | blastp |
| 894 | LYM21 H21 | switchgrass\|gb167\|FL936988 | 2401 | 258 | 95.5 | blastp |
| 895 | LYM21 H22 | tobacco\|gb162\|AM791579 | 2402 | 258 | 88.2 | blastp |
| 896 | LYM21 H23 | wheat\|gb164\|BE352632 | 2403 | 258 | 89.1 | blastp |
| 897 | LYM21 H24 | wheat\|gb164\|BE402792 | 2404 | 258 | 89.1 | blastp |
| 898 | LYM21 H25 | wheat\|gb164\|BE492575 | 2405 | 258 | 89.09 | tblastn |
| 899 | LYM21 H26 | wheat\|gb164\|CA484575 | 2406 | 258 | 94.5 | blastp |
| 900 | LYM21 H27 | wheat\|gb164\|CA616609 | 2407 | 258 | 92.73 | tblastn |
| 901 | LYM24 H1 | fescue\|gb161\|DT681171 | 2408 | 261 | 80.61 | tblastn |
| 902 | LYM24 H2 | leymus\|gb166\|CD808623 | 2409 | 261 | 80.5 | blastp |
| 903 | LYM24 H8 | maize\|gb170\|AI621440 | 2410 | 261 | 81 | blastp |
| 904 | LYM24 H9 | pseudoroegneria\|gb167\|FF349814 | 2411 | 261 | 80 | blastp |
| 905 | LYM24 H10 | sorghum\|09v1\|SB03G044280 | 2412 | 261 | 83.1 | blastp |
| 906 | LYM24 H11 | sugarcane\|gb157.3\|CA072633 | 2413 | 261 | 82.6 | blastp |
| 907 | LYM24 H6 | switchgrass\|gb167\|DN144637 | 2414 | 261 | 84.6 | blastp |
| 908 | LYM24 H7 | switchgrass\|gb167\|DN145452 | 2415 | 261 | 85.6 | blastp |
| 909 | LYM24 H8 | wheat\|gb164\|BE425900 | 2416 | 261 | 80 | tblastn |
| 910 | LYM26 H1 | wheat\|gb164\|BE398903 | 2417 | 262 | 88.6 | blastp |
| 911 | LYM30 H5 | brachypodium\|09v1\|SRR031799S0073966 | 2418 | 263 | 86.5 | blastp |
| 912 | LYM30 H6 | maize\|gb170\|AW520185 | 2419 | 263 | 85.8 | blastp |
| 913 | LYM30 H7 | maize\|gb170\|AW927689 | 2420 | 263 | 85 | blastp |
| 914 | LYM30 H8 | rice\|gb170\|OS11G02580 | 2421 | 263 | 99.2 | blastp |
| 915 | LYM30 H9 | rice\|gb170\|OS12G02510 | 2422 | 263 | 87.7 | blastp |
| 916 | LYM30 H10 | sorghum\|09v1\|SB05G001250 | 2423 | 263 | 86.1 | blastp |
| 917 | LYM30 H5 | switchgrass\|gb167\|FL796240 | 2424 | 263 | 80.16 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 918 | LYM31 H1 | rice\|gb170\|OS12G02710 | 2425 | 264 | 97.9 | blastp |
| 919 | LYM35 H5 | brachypodium\|09v1\|SRR031798S0189278 | 2426 | 267 | 80 | blastp |
| 920 | LYM35 H6 | maize\|gb170\|BM416880 | 2427 | 267 | 89.7 | blastp |
| 921 | LYM35 H7 | sorghum\|09v1\|SB06G031730 | 2428 | 267 | 86.7 | blastp |
| 922 | LYM35 H8 | sugarcane\|gb157.3\|CA105471 | 2429 | 267 | 87.5 | blastp |
| 923 | LYM35 H4 | switchgrass\|gb167\|FL939819 | 2430 | 267 | 89.9 | blastp |
| 924 | LYM35 H5 | wheat\|gb164\|BE500504 | 2431 | 267 | 86.1 | blastp |
| 925 | LYM42 H0 | rice\|gb170\|OS01G41120 | 2432 | 273 | 96.7 | blastp |
| 925 | LYM42 H0 | rice\|gb170\|OS01G41120 | 2432 | 439 | 99.83 | tblastn |
| 926 | LYM43 H1 | rice\|gb170\|OS12G02800 | 2433 | 274 | 91.4 | blastp |
| 927 | LYM52 H1 | b rapa\|gb162\|EX068270 | 2434 | 277 | 94.5 | blastp |
| 928 | LYM52 H2 | fescue\|gb161\|CK802823 | 2435 | 277 | 84.4 | blastp |
| 929 | LYM52 H3 | leymus\|gb166\|EG379466 | 2436 | 277 | 96.3 | blastp |
| 930 | LYM52 H10 | maize\|gb170\|BE130094 | 2437 | 277 | 80 | blastp |
| 931 | LYM52 H11 | maize\|gb170\|LLBE056010 | 2438 | 277 | 81 | blastp |
| 932 | LYM52 H12 | rice\|gb170\|OS04G51792 | 2439 | 277 | 81.4 | blastp |
| 933 | LYM52 H13 | sorghum\|09v1\|SB06G027870 | 2440 | 277 | 82.5 | blastp |
| 934 | LYM52 H14 | sugarcane\|gb157.3\|AA577629 | 2441 | 277 | 84.47 | tblastn |
| 935 | LYM52 H8 | switchgrass\|gb167\|DN147335 | 2442 | 277 | 82.65 | tblastn |
| 936 | LYM52 H9 | wheat\|gb164\|BG909259 | 2443 | 277 | 94.5 | blastp |
| 937 | LYM52 H10 | wheat\|gb164\|BG909493 | 2444 | 277 | 95.1 | blastp |
| 938 | LYM56 H9 | brachypodium\|09v1\|SRR031795S0049724 | 2445 | 279 | 85.9 | blastp |
| 939 | LYM56 H10 | maize\|gb170\|AI711954 | 2446 | 279 | 80.14 | tblastn |
| 940 | LYM56 H2 | pseudoroegneria\|gb167\|FF341776 | 2447 | 279 | 87.9 | blastp |
| 941 | LYM56 H11 | rice\|gb170\|OS03G45720 | 2448 | 279 | 80.1 | blastp |
| 942 | LYM56 H12 | sorghum\|09v1\|SB01G012840 | 2449 | 279 | 81 | blastp |
| 943 | LYM56 H13 | sugarcane\|gb157.3\|BQ533995 | 2450 | 279 | 80.14 | tblastn |
| 944 | LYM56 H6 | switchgrass\|gb167\|FE631693 | 2451 | 279 | 84.5 | blastp |
| 945 | LYM56 H7 | switchgrass\|gb167\|FL782747 | 2452 | 279 | 83.1 | blastp |
| 946 | LYM56 H8 | wheat\|gb164\|BE404207 | 2453 | 279 | 88.7 | blastp |
| 947 | LYM56 H9 | wheat\|gb164\|CD912963 | 2454 | 279 | 87.8 | blastp |
| 948 | LYM57 H0 | brachypodium\|09v1\|DV475724 | 2455 | 280 | 81.1 | blastp |
| 949 | LYM62 H1 | sorghum\|09v1\|SB10G012150 | 2456 | 282 | 88.9 | blastp |
| 950 | LYM66 H1 | wheat\|gb164\|BE403932 | 2457 | 283 | 83 | blastp |
| 950 | LYM66 H1 | wheat\|gb164\|BE403932 | 2457 | 440 | 83 | blastp |
| 951 | LYM66 H2 | wheat\|gb164\|BE405409 | 2458 | 283 | 90.4 | blastp |
| 951 | LYM66 H2 | wheat\|gb164\|BE405409 | 2458 | 440 | 90.4 | blastp |
| 952 | LYM66 H3 | wheat\|gb164\|CA600263 | 2459 | 283 | 90.1 | blastp |
| 952 | LYM66 H3 | wheat\|gb164\|CA600263 | 2459 | 440 | 90.1 | blastp |
| 953 | LYM69 H0 | rice\|gb170\|OS07G42520 | 2460 | 286 | 98.3 | blastp |
| 954 | LYM73 H6 | brachypodium\|09v1\|DV481090 | 2461 | 287 | 95.8 | blastp |
| 955 | LYM73 H7 | maize\|gb170\|AW256155 | 2462 | 287 | 93.7 | blastp |
| 956 | LYM73 H8 | sorghum\|09v1\|SB07G004300 | 2463 | 287 | 94.3 | blastp |
| 957 | LYM73 H9 | sugarcane\|gb157.3\|CA117425 | 2464 | 287 | 94.3 | blastp |
| 958 | LYM73 H5 | switchgrass\|gb167\|DN145973 | 2465 | 287 | 94.6 | blastp |
| 959 | LYM73 H6 | wheat\|gb164\|AF289257S1 | 2466 | 287 | 92.67 | tblastn |
| 960 | LYM79 H3 | brachypodium\|09v1\|SRR031800S0005207 | 2467 | 289 | 83.8 | blastp |
| 961 | LYM79 H4 | millet\|09v1\|EVO454PM011117 | 2468 | 441 | 82.72 | tblastn |
| 962 | LYM79 H5 | sorghum\|09v1\|SB10G012140 | 2469 | 289 | 93 | blastp |
| 962 | LYM79 H5 | sorghum\|09v1\|SB10G012140 | 2469 | 441 | 93.75 | tblastn |
| 963 | LYM79 H1 | switchgrass\|gb167\|FE598528 | 2470 | 289 | 90.6 | blastp |
| 963 | LYM79 H1 | switchgrass\|gb167\|FE598528 | 2470 | 441 | 91.1 | tblastn |
| 964 | LYM79 H2 | switchgrass\|gb167\|FL957870 | 2471 | 441 | 86.6 | tblastn |
| 965 | LYM79 H3 | wheat\|gb164\|BE590518 | 2472 | 289 | 80 | blastp |
| 965 | LYM79 H3 | wheat\|gb164\|BE590518 | 2472 | 441 | 83.33 | tblastn |
| 966 | LYM82 H1 | banana\|gb167\|FF561962 | 2473 | 290 | 82.1 | blastp |
| 967 | LYM82 H12 | brachypodium\|09v1\|GT816645 | 2474 | 290 | 94.1 | blastp |
| 968 | LYM82 H2 | leymus\|gb166\|EG384073 | 2475 | 290 | 97.9 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 969 | LYM82 H13 | maize\|gb170\|AW181152 | 2476 | 290 | 90.6 | blastp |
| 970 | LYM82 H4 | melon\|gb165\|AM718213 | 2477 | 290 | 80.21 | tblastn |
| 971 | LYM82 H14 | millet\|09v1\|EVO454PM002754 | 2478 | 290 | 82.99 | tblastn |
| 972 | LYM82 H5 | *pseudoroegneria*\|gb167\|FF352234 | 2479 | 290 | 99 | blastp |
| 973 | LYM82 H15 | rice\|gb170\|OS06G04460 | 2480 | 290 | 91 | blastp |
| 974 | LYM82 H16 | *sorghum*\|09v1\|SB10G002420 | 2481 | 290 | 90.3 | blastp |
| 975 | LYM82 H8 | soybean\|gb168\|CA921223 | 2482 | 290 | 80.21 | tblastn |
| 976 | LYM82 H17 | sugarcane\|gb157.3\|BU102729 | 2483 | 290 | 90.3 | blastp |
| 977 | LYM82 H10 | switchgrass\|gb167\|FL744837 | 2484 | 290 | 89.6 | blastp |
| 978 | LYM82 H11 | wheat\|gb164\|BE403842 | 2485 | 290 | 99 | blastp |
| 979 | LYM82 H12 | wheat\|gb164\|CA660788 | 2486 | 290 | 99 | blastp |
| 980 | LYM83 H8 | *brachypodium*\|09v1\|SRR031797S0009670 | 2487 | 291 | 86.5 | blastp |
| 980 | LYM83 H8 | *brachypodium*\|09v1\|SRR031797S0009670 | 2487 | 442 | 86.1 | blastp |
| 981 | LYM83 H9 | *lolium*\|09v1\|ES699086 | 2488 | 291 | 84.84 | tblastn |
| 981 | LYM83 H9 | *lolium*\|09v1\|ES699086 | 2488 | 442 | 84.43 | tblastn |
| 982 | LYM83 H10 | maize\|gb170\|AI665347 | 2489 | 291 | 82.4 | blastp |
| 982 | LYM83 H10 | maize\|gb170\|AI665347 | 2489 | 442 | 82.4 | blastp |
| 983 | LYM83 H3 | *pseudoroegneria*\|gb167\|FF354990 | 2490 | 291 | 97.5 | blastp |
| 983 | LYM83 H3 | *pseudoroegneria*\|gb167\|FF354990 | 2490 | 442 | 97.1 | blastp |
| 984 | LYM83 H11 | rice\|gb170\|OS05G45300 | 2491 | 291 | 81.6 | blastp |
| 984 | LYM83 H11 | rice\|gb170\|OS05G45300 | 2491 | 442 | 81.1 | blastp |
| 985 | LYM83 H12 | *sorghum*\|09v1\|SB09G026370 | 2492 | 291 | 82 | blastp |
| 985 | LYM83 H12 | *sorghum*\|09v1\|SB09G026370 | 2492 | 442 | 81.6 | blastp |
| 986 | LYM83 H6 | switchgrass\|gb167\|DN149383 | 2493 | 291 | 84 | blastp |
| 986 | LYM83 H6 | switchgrass\|gb167\|DN149383 | 2493 | 442 | 83.6 | blastp |
| 987 | LYM83 H7 | wheat\|gb164\|BE516715 | 2494 | 291 | 94.7 | blastp |
| 987 | LYM83 H7 | wheat\|gb164\|BE516715 | 2494 | 442 | 94.3 | blastp |
| 988 | LYM83 H8 | wheat\|gb164\|BF428688 | 2495 | 291 | 95.1 | blastp |
| 988 | LYM83 H8 | wheat\|gb164\|BF428688 | 2495 | 442 | 94.7 | blastp |
| 989 | LYM84 H8 | *brachypodium*\|09v1\|SRR031795S0021840 | 2496 | 292 | 92.8 | blastp |
| 990 | LYM84 H9 | maize\|gb170\|AW282161 | 2497 | 292 | 82.8 | blastp |
| 991 | LYM84 H10 | maize\|gb170\|LLDQ245778 | 2498 | 292 | 98.7 | blastp |
| 992 | LYM84 H4 | *pseudoroegneria*\|gb167\|FF355744 | 2499 | 292 | 98.3 | blastp |
| 993 | LYM84 H11 | rice\|gb170\|OS03G41612 | 2500 | 292 | 84.58 | tblastn |
| 994 | LYM84 H12 | *sorghum*\|09v1\|SB01G014640 | 2501 | 292 | 82.9 | blastp |
| 995 | LYM84 H7 | switchgrass\|gb167\|FE652995 | 2502 | 292 | 81.3 | blastp |
| 996 | LYM84 H8 | wheat\|gb164\|BE417697 | 2503 | 292 | 95.1 | blastp |
| 997 | LYM88 H0 | *arabidopsis lyrata*\|09v1\|JGIAL014996 | 2504 | 294 | 91.5 | blastp |
| 998 | LYM89 H5 | *arabidopsis lyrata*\|09v1\|JGIAL031299 | 2505 | 295 | 86.36 | tblastn |
| 999 | LYM89 H2 | canola\|gb161\|CD812018 | 2506 | 295 | 81.8 | blastp |
| 1000 | LYM89 H3 | canola\|gb161\|CD821897 | 2507 | 295 | 81.8 | blastp |
| 1001 | LYM89 H4 | radish\|gb164\|EW732798 | 2508 | 295 | 81.65 | tblastn |
| 1002 | LYM89 H5 | radish\|gb164\|EX749702 | 2509 | 295 | 80.7 | blastp |
| 1003 | LYM90 H3 | *brachypodium*\|09v1\|DV488904 | 2510 | 296 | 83.2 | blastp |
| 1004 | LYM90 H2 | wheat\|gb164\|BQ242151 | 2511 | 296 | 94.6 | blastp |
| 1005 | LYM90 H3 | wheat\|gb164\|BQ244922 | 2512 | 296 | 94.6 | blastp |
| 1006 | LYM91 H1 | rye\|gb164\|BE494176 | 2513 | 297 | 82.5 | blastp |
| 1007 | LYM91 H2 | wheat\|gb164\|BE400659 | 2514 | 297 | 85.4 | blastp |
| 1008 | LYM91 H3 | wheat\|gb164\|CA593112 | 2515 | 297 | 86.27 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1009 | LYM93 H1 | wheat\|gb164\|BE401535 | 2516 | 298 | 93.6 | blastp |
| 1010 | LYM93 H2 | wheat\|gb164\|BE418047 | 2517 | 298 | 93.6 | blastp |
| 1011 | LYM93 H3 | wheat\|gb164\|CA624071 | 2518 | 298 | 84.6 | blastp |
| 1012 | LYM93 H4 | wheat\|gb164\|CA678405 | 2519 | 298 | 94.55 | tblastn |
| 1013 | LYM93 H5 | wheat\|gb164\|CJ920171 | 2520 | 298 | 88.7 | blastp |
| 1014 | LYM99 H2 | brachypodium\|09v1\|DV482533 | 2521 | 299 | 86.8 | blastp |
| 1015 | LYM99 H2 | wheat\|gb164\|AL818990 | 2522 | 299 | 94.12 | tblastn |
| 1016 | LYM100 H1 | wheat\|gb164\|BE399036 | 2523 | 301 | 89.5 | blastp |
| 1017 | LYM103 H2 | sorghum\|09v1\|SB03G004410 | 2524 | 303 | 89.69 | tblastn |
| 1018 | LYM103 H3 | sugarcane\|gb157.3\|CA078686 | 2525 | 303 | 89.69 | tblastn |
| 1019 | LYM103 H2 | switchgrass\|gb167\|FL877864 | 2526 | 303 | 87 | blastp |
| 1020 | LYM105 H5 | barley\|gb157SOLEXA\|BQ461657 | 2527 | 304 | 90.9 | blastp |
| 1021 | LYM105 H2 | pseudoroegneria\|gb167\|FF366339 | 2528 | 304 | 90.5 | blastp |
| 1022 | LYM105 H3 | wheat\|gb164\|BE405330 | 2529 | 304 | 90 | blastp |
| 1023 | LYM105 H4 | wheat\|gb164\|BE637936 | 2530 | 304 | 91.8 | blastp |
| 1024 | LYM105 H5 | wheat\|gb164\|BQ743875 | 2531 | 304 | 89.4 | blastp |
| 1025 | LYM106 H8 | brachypodium\|09v1\|DV476632 | 2532 | 305 | 80.7 | blastp |
| 1026 | LYM106 H9 | maize\|gb170\|LLDQ245927 | 2533 | 305 | 97.9 | blastp |
| 1027 | LYM106 H3 | pseudoroegneria\|gb167\|FF347837 | 2534 | 305 | 96.5 | blastp |
| 1028 | LYM106 H4 | rye\|gb164\|BE586535 | 2535 | 305 | 90.3 | blastp |
| 1029 | LYM106 H5 | spruce\|gb162\|DR543563 | 2536 | 305 | 84.72 | tblastn |
| 1030 | LYM106 H6 | wheat\|gb164\|BE443195 | 2537 | 305 | 96.5 | blastp |
| 1031 | LYM106 H7 | wheat\|gb164\|BE445264 | 2538 | 305 | 97.9 | blastp |
| 1032 | LYM106 H8 | wheat\|gb164\|BF485098 | 2539 | 305 | 97.2 | blastp |
| 1033 | LYM110 H1 | sugarcane\|gb157.3\|CA204413 | 2540 | 306 | 84.3 | tblastn |
| 1034 | LYM111 H7 | brachypodium\|09v1\|GT765731 | 2541 | 307 | 80.96 | tblastn |
| 1035 | LYM111 H1 | cenchrus\|gb166\|EB657665 | 2542 | 307 | 87.6 | blastp |
| 1036 | LYM111 H8 | maize\|gb170\|AI941545 | 2543 | 307 | 89.9 | blastp |
| 1037 | LYM111 H9 | rice\|gb170\|OS01G57066 | 2544 | 307 | 81.5 | blastp |
| 1038 | LYM111 H10 | sorghum\|09v1\|SB03G036350 | 2545 | 307 | 91.5 | blastp |
| 1039 | LYM111 H11 | sorghum\|09v1\|SB05G023720 | 2546 | 307 | 93.1 | tblastn |
| 1040 | LYM111 H12 | sugarcane\|gb157.3\|CA072460 | 2547 | 307 | 89.38 | tblastn |
| 1041 | LYM111 H7 | switchgrass\|gb167\|FL711377 | 2548 | 307 | 90.8 | blastp |
| 1042 | LYM119 H1 | sorghum\|09v1\|SB05G003680 | 2549 | 308 | 93.8 | blastp |
| 1043 | LYM122 H1 | brachypodium\|09v1\|DV469739 | 2550 | 310 | 84.5 | blastp |
| 1044 | LYM122 H1 | pseudoroegneria\|gb167\|FF350527 | 2551 | 310 | 82.53 | tblastn |
| 1045 | LYM129 H2 | brachypodium\|09v1\|SRR031795S0005798 | 2552 | 315 | 80.4 | blastp |
| 1046 | LYM129 H3 | maize\|gb170\|BQ486269 | 2553 | 315 | 82.8 | blastp |
| 1047 | LYM129 H4 | sorghum\|09v1\|SB03G044510 | 2554 | 315 | 81.6 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1048 | LYM129 H2 | switchgrass\|gb167\|FE643628 | 2555 | 315 | 80.6 | blastp |
| 1049 | LYM130 H1 | leymus\|gb166\|EG377985 | 2556 | 316 | 80.2 | blastp |
| 1050 | LYM130 H2 | rice\|gb170\|OS05G04380 | 2557 | 316 | 99.4 | blastp |
| 1051 | LYM130 H2 | wheat\|gb164\|BE414767 | 2558 | 316 | 80.8 | blastp |
| 1052 | LYM131 H1 | aquilegia\|gb157.3\|DR917618 | 2559 | 317 | 81.2 | blastp |
| 1053 | LYM131 H13 | barley\|gb157SOLEXA\|AL450948 | 2560 | 317 | 83 | blastp |
| 1054 | LYM131 H14 | brachypodium\|09v1\|DV479902 | 2561 | 317 | 85.3 | blastp |
| 1055 | LYM131 H15 | maize\|gb170\|AI861327 | 2562 | 317 | 90.8 | blastp |
| 1056 | LYM131 H16 | maize\|gb170\|AW129826 | 2563 | 317 | 82.8 | blastp |
| 1057 | LYM131 H17 | maize\|gb170\|AW453172 | 2564 | 317 | 91.7 | blastp |
| 1058 | LYM131 H18 | rice\|gb170\|OS08G12750 | 2565 | 317 | 85.1 | blastp |
| 1059 | LYM131 H19 | sorghum\|09v1\|SB06G027970 | 2566 | 317 | 91.5 | blastp |
| 1060 | LYM131 H20 | sorghum\|09v1\|SB07G006320 | 2567 | 317 | 81 | blastp |
| 1061 | LYM131 H21 | sugarcane\|gb157.3\|CA068895 | 2568 | 317 | 91.5 | blastp |
| 1062 | LYM131 H11 | switchgrass\|gb167\|FE607026 | 2569 | 317 | 81.7 | blastp |
| 1063 | LYM131 H12 | switchgrass\|gb167\|FL708944 | 2570 | 317 | 91.49 | tblastn |
| 1064 | LYM131 H13 | wheat\|gb164\|BE412257 | 2571 | 317 | 83.7 | blastp |
| 1065 | LYM134 H0 | rice\|gb170\|OS04G56990 | 2572 | 319 | 98.8 | blastp |
| 1066 | LYM137 H2 | amborella\|gb166\|CK758151 | 2573 | 321 | 85.1 | blastp |
| 1067 | LYM137 H3 | antirrhinum\|gb166\|AJ788115 | 2574 | 321 | 83.7 | blastp |
| 1068 | LYM137 H4 | antirrhinum\|gb166\|AJ791024 | 2575 | 321 | 83 | blastp |
| 1069 | LYM137 H5 | antirrhinum\|gb166\|AJ793144 | 2576 | 321 | 83.01 | tblastn |
| 1070 | LYM137 H217 | apple\|gb171\|CN445333 | 2577 | 321 | 81 | blastp |
| 1071 | LYM137 H218 | apple\|gb171\|CN489019 | 2578 | 321 | 82.4 | blastp |
| 1072 | LYM137 H219 | apple\|gb171\|CN491888 | 2579 | 321 | 81.8 | blastp |
| 1073 | LYM137 H10 | aquilegia\|gb157.3\|DT729599 | 2580 | 321 | 82.7 | blastp |
| 1074 | LYM137 H220 | arabidopsis lyrata\|09v1\|BQ834082 | 2581 | 321 | 81.8 | blastp |
| 1075 | LYM137 H221 | arabidopsis lyrata\|09v1\|BQ834260 | 2582 | 321 | 80.5 | blastp |
| 1076 | LYM137 H222 | arabidopsis lyrata\|09v1\|JGIAL015196 | 2583 | 321 | 80.5 | blastp |
| 1077 | LYM137 H11 | arabidopsis\|gb165\|AT3G55280 | 2584 | 321 | 81.2 | blastp |
| 1078 | LYM137 H12 | artemisia\|gb164\|EY035831 | 2585 | 321 | 85 | blastp |
| 1079 | LYM137 H13 | avocado\|gb164\|CO995706 | 2586 | 321 | 85.3 | blastp |
| 1080 | LYM137 H14 | avocado\|gb164\|CV460574 | 2587 | 321 | 84.6 | blastp |
| 1081 | LYM137 H15 | b juncea\|gb164\|EVGN00185312102498 | 2588 | 321 | 83.8 | blastp |
| 1082 | LYM137 H16 | b juncea\|gb164\|EVGN00317014862029 | 2589 | 321 | 81.2 | blastp |
| 1083 | LYM137 H17 | b juncea\|gb164\|EVGN01375409582897 | 2590 | 321 | 81.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1084 | LYM137 H223 | b nigra\|09v1\|GT069407 | 2591 | 321 | 81.2 | blastp |
| 1085 | LYM137 H18 | b oleracea\|gb161\|AM392244 | 2592 | 321 | 81.2 | blastp |
| 1086 | LYM137 H19 | b oleracea\|gb161\|DY014383 | 2593 | 321 | 83.8 | blastp |
| 1087 | LYM137 H20 | b oleracea\|gb161\|DY023491 | 2594 | 321 | 83.8 | blastp |
| 1088 | LYM137 H21 | b oleracea\|gb161\|DY023494 | 2595 | 321 | 81.2 | blastp |
| 1089 | LYM137 H22 | b oleracea\|gb161\|DY027443 | 2596 | 321 | 81.2 | blastp |
| 1090 | LYM137 H23 | b oleracea\|gb161\|EE535717 | 2597 | 321 | 80.5 | blastp |
| 1091 | LYM137 H24 | b rapa\|gb162\|BG543640 | 2598 | 321 | 83.77 | tblastn |
| 1092 | LYM137 H25 | b rapa\|gb162\|BQ791808 | 2599 | 321 | 80.5 | blastp |
| 1093 | LYM137 H26 | b rapa\|gb162\|CA991997 | 2600 | 321 | 81.2 | blastp |
| 1094 | LYM137 H27 | b rapa\|gb162\|CV432555 | 2601 | 321 | 81.2 | blastp |
| 1095 | LYM137 H28 | b rapa\|gb162\|CV432912 | 2602 | 321 | 81.2 | blastp |
| 1096 | LYM137 H29 | b rapa\|gb162\|CV432918 | 2603 | 321 | 83.8 | blastp |
| 1097 | LYM137 H30 | b rapa\|gb162\|CX267185 | 2604 | 321 | 81.2 | blastp |
| 1098 | LYM137 H31 | b rapa\|gb162\|CX271342 | 2605 | 321 | 81.2 | blastp |
| 1099 | LYM137 H32 | banana\|gb167\|DN239514 | 2606 | 321 | 85.7 | blastp |
| 1100 | LYM137 H33 | banana\|gb167\|ES431662 | 2607 | 321 | 86.4 | blastp |
| 1101 | LYM137 H34 | banana\|gb167\|FF558102 | 2608 | 321 | 85.7 | blastp |
| 1102 | LYM137 H35 | banana\|gb167\|FF558729 | 2609 | 321 | 86.4 | blastp |
| 1103 | LYM137 H36 | banana\|gb167\|FF560801 | 2610 | 321 | 85.7 | blastp |
| 1104 | LYM137 H37 | banana\|gb167\|FL657344 | 2611 | 321 | 85.8 | blastp |
| 1105 | LYM137 H38 | *basilicum*\|gb157.3\|DY342616 | 2612 | 321 | 80.5 | blastp |
| 1106 | LYM137 H39 | bean\|gb167\|CA897728 | 2613 | 321 | 85 | blastp |
| 1107 | LYM137 H40 | bean\|gb167\|CA897730 | 2614 | 321 | 83.1 | blastp |
| 1108 | LYM137 H41 | beet\|gb162\|BF011189 | 2615 | 321 | 82.5 | blastp |
| 1109 | LYM137 H42 | beet\|gb162\|BI096284 | 2616 | 321 | 84.4 | blastp |
| 1110 | LYM137 H224 | *brachypodium*\|09v1\|DV476457 | 2617 | 321 | 96.1 | blastp |
| 1111 | LYM137 H225 | *brachypodium*\|09v1\|DV489152 | 2618 | 321 | 96.1 | blastp |
| 1112 | LYM137 H45 | cacao\|gb167\|CA795798 | 2619 | 321 | 83.7 | blastp |
| 1113 | LYM137 H46 | cacao\|gb167\|CU476798 | 2620 | 321 | 83.8 | blastp |
| 1114 | LYM137 H47 | canola\|gb161\|CD811640 | 2621 | 321 | 83.8 | blastp |
| 1115 | LYM137 H48 | canola\|gb161\|CD812285 | 2622 | 321 | 81.2 | blastp |
| 1116 | LYM137 H49 | canola\|gb161\|CD812312 | 2623 | 321 | 81.2 | blastp |
| 1117 | LYM137 H50 | canola\|gb161\|CD812501 | 2624 | 321 | 81.2 | blastp |
| 1118 | LYM137 H51 | canola\|gb161\|CD815420 | 2625 | 321 | 81.2 | blastp |
| 1119 | LYM137 H52 | canola\|gb161\|CD816902 | 2626 | 321 | 81.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1120 | LYM137 H53 | canola\|gb161\|CD817591 | 2627 | 321 | 81.2 | blastp |
| 1121 | LYM137 H54 | canola\|gb161\|CD821663 | 2628 | 321 | 83.8 | blastp |
| 1122 | LYM137 H55 | canola\|gb161\|CN726029 | 2629 | 321 | 83.8 | blastp |
| 1123 | LYM137 H56 | canola\|gb161\|CN731028 | 2630 | 321 | 81.2 | blastp |
| 1124 | LYM137 H57 | canola\|gb161\|EE479368 | 2631 | 321 | 83.8 | blastp |
| 1125 | LYM137 H58 | canola\|gb161\|H07535 | 2632 | 321 | 83.8 | blastp |
| 1126 | LYM137 H226 | cassava\|09v1\|CK643771 | 2633 | 321 | 83.1 | blastp |
| 1127 | LYM137 H227 | cassava\|09v1\|CK647492 | 2634 | 321 | 83.8 | blastp |
| 1128 | LYM137 H228 | cassava\|09v1\|DV455355 | 2635 | 321 | 81.8 | blastp |
| 1129 | LYM137 H229 | castorbean\|09v1\|EG700188 | 2636 | 321 | 85 | blastp |
| 1130 | LYM137 H230 | castorbean\|09v1\|XM002531924 | 2637 | 321 | 84.9 | blastp |
| 1131 | LYM137 H63 | catharanthus\|gb166\|EG556131 | 2638 | 321 | 82.6 | blastp |
| 1132 | LYM137 H64 | catharanthus\|gb166\|EG557604 | 2639 | 321 | 82.6 | blastp |
| 1133 | LYM137 H65 | cenchrus\|gb166\|EB652612 | 2640 | 321 | 93.4 | blastp |
| 1134 | LYM137 H66 | centaurea\|gb166\|EH715158 | 2641 | 321 | 83 | blastp |
| 1135 | LYM137 H67 | centaurea\|gb166\|EH737696 | 2642 | 321 | 84.3 | blastp |
| 1136 | LYM137 H68 | centaurea\|gb166\|EH746709 | 2643 | 321 | 82.5 | blastp |
| 1137 | LYM137 H231 | chestnut\|gb170\|SRR006295S0004667 | 2644 | 321 | 83.8 | blastp |
| 1138 | LYM137 H232 | chestnut\|gb170\|SRR006295S0010167 | 2645 | 321 | 83.1 | blastp |
| 1139 | LYM137 H233 | chickpea\|09v2\|FE669244 | 2646 | 321 | 85.6 | blastp |
| 1140 | LYM137 H234 | chickpea\|09v2\|FE671615 | 2647 | 321 | 85.6 | blastp |
| 1141 | LYM137 H235 | cichorium\|gb171\|DT210912 | 2648 | 321 | 84.3 | blastp |
| 1142 | LYM137 H236 | cichorium\|gb171\|EH681883 | 2649 | 321 | 84.4 | blastp |
| 1143 | LYM137 H237 | cichorium\|gb171\|EH696050 | 2650 | 321 | 83.8 | blastp |
| 1144 | LYM137 H72 | citrus\|gb166\|CB610578 | 2651 | 321 | 83.7 | blastp |
| 1145 | LYM137 H73 | citrus\|gb166\|CN183415 | 2652 | 321 | 82.9 | blastp |
| 1146 | LYM137 H74 | coffea\|gb157.2\|DV663668 | 2653 | 321 | 85 | blastp |
| 1147 | LYM137 H75 | cotton\|gb164\|AI728522 | 2654 | 321 | 84.3 | blastp |
| 1148 | LYM137 H76 | cotton\|gb164\|AI729531 | 2655 | 321 | 85 | blastp |
| 1149 | LYM137 H77 | cotton\|gb164\|BE055719 | 2656 | 321 | 83 | blastp |
| 1150 | LYM137 H78 | cotton\|gb164\|BF269641 | 2657 | 321 | 84.3 | blastp |
| 1151 | LYM137 H79 | cotton\|gb164\|BG441496 | 2658 | 321 | 81.8 | blastp |
| 1152 | LYM137 H80 | cowpea\|gb166\|BE336250 | 2659 | 321 | 83.9 | blastp |
| 1153 | LYM137 H81 | cowpea\|gb166\|FF382348 | 2660 | 321 | 85.1 | blastp |
| 1154 | LYM137 H82 | cowpea\|gb166\|FF391267 | 2661 | 321 | 86.9 | blastp |
| 1155 | LYM137 H83 | cryptomeria\|gb166\|BP176442 | 2662 | 321 | 80.5 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1156 | LYM137 H84 | cryptomeria\|gb166\|BW996322 | 2663 | 321 | 81.2 | blastp |
| 1157 | LYM137 H238 | cucumber\|09v1\|BGI454H0165031 | 2664 | 321 | 81.6 | blastp |
| 1158 | LYM137 H239 | cucumber\|09v1\|CK085893 | 2665 | 321 | 83.7 | blastp |
| 1159 | LYM137 H240 | cucumber\|09v1\|DV632825 | 2666 | 321 | 85 | blastp |
| 1160 | LYM137 H85 | cynara\|gb167\|GE588138 | 2667 | 321 | 84.4 | blastp |
| 1161 | LYM137 H86 | dandelion\|gb161\|DY804086 | 2668 | 321 | 85.1 | blastp |
| 1162 | LYM137 H87 | dandelion\|gb161\|DY813115 | 2669 | 321 | 83.8 | blastp |
| 1163 | LYM137 H88 | eucalyptus\|gb166\|CT980143 | 2670 | 321 | 83.1 | blastp |
| 1164 | LYM137 H89 | eucalyptus\|gb166\|CT981000 | 2671 | 321 | 81.3 | blastp |
| 1165 | LYM137 H90 | fescue\|gb161\|DT686472 | 2672 | 321 | 80.9 | blastp |
| 1166 | LYM137 H241 | flax\|09v1\|EU829592 | 2673 | 321 | 81 | blastp |
| 1167 | LYM137 H242 | gerbera\|09v1\|AJ750707 | 2674 | 321 | 85.6 | blastp |
| 1168 | LYM137 H243 | gerbera\|09v1\|AJ753127 | 2675 | 321 | 84.31 | tblastn |
| 1169 | LYM137 H244 | gerbera\|09v1\|AJ755440 | 2676 | 321 | 81.7 | blastp |
| 1170 | LYM137 H91 | ginger\|gb164\|DY352000 | 2677 | 321 | 85.5 | blastp |
| 1171 | LYM137 H92 | ginger\|gb164\|DY356913 | 2678 | 321 | 83.7 | blastp |
| 1172 | LYM137 H93 | grape\|gb160\|CA816335 | 2679 | 321 | 80.6 | blastp |
| 1173 | LYM137 H94 | grape\|gb160\|CB348289 | 2680 | 321 | 81.3 | blastp |
| 1174 | LYM137 H95 | grape\|gb160\|CB979641 | 2681 | 321 | 84.5 | blastp |
| 1175 | LYM137 H96 | iceplant\|gb164\|CA834927 | 2682 | 321 | 82.5 | blastp |
| 1176 | LYM137 H97 | ipomoea\|gb157.2\|BU690174 | 2683 | 321 | 82.2 | blastp |
| 1177 | LYM137 H98 | ipomoea\|gb157.2\|CJ738553 | 2684 | 321 | 82.9 | blastp |
| 1178 | LYM137 H245 | jatropha\|09v1\|GO247333 | 2685 | 321 | 85.6 | blastp |
| 1179 | LYM137 H99 | kiwi\|gb166\|FG413271 | 2686 | 321 | 83.1 | blastp |
| 1180 | LYM137 H100 | kiwi\|gb166\|FG421995 | 2687 | 321 | 84.2 | blastp |
| 1181 | LYM137 H101 | kiwi\|gb166\|FG429490 | 2688 | 321 | 83.9 | blastp |
| 1182 | LYM137 H102 | kiwi\|gb166\|FG461535 | 2689 | 321 | 84.2 | blastp |
| 1183 | LYM137 H103 | kiwi\|gb166\|FG501757 | 2690 | 321 | 83.6 | blastp |
| 1184 | LYM137 H104 | lettuce\|gb157.2\|CV700088 | 2691 | 321 | 83.8 | blastp |
| 1185 | LYM137 H105 | lettuce\|gb157.2\|DW046053 | 2692 | 321 | 83 | blastp |
| 1186 | LYM137 H106 | lettuce\|gb157.2\|DW049273 | 2693 | 321 | 83.8 | blastp |
| 1187 | LYM137 H107 | lettuce\|gb157.2\|DW077894 | 2694 | 321 | 83.8 | blastp |
| 1188 | LYM137 H108 | lettuce\|gb157.2\|DW080256 | 2695 | 321 | 83.7 | blastp |
| 1189 | LYM137 H109 | lettuce\|gb157.2\|DW080360 | 2696 | 321 | 83.1 | blastp |
| 1190 | LYM137 H110 | lettuce\|gb157.2\|DW112293 | 2697 | 321 | 83.8 | blastp |
| 1191 | LYM137 H111 | lettuce\|gb157.2\|DW145178 | 2698 | 321 | 83.8 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1192 | LYM137H112 | leymus\|gb166\|CD809209 | 2699 | 321 | 98.7 | blastp |
| 1193 | LYM137H246 | liquorice\|gb171\|FS239986 | 2700 | 321 | 83.9 | blastp |
| 1194 | LYM137H113 | liriodendron\|gb166\|CK743367 | 2701 | 321 | 85.3 | blastp |
| 1195 | LYM137H247 | lolium\|09v1\|AU251012 | 2702 | 321 | 97.4 | blastp |
| 1196 | LYM137H248 | lotus\|09v1\|LLBG662285 | 2703 | 321 | 85 | blastp |
| 1197 | LYM137H249 | lotus\|09v1\|LLBI418687 | 2704 | 321 | 83.9 | blastp |
| 1198 | LYM137H250 | lotus\|09v1\|LLGO006921 | 2705 | 321 | 83.7 | blastp |
| 1199 | LYM137H115 | lovegrass\|gb167\|EH183574 | 2706 | 321 | 92.8 | blastp |
| 1200 | LYM137H116 | lovegrass\|gb167\|EH185967 | 2707 | 321 | 90.1 | blastp |
| 1201 | LYM137H251 | maize\|gb170\|AA979822 | 2708 | 321 | 93.4 | blastp |
| 1202 | LYM137H252 | maize\|gb170\|AI612349 | 2709 | 321 | 94.7 | blastp |
| 1203 | LYM137H253 | maize\|gb170\|EY962027 | 2710 | 321 | 82.89 | tblastn |
| 1204 | LYM137H254 | maize\|gb170\|LLBG320994 | 2711 | 321 | 94.1 | blastp |
| 1205 | LYM137H255 | maize\|gb170\|LLDQ245209 | 2712 | 321 | 99.3 | blastp |
| 1206 | LYM137H256 | maize\|gb170\|LLDQ245775 | 2713 | 321 | 81.2 | blastp |
| 1207 | LYM137H257 | maize\|gb170\|T18742 | 2714 | 321 | 93.4 | blastp |
| 1208 | LYM137H258 | medicago\|09v1\|AW208139 | 2715 | 321 | 85.1 | blastp |
| 1209 | LYM137H259 | medicago\|09v1\|AW287975 | 2716 | 321 | 83.6 | blastp |
| 1210 | LYM137H260 | medicago\|09v1\|LLAJ846422 | 2717 | 321 | 82.47 | tblastn |
| 1211 | LYM137H127 | melon\|gb165\|DV632825 | 2718 | 321 | 85 | blastp |
| 1212 | LYM137H128 | melon\|gb165\|DV632919 | 2719 | 321 | 83.7 | blastp |
| 1213 | LYM137H261 | millet\|09v1\|CD725778 | 2720 | 321 | 94.7 | blastp |
| 1214 | LYM137H262 | millet\|09v1\|EVO454PM001999 | 2721 | 321 | 91.4 | blastp |
| 1215 | LYM137H263 | monkeyflower\|09v1\|DV211090 | 2722 | 321 | 81.3 | blastp |
| 1216 | LYM137H264 | monkeyflower\|09v1\|GO948368 | 2723 | 321 | 81.3 | blastp |
| 1217 | LYM137H129 | nicotiana benthamiana\|gb162\|ES885186 | 2724 | 321 | 85.7 | blastp |
| 1218 | LYM137H130 | nuphar\|gb166\|FD386160 | 2725 | 321 | 85.8 | blastp |
| 1219 | LYM137H265 | oak\|gb170\|CU656727 | 2726 | 321 | 83.1 | blastp |
| 1220 | LYM137H266 | oak\|gb170\|SRR006307S0003551 | 2727 | 321 | 83.8 | blastp |
| 1221 | LYM137H131 | oat\|gb164\|CN814837 | 2728 | 321 | 98 | blastp |
| 1222 | LYM137H132 | oil palm\|gb166\|CN599457 | 2729 | 321 | 87.2 | blastp |
| 1223 | LYM137H133 | oil palm\|gb166\|EL688664 | 2730 | 321 | 84.5 | blastp |
| 1224 | LYM137H134 | onion\|gb162\|CF451442 | 2731 | 321 | 85.2 | blastp |
| 1225 | LYM137H135 | papaya\|gb165\|EX238983 | 2732 | 321 | 83.1 | blastp |
| 1226 | LYM137H136 | papaya\|gb165\|EX281727 | 2733 | 321 | 84.3 | blastp |
| 1227 | LYM137H267 | peanut\|gb171\|CD038036 | 2734 | 321 | 84.4 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1228 | LYM137 H268 | peanut\|gb171\|CD038042 | 2735 | 321 | 83.2 | blastp |
| 1229 | LYM137 H269 | peanut\|gb171\|EH042912 | 2736 | 321 | 85.1 | blastp |
| 1230 | LYM137 H270 | pea\|09v1\|EX570565 | 2737 | 321 | 83.7 | blastp |
| 1231 | LYM137 H271 | pepper\|gb171\|BM063192 | 2738 | 321 | 83 | blastp |
| 1232 | LYM137 H272 | pepper\|gb171\|CA518436 | 2739 | 321 | 81.8 | blastp |
| 1233 | LYM137 H273 | petunia\|gb171\|CV298826 | 2740 | 321 | 83 | blastp |
| 1234 | LYM137 H274 | petunia\|gb171\|CV299096 | 2741 | 321 | 83.7 | blastp |
| 1235 | LYM137 H275 | petunia\|gb171\|FN007657 | 2742 | 321 | 83.1 | blastp |
| 1236 | LYM137 H276 | poplar\|gb170\|AI161822 | 2743 | 321 | 81.8 | blastp |
| 1237 | LYM137 H277 | poplar\|gb170\|AI164812 | 2744 | 321 | 80.4 | blastp |
| 1238 | LYM137 H278 | poplar\|gb170\|CN517615 | 2745 | 321 | 81.58 | tblastn |
| 1239 | LYM137 H150 | poppy\|gb166\|FE964482 | 2746 | 321 | 82.6 | blastp |
| 1240 | LYM137 H151 | poppy\|gb166\|FE968489 | 2747 | 321 | 83.9 | blastp |
| 1241 | LYM137 H152 | potato\|gb157.2\|BE923747 | 2748 | 321 | 83.7 | blastp |
| 1242 | LYM137 H153 | potato\|gb157.2\|BF459639 | 2749 | 321 | 83.7 | blastp |
| 1243 | LYM137 H155 | potato\|gb157.2\|BI407078 | 2750 | 321 | 82.5 | blastp |
| 1244 | LYM137 H156 | potato\|gb157.2\|BQ046658 | 2751 | 321 | 82.5 | blastp |
| 1245 | LYM137 H157 | prunus\|gb167\|BU048009 | 2752 | 321 | 83.8 | blastp |
| 1246 | LYM137 H158 | prunus\|gb167\|BU572674 | 2753 | 321 | 83.8 | blastp |
| 1247 | LYM137 H159 | pseudoroegneria\|gb167\|FF344271 | 2754 | 321 | 98.7 | blastp |
| 1248 | LYM137 H160 | radish\|gb164\|EV524412 | 2755 | 321 | 82.5 | blastp |
| 1249 | LYM137 H161 | radish\|gb164\|EV526732 | 2756 | 321 | 81.2 | blastp |
| 1250 | LYM137 H162 | radish\|gb164\|EV527806 | 2757 | 321 | 81.2 | blastp |
| 1251 | LYM137 H163 | radish\|gb164\|EV536949 | 2758 | 321 | 81.2 | blastp |
| 1252 | LYM137 H164 | radish\|gb164\|EV539087 | 2759 | 321 | 83.1 | blastp |
| 1253 | LYM137 H165 | radish\|gb164\|EV545248 | 2760 | 321 | 81.2 | blastp |
| 1254 | LYM137 H166 | radish\|gb164\|EV570492 | 2761 | 321 | 81.2 | blastp |
| 1255 | LYM137 H167 | radish\|gb164\|EW724465 | 2762 | 321 | 81.2 | blastp |
| 1256 | LYM137 H168 | radish\|gb164\|EW724737 | 2763 | 321 | 83.1 | blastp |
| 1257 | LYM137 H169 | radish\|gb164\|EW731970 | 2764 | 321 | 81.2 | blastp |
| 1258 | LYM137 H170 | radish\|gb164\|EW732728 | 2765 | 321 | 81.2 | blastp |
| 1259 | LYM137 H171 | radish\|gb164\|EX755641 | 2766 | 321 | 80.4 | blastp |
| 1260 | LYM137 H172 | radish\|gb164\|EX756784 | 2767 | 321 | 83.8 | blastp |
| 1261 | LYM137 H173 | radish\|gb164\|EX757824 | 2768 | 321 | 81.2 | blastp |
| 1262 | LYM137 H279 | rice\|gb170\|OS01G24690 | 2769 | 321 | 92.2 | blastp |
| 1263 | LYM137 H280 | rice\|gb170\|OS04G42270 | 2770 | 321 | 94.1 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1264 | LYM137 H176 | rye\|gb164\|BE493987 | 2771 | 321 | 100 | blastp |
| 1265 | LYM137 H177 | safflower\|gb162\|EL378228 | 2772 | 321 | 82.4 | blastp |
| 1266 | LYM137 H178 | safflower\|gb162\|EL399454 | 2773 | 321 | 83.8 | blastp |
| 1267 | LYM137 H179 | safflower\|gb162\|EL411711 | 2774 | 321 | 81.7 | blastp |
| 1268 | LYM137 H281 | senecio\|gb170\|DY666439 | 2775 | 321 | 83.01 | tblastn |
| 1269 | LYM137 H282 | solanum phureja\|09v1\|SPHAA824956 | 2776 | 321 | 82.5 | blastp |
| 1270 | LYM137 H283 | solanum phureja\|09v1\|SPHBQ115070 | 2777 | 321 | 82.69 | tblastn |
| 1271 | LYM137 H284 | solanum phureja\|09v1\|SPHTOM289A | 2778 | 321 | 83.7 | blastp |
| 1272 | LYM137 H285 | sorghum\|09v1\|SB06G021660 | 2779 | 321 | 94.7 | blastp |
| 1273 | LYM137 H286 | sorghum\|09v1\|SB10G005240 | 2780 | 321 | 94.1 | blastp |
| 1274 | LYM137 H182 | soybean\|gb168\|AL365737 | 2781 | 321 | 85.6 | blastp |
| 1275 | LYM137 H183 | soybean\|gb168\|AW208139 | 2782 | 321 | 84.3 | blastp |
| 1276 | LYM137 H184 | soybean\|gb168\|AW287975 | 2783 | 321 | 85.6 | blastp |
| 1277 | LYM137 H185 | soybean\|gb168\|BE336250 | 2784 | 321 | 81.9 | blastp |
| 1278 | LYM137 H186 | soybean\|gb168\|BE336251 | 2785 | 321 | 84.5 | blastp |
| 1279 | LYM137 H187 | soybean\|gb168\|BI967538 | 2786 | 321 | 85 | blastp |
| 1280 | LYM137 H188 | spurge\|gb161\|BI993574 | 2787 | 321 | 83.8 | blastp |
| 1281 | LYM137 H189 | strawberry\|gb164\|CO378565 | 2788 | 321 | 83.7 | blastp |
| 1282 | LYM137 H190 | strawberry\|gb164\|EX685316 | 2789 | 321 | 82.5 | blastp |
| 1283 | LYM137 H287 | sugarcane\|gb157.3\|AI216927 | 2790 | 321 | 94.7 | blastp |
| 1284 | LYM137 H288 | sugarcane\|gb157.3\|BQ535570 | 2791 | 321 | 92.8 | blastp |
| 1285 | LYM137 H289 | sugarcane\|gb157.3\|BQ535956 | 2792 | 321 | 94.1 | blastp |
| 1286 | LYM137 H290 | sugarcane\|gb157.3\|BQ537453 | 2793 | 321 | 93.4 | blastp |
| 1287 | LYM137 H291 | sugarcane\|gb157.3\|CA106878 | 2794 | 321 | 94.7 | blastp |
| 1288 | LYM137 H292 | sugarcane\|gb157.3\|CA111839 | 2795 | 321 | 93.4 | blastp |
| 1289 | LYM137 H293 | sugarcane\|gb157.3\|CA113465 | 2796 | 321 | 92.11 | tblastn |
| 1290 | LYM137 H198 | sunflower\|gb162\|CD846067 | 2797 | 321 | 84.3 | blastp |
| 1291 | LYM137 H199 | sunflower\|gb162\|CD848213 | 2798 | 321 | 84.3 | blastp |
| 1292 | LYM137 H200 | sunflower\|gb162\|CD851130 | 2799 | 321 | 85.6 | blastp |
| 1293 | LYM137 H201 | sunflower\|gb162\|CD853875 | 2800 | 321 | 83.8 | blastp |
| 1294 | LYM137 H202 | switchgrass\|gb167\|DN140751 | 2801 | 321 | 92.8 | blastp |
| 1295 | LYM137 H203 | switchgrass\|gb167\|DN143966 | 2802 | 321 | 90.8 | blastp |
| 1296 | LYM137 H204 | switchgrass\|gb167\|FE603312 | 2803 | 321 | 91.4 | blastp |
| 1297 | LYM137 H205 | switchgrass\|gb167\|FE645253 | 2804 | 321 | 92.8 | blastp |
| 1298 | LYM137 H294 | tea\|gb171\|GE652357 | 2805 | 321 | 84.52 | tblastn |
| 1299 | LYM137 H295 | tea\|gb171\|GH613259 | 2806 | 321 | 81.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1300 | LYM137 H206 | thellungiella\|gb167\|DN773656 | 2807 | 321 | 81.2 | blastp |
| 1301 | LYM137 H207 | tobacco\|gb162\|DV157653 | 2808 | 321 | 82.5 | blastp |
| 1302 | LYM137 H208 | tobacco\|gb162\|EB444171 | 2809 | 321 | 85.1 | blastp |
| 1303 | LYM137 H209 | tobacco\|gb162\|EB445443 | 2810 | 321 | 85.6 | blastp |
| 1304 | LYM137 H210 | tobacco\|gb162\|EB679214 | 2811 | 321 | 83.8 | blastp |
| 1305 | LYM137 H211 | tobacco\|gb162\|TOBRPL25A | 2812 | 321 | 85.7 | blastp |
| 1306 | LYM137 H296 | tomato\|09v1\|AA824956 | 2813 | 321 | 81.8 | blastp |
| 1307 | LYM137 H297 | tomato\|09v1\|BQ115070 | 2814 | 321 | 83.8 | blastp |
| 1308 | LYM137 H298 | tomato\|09v1\|TOM289A | 2815 | 321 | 83.7 | blastp |
| 1309 | LYM137 H214 | wheat\|gb164\|BE401860 | 2816 | 321 | 99.3 | blastp |
| 1310 | LYM137 H215 | wheat\|gb164\|BE403516 | 2817 | 321 | 99.3 | blastp |
| 1311 | LYM137 H216 | wheat\|gb164\|BE404488 | 2818 | 321 | 99.3 | blastp |
| 1312 | LYM137 H217 | wheat\|gb164\|CA612898 | 2819 | 321 | 82.89 | tblastn |
| 1313 | LYM137 H299 | zinnia\|gb171\|AU304473 | 2820 | 321 | 83 | blastp |
| 1314 | LYM140 H18 | apple\|gb171\|CN874007 | 2821 | 322 | 80.1 | blastp |
| 1315 | LYM140 H1 | banana\|gb167\|ES433790 | 2822 | 322 | 80 | tblastn |
| 1316 | LYM140 H19 | brachypodium\|09v1\|DV472528 | 2823 | 322 | 90.3 | blastp |
| 1317 | LYM140 H20 | cassava\|09v1\|BM259738 | 2824 | 322 | 80.3 | blastp |
| 1318 | LYM140 H21 | cassava\|09v1\|CK640886 | 2825 | 322 | 80.3 | blastp |
| 1319 | LYM140 H22 | castorbean\|09v1\|EG656528 | 2826 | 322 | 80.4 | blastp |
| 1320 | LYM140 H23 | chestnut\|gb170\|SRR006295S0060343 | 2827 | 322 | 80 | blastp |
| 1321 | LYM140 H24 | chestnut\|gb170\|SRR006296S0039724 | 2828 | 322 | 80.49 | tblastn |
| 1322 | LYM140 H4 | citrus\|gb166\|CB290479 | 2829 | 322 | 80.3 | blastp |
| 1323 | LYM140 H5 | cotton\|gb164\|BF271942 | 2830 | 322 | 81.4 | blastp |
| 1324 | LYM140 H6 | cotton\|gb164\|CA992695 | 2831 | 322 | 80.1 | blastp |
| 1325 | LYM140 H7 | cowpea\|gb166\|FC459791 | 2832 | 322 | 80.48 | tblastn |
| 1326 | LYM140 H25 | maize\|gb170\|AW331287 | 2833 | 322 | 89.2 | blastp |
| 1327 | LYM140 H9 | oil palm\|gb166\|ES414711 | 2834 | 322 | 80.8 | blastp |
| 1328 | LYM140 H10 | papaya\|gb165\|EX227799 | 2835 | 322 | 80 | blastp |
| 1329 | LYM140 H11 | radish\|gb164\|EV528272 | 2836 | 322 | 80.3 | blastp |
| 1330 | LYM140 H26 | rice\|gb170\|OS04G53210 | 2837 | 322 | 88.6 | blastp |
| 1331 | LYM140 H27 | sorghum\|09v1\|SB06G028990 | 2838 | 322 | 88.9 | blastp |
| 1332 | LYM140 H13 | soybean\|gb168\|AW126193 | 2839 | 322 | 80 | blastp |
| 1333 | LYM140 H28 | sugarcane\|gb157.3\|CA071893 | 2840 | 322 | 88.1 | blastp |
| 1334 | LYM140 H15 | sunflower\|gb162\|BU671805 | 2841 | 322 | 80.1 | blastp |
| 1335 | LYM140 H16 | switchgrass\|gb167\|FE624047 | 2842 | 322 | 90.5 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1336 | LYM140 H17 | wheat\|gb164\|BE415726 | 2843 | 322 | 98.1 | blastp |
| 1337 | LYM140 H18 | wheat\|gb164\|BF200613 | 2844 | 322 | 86.7 | blastp |
| 1338 | LYM141 H0 | rice\|gb170\|OS12G02910 | 2845 | 323 | 86.6 | blastp |
| 1339 | LYM142 H7 | barley\|gb157SOLEXA\|BQ761869 | 2846 | 324 | 86.6 | blastp |
| 1340 | LYM142 H8 | brachypodium\|09v1\|DV478753 | 2847 | 324 | 86.8 | blastp |
| 1341 | LYM142 H3 | leymus\|gb166\|EG401596 | 2848 | 324 | 97.7 | blastp |
| 1342 | LYM142 H4 | pseudoroegneria\|gb167\|FF362922 | 2849 | 324 | 97.7 | blastp |
| 1343 | LYM142 H9 | rice\|gb170\|OS02G33550 | 2850 | 324 | 83.9 | blastp |
| 1344 | LYM142 H6 | wheat\|gb164\|BE404843 | 2851 | 324 | 94.4 | blastp |
| 1345 | LYM142 H7 | wheat\|gb164\|CA631467 | 2852 | 324 | 83.9 | blastp |
| 1346 | LYM144 H0 | brachypodium\|09v1\|GT775853 | 2853 | 326 | 80.6 | blastp |
| 1347 | LYM148 H10 | brachypodium\|09v1\|DV478384 | 2854 | 328 | 91.1 | blastp |
| 1348 | LYM148 H2 | leymus\|gb166\|EG398961 | 2855 | 328 | 92.73 | tblastn |
| 1349 | LYM148 H11 | maize\|gb170\|AW060086 | 2856 | 328 | 84.5 | blastp |
| 1350 | LYM148 H12 | millet\|09v1\|EVO454PM023692 | 2857 | 328 | 82.9 | blastp |
| 1351 | LYM148 H13 | rice\|gb170\|OS06G45440 | 2858 | 328 | 82.4 | blastp |
| 1352 | LYM148 H14 | sorghum\|09v1\|SB10G026570 | 2859 | 328 | 83.3 | blastp |
| 1353 | LYM148 H6 | switchgrass\|gb167\|FE604043 | 2860 | 328 | 82.5 | blastp |
| 1354 | LYM148 H7 | switchgrass\|gb167\|FE641627 | 2861 | 328 | 81.1 | blastp |
| 1355 | LYM148 H8 | wheat\|gb164\|BE442896 | 2862 | 328 | 96.3 | blastp |
| 1356 | LYM148 H9 | wheat\|gb164\|BQ295259 | 2863 | 328 | 97 | blastp |
| 1357 | LYM148 H10 | wheat\|gb164\|BQ788641 | 2864 | 328 | 97 | blastp |
| 1358 | LYM149 H5 | brachypodium\|09v1\|DV488199 | 2865 | 329 | 83.2 | blastp |
| 1359 | LYM149 H2 | pseudoroegneria\|gb167\|FF346387 | 2866 | 329 | 87 | blastp |
| 1360 | LYM149 H3 | wheat\|gb164\|BE429052 | 2867 | 329 | 87.2 | blastp |
| 1361 | LYM149 H4 | wheat\|gb164\|BQ620138 | 2868 | 329 | 87.5 | blastp |
| 1362 | LYM149 H5 | wheat\|gb164\|CA641424 | 2869 | 329 | 89.69 | tblastn |
| 1363 | LYM152 H14 | arabidopsis lyrata\|09v1\|BQ834051 | 2870 | 330 | 86.7 | blastp |
| 1364 | LYM152 H15 | arabidopsis lyrata\|09v1\|JGIAL030307 | 2871 | 330 | 96.7 | blastp |
| 1365 | LYM152 H1 | arabidopsis\|gb165\|AT4G25890 | 2872 | 330 | 82.5 | tblastn |
| 1366 | LYM152 H2 | b oleracea\|gb161\|DY027305 | 2873 | 330 | 95 | blastp |
| 1367 | LYM152 H3 | b oleracea\|gb161\|DY028937 | 2874 | 330 | 93.4 | blastp |
| 1368 | LYM152 H4 | b rapa\|gb162\|BG544013 | 2875 | 330 | 94.17 | tblastn |
| 1369 | LYM152 H5 | b rapa\|gb162\|L35776 | 2876 | 330 | 92.6 | blastp |
| 1370 | LYM152 H6 | b rapa\|gb162\|L35823 | 2877 | 330 | 95 | blastp |
| 1371 | LYM152 H7 | canola\|gb161\|CD812096 | 2878 | 330 | 94.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1372 | LYM152 H8 | canola\|gb161\|CD812552 | 2879 | 330 | 95 | blastp |
| 1373 | LYM152 H9 | canola\|gb161\|CD817037 | 2880 | 330 | 95 | blastp |
| 1374 | LYM152 H10 | canola\|gb161\|CD830347 | 2881 | 330 | 92.6 | blastp |
| 1375 | LYM152 H12 | radish\|gb164\|EV548235 | 2882 | 330 | 92.5 | blastp |
| 1376 | LYM152 H13 | radish\|gb164\|EW718196 | 2883 | 330 | 92.5 | blastp |
| 1377 | LYM152 H14 | *thellungiella*\|gb167\|BM985697 | 2884 | 330 | 91.7 | blastp |
| 1378 | LYM153 H6 | barley\|gb157SOLEXA\|BF625242 | 2885 | 331 | 81.5 | blastp |
| 1379 | LYM153 H7 | *brachypodium*\|09v1\|SRR031796S0027091 | 2886 | 331 | 81.5 | blastp |
| 1380 | LYM153 H2 | *cenchrus*\|gb166\|EB654758 | 2887 | 331 | 80 | blastp |
| 1381 | LYM153 H8 | millet\|09v1\|EVO454PM017552 | 2888 | 331 | 83.1 | blastp |
| 1382 | LYM153 H9 | *sorghum*\|09v1\|SB10G003440 | 2889 | 331 | 81.5 | blastp |
| 1383 | LYM153 H4 | switchgrass\|gb167\|FE634744 | 2890 | 331 | 83.1 | blastp |
| 1384 | LYM153 H5 | wheat\|gb164\|CD490951 | 2891 | 331 | 94.03 | tblastn |
| 1385 | LYM153 H6 | wheat\|gb164\|CK215660 | 2892 | 331 | 80.3 | tblastn |
| 1386 | LYM156 H6 | barley\|gb157SOLEXA\|AL506124 | 2893 | 332 | 96.1 | blastp |
| 1387 | LYM156 H7 | barley\|gb157SOLEXA\|BE195142 | 2894 | 332 | 93.1 | blastp |
| 1388 | LYM156 H3 | *pseudoroegneria*\|gb167\|FF346665 | 2895 | 332 | 92.8 | blastp |
| 1389 | LYM156 H4 | *pseudoroegneria*\|gb167\|FF354463 | 2896 | 332 | 86.3 | blastp |
| 1390 | LYM156 H8 | rice\|gb170\|OS07G46830 | 2897 | 332 | 80 | blastp |
| 1391 | LYM156 H6 | wheat\|gb164\|BE637888 | 2898 | 332 | 91.8 | blastp |
| 1392 | LYM157 H1 | barley\|gb157SOLEXA\|BG299283 | 2899 | 333 | 94.9 | blastp |
| 1393 | LYM159 H1 | wheat\|gb164\|CA598148 | 2900 | 334 | 81.01 | tblastn |
| 1394 | LYM159 H2 | wheat\|gb164\|CD866037 | 2901 | 334 | 87.7 | blastp |
| 1395 | LYM159 H3 | wheat\|gb164\|CD867356 | 2902 | 334 | 86.4 | blastp |
| 1396 | LYM160 H1 | wheat\|gb164\|BE399997 | 2903 | 335 | 87.6 | tblastn |
| 1397 | LYM160 H2 | wheat\|gb164\|BE500200 | 2904 | 335 | 80 | blastp |
| 1398 | LYM161 H0 | *brachypodium*\|09v1\|DV471902 | 2905 | 336 | 81.9 | blastp |
| 1398 | LYM161 H0 | *brachypodium*\|09v1\|DV471902 | 2905 | 444 | 81.02 | tblastn |
| 1399 | LYM162 H5 | maize\|gb170\|AW331105 | 2906 | 337 | 84.8 | blastp |
| 1400 | LYM162 H6 | millet\|09v1\|EVO454PM026751 | 2907 | 337 | 85.7 | blastp |
| 1401 | LYM162 H7 | *sorghum*\|09v1\|SB03G043995 | 2908 | 337 | 87.5 | blastp |
| 1402 | LYM162 H8 | sugarcane\|gb157.3\|BQ536349 | 2909 | 337 | 87.5 | blastp |
| 1403 | LYM162 H4 | switchgrass\|gb167\|FL738992 | 2910 | 337 | 83.9 | blastp |
| 1404 | LYM162 H5 | switchgrass\|gb167\|FL829126 | 2911 | 337 | 85.7 | blastp |
| 1405 | LYM165 H5 | maize\|gb170\|LLCO452769 | 2912 | 339 | 99.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1406 | LYM165 H6 | sorghum|09v1|SB03G030690 | 2913 | 339 | 89.2 | blastp |
| 1407 | LYM165 H7 | sugarcane|gb157.3|BQ529806 | 2914 | 339 | 81.1 | blastp |
| 1408 | LYM165 H8 | sugarcane|gb157.3|CA084294 | 2915 | 339 | 90.4 | blastp |
| 1409 | LYM165 H4 | switchgrass|gb167|DN143471 | 2916 | 339 | 85.9 | blastp |
| 1410 | LYM165 H5 | switchgrass|gb167|DN144101 | 2917 | 339 | 85.7 | blastp |
| 1411 | LYM166 H1 | brachypodium|09v1|DV486893 | 2918 | 340 | 85.4 | tblastn |
| 1411 | LYM166 H1 | brachypodium|09v1|DV486893 | 2918 | 445 | 85.36 | tblastn |
| 1412 | LYM170 H7 | barley|gb157SOLEXA|AV915706 | 2919 | 341 | 91.6 | blastp |
| 1413 | LYM170 H8 | brachypodium|09v1|SRR031797S0049196 | 2920 | 341 | 94.8 | blastp |
| 1414 | LYM170 H9 | maize|gb170|AI665902 | 2921 | 341 | 87.3 | blastp |
| 1415 | LYM170 H10 | maize|gb170|BE050628 | 2922 | 341 | 86.4 | blastp |
| 1416 | LYM170 H11 | sorghum|09v1|SB03G036440 | 2923 | 341 | 87.3 | blastp |
| 1417 | LYM170 H12 | sugarcane|gb157.3|CA067017 | 2924 | 341 | 88.3 | blastp |
| 1418 | LYM170 H6 | switchgrass|gb167|DN142710 | 2925 | 341 | 87.3 | blastp |
| 1419 | LYM170 H7 | wheat|gb164|BE415371 | 2926 | 341 | 93.5 | blastp |
| 1420 | LYM172 H11 | brachypodium|09v1|DV489358 | 2927 | 342 | 87.6 | blastp |
| 1421 | LYM172 H12 | maize|gb170|AA979770 | 2928 | 342 | 81.7 | blastp |
| 1422 | LYM172 H13 | maize|gb170|AI711966 | 2929 | 342 | 81.2 | blastp |
| 1423 | LYM172 H14 | maize|gb170|AI947521 | 2930 | 342 | 80.71 | tblastn |
| 1424 | LYM172 H15 | maize|gb170|AW120145 | 2931 | 342 | 82.9 | blastp |
| 1425 | LYM172 H16 | millet|09v1|EVO454PM002481 | 2932 | 342 | 85.6 | tblastn |
| 1426 | LYM172 H17 | rice|gb170|OS02G08364 | 2933 | 342 | 81.8 | blastp |
| 1427 | LYM172 H18 | sorghum|09v1|SB04G005430 | 2934 | 342 | 80.43 | tblastn |
| 1428 | LYM172 H19 | sorghum|09v1|SB10G025800 | 2935 | 342 | 83.9 | blastp |
| 1429 | LYM172 H20 | sugarcane|gb157.3|CA071007 | 2936 | 342 | 80.1 | blastp |
| 1430 | LYM172 H9 | switchgrass|gb167|FL692588 | 2937 | 342 | 80.7 | blastp |
| 1431 | LYM172 H10 | wheat|gb164|BE400761 | 2938 | 342 | 81.25 | tblastn |
| 1432 | LYM172 H11 | wheat|gb164|BE498868 | 2939 | 342 | 87.77 | tblastn |
| 1433 | LYM213 H1 | switchgrass|gb167|FE620008 | 2940 | 343 | 80.4 | blastp |
| 1433 | LYM213 H1 | switchgrass|gb167|FE620008 | 2940 | 386 | 88.7 | blastp |
| 1434 | LYM174 H3 | maize|gb170|AW144917 | 2941 | 344 | 89.4 | blastp |
| 1435 | LYM174 H4 | maize|gb170|AW267379 | 2942 | 344 | 86.6 | blastp |
| 1436 | LYM174 H5 | sugarcane|gb157.3|CA089309 | 2943 | 344 | 92.31 | tblastn |
| 1437 | LYM174 H3 | switchgrass|gb167|DN150662 | 2944 | 344 | 80.9 | blastp |
| 1438 | LYM175 H0 | maize|gb170|AW498464 | 2945 | 345 | 81.2 | blastp |
| 1439 | LYM175 H1 | rice|gb170|OS01G69090 | 2946 | 345 | 95 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1439 | LYM175 H1 | rice\|gb170\|OS01G69090 | 2946 | 446 | 100 | blastp |
| 1440 | LYM215 H2 | sorghum\|09v1\|SB03G043980 | 2947 | 345 | 81.2 | blastp |
| 1440 | LYM215 H2 | sorghum\|09v1\|SB03G043980 | 2947 | 387 | 94.6 | blastp |
| 1441 | LYM176 H2 | maize\|gb170\|CA452713 | 2948 | 346 | 82.2 | blastp |
| 1442 | LYM176 H3 | sorghum\|09v1\|SB03G036470 | 2949 | 346 | 83 | blastp |
| 1443 | LYM176 H2 | switchgrass\|gb167\|FE606366 | 2950 | 346 | 82 | blastp |
| 1444 | LYM178 H9 | brachypodium\|09v1\|DV472161 | 2951 | 347 | 84.9 | blastp |
| 1445 | LYM178 H10 | brachypodium\|09v1\|SRR031797S0177787 | 2952 | 347 | 84.6 | blastp |
| 1446 | LYM178 H1 | fescue\|gb161\|DT674427 | 2953 | 347 | 89.4 | blastp |
| 1447 | LYM178 H2 | leymus\|gb166\|EG394591 | 2954 | 347 | 84.08 | tblastn |
| 1448 | LYM178 H11 | maize\|gb170\|W21746 | 2955 | 347 | 83.4 | blastp |
| 1449 | LYM178 H12 | millet\|09v1\|EVO454PM001531 | 2956 | 347 | 83.1 | blastp |
| 1450 | LYM178 H3 | pseudoroegneria\|gb167\|FF358503 | 2957 | 347 | 93.6 | blastp |
| 1451 | LYM178 H13 | sorghum\|09v1\|SB03G008890 | 2958 | 347 | 83.1 | blastp |
| 1452 | LYM178 H14 | sorghum\|09v1\|SB07G001060 | 2959 | 347 | 81.9 | blastp |
| 1453 | LYM178 H15 | sugarcane\|gb157.3\|CA066169 | 2960 | 347 | 82.4 | blastp |
| 1454 | LYM178 H16 | sugarcane\|gb157.3\|CA079726 | 2961 | 347 | 83.1 | blastp |
| 1455 | LYM178 H8 | switchgrass\|gb167\|FE636508 | 2962 | 347 | 82.4 | blastp |
| 1456 | LYM178 H9 | wheat\|gb164\|BQ620752 | 2963 | 347 | 94.7 | blastp |
| 1457 | LYM179 H0 | sorghum\|09v1\|SB08G006470 | 2964 | 348 | 86.5 | blastp |
| 1458 | LYM107 H2 | brachypodium\|09v1\|GT808738 | 2965 | 349 | 86.9 | blastp |
| 1459 | LYM107 H3 | maize\|gb170\|CF075587 | 2966 | 349 | 95.2 | blastp |
| 1460 | LYM107 H4 | rice\|gb170\|OS05G26660 | 2967 | 349 | 86.4 | blastp |
| 1461 | LYM107 H5 | sorghum\|09v1\|SB03G036480 | 2968 | 349 | 95 | blastp |
| 1462 | LYM109 H1 | maize\|gb170\|BG517163 | 2969 | 350 | 82.62 | tblastn |
| 1462 | LYM109 H1 | maize\|gb170\|BG517163 | 2969 | 447 | 82.6 | tblastn |
| 1463 | LYM109 H2 | sorghum\|09v1\|SB05G003660 | 2970 | 350 | 88.75 | tblastn |
| 1463 | LYM109 H2 | sorghum\|09v1\|SB05G003660 | 2970 | 447 | 88.87 | tblastn |
| 1464 | LYM112 H1 | maize\|gb170\|CF037322 | 2971 | 351 | 95.4 | blastp |
| 1464 | LYM112 H1 | maize\|gb170\|CF037322 | 2971 | 448 | 93.96 | tblastn |
| 1465 | LYM112 H2 | sorghum\|09v1\|SB02G039985 | 2972 | 351 | 92.43 | tblastn |
| 1465 | LYM112 H2 | sorghum\|09v1\|SB02G039985 | 2972 | 448 | 84.8 | blastp |
| 1466 | LYM115 H0 | sorghum\|09v1\|SB01G043900 | 2973 | 353 | 90.19 | tblastn |
| 1467 | LYM116 H3 | sorghum\|09v1\|SB06G031340 | 2974 | 354 | 88.2 | blastp |
| 1468 | LYM116 H2 | switchgrass\|gb167\|FE653493 | 2975 | 354 | 80.88 | tblastn |
| 1469 | LYM116 H3 | switchgrass\|gb167\|FL790906 | 2976 | 354 | 80.88 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1470 | LYM117H2 | maize\|gb170\|GFXAF243041X1 | 2977 | 355 | 84.4 | blastp |
| 1470 | LYM117H2 | maize\|gb170\|GFXAF243041X1 | 2977 | 449 | 84.5 | blastp |
| 1471 | LYM117H3 | sorghum\|09v1\|SB07G027220 | 2978 | 355 | 82.3 | blastp |
| 1471 | LYM117H3 | sorghum\|09v1\|SB07G027220 | 2978 | 449 | 82.3 | blastp |
| 1472 | LYM121H1 | rice\|gb170\|OS12G02620 | 2979 | 357 | 90.6 | blastp |
| 1473 | LYM123H4 | barley\|gb157SOLEXA\|AF268595 | 2980 | 358 | 85.5 | blastp |
| 1474 | LYM123H5 | brachypodium\|09v1\|GT761722 | 2981 | 358 | 84 | blastp |
| 1475 | LYM123H6 | maize\|gb170\|AI795558 | 2982 | 358 | 85.2 | blastp |
| 1476 | LYM123H7 | sorghum\|09v1\|SB06G031680 | 2983 | 358 | 86.3 | blastp |
| 1477 | LYM123H4 | wheat\|gb164\|BE401871 | 2984 | 358 | 85.6 | blastp |
| 1478 | LYM135H1 | brachypodium\|09v1\|DV480514 | 2985 | 359 | 93.1 | blastp |
| 1479 | LYM135H2 | maize\|gb170\|CB885667 | 2986 | 359 | 80.2 | blastp |
| 1480 | LYM135H3 | sorghum\|09v1\|SB10G007850 | 2987 | 359 | 84.1 | blastp |
| 1481 | LYM138H2 | brachypodium\|09v1\|GT810825 | 2988 | 360 | 84 | blastp |
| 1482 | LYM138H3 | maize\|gb170\|AI612333 | 2989 | 360 | 86.17 | tblastn |
| 1483 | LYM138H4 | sorghum\|09v1\|SB06G031570 | 2990 | 360 | 86.33 | tblastn |
| 1484 | LYM146H2 | brachypodium\|09v1\|SRR031798S0143459 | 2991 | 361 | 84.3 | blastp |
| 1485 | LYM146H3 | rice\|gb170\|OS03G21730 | 2992 | 361 | 86.4 | blastp |
| 1486 | LYM146H4 | sorghum\|09v1\|SB01G036160 | 2993 | 361 | 96 | blastp |
| 1487 | LYM147H0 | sorghum\|09v1\|SB03G003200 | 2994 | 362 | 82 | blastp |
| 1488 | LYM154H0 | wheat\|gb164\|BE500571 | 2995 | 363 | 82.5 | blastp |
| 1489 | LYM155H3 | brachypodium\|09v1\|DV479969 | 2996 | 364 | 84.7 | blastp |
| 1489 | LYM155H3 | brachypodium\|09v1\|DV479969 | 2996 | 451 | 83.5 | blastp |
| 1490 | LYM155H4 | rice\|gb170\|OS03G58890 | 2997 | 364 | 81.3 | blastp |
| 1490 | LYM155H4 | rice\|gb170\|OS03G58890 | 2997 | 451 | 80 | blastp |
| 1491 | LYM155H3 | wheat\|gb164\|BQ801019 | 2998 | 364 | 92.3 | blastp |
| 1491 | LYM155H3 | wheat\|gb164\|BQ801019 | 2998 | 451 | 91.6 | blastp |
| 1492 | LYM180H0 | brachypodium\|09v1\|DV473436 | 2999 | 365 | 82.9 | blastp |
| 1492 | LYM180H0 | brachypodium\|09v1\|DV473436 | 2999 | 452 | 83.54 | tblastn |
| 1493 | LYM181H3 | brachypodium\|09v1\|DV485149 | 3000 | 366 | 85.3 | blastp |
| 1493 | LYM181H3 | brachypodium\|09v1\|DV485149 | 3000 | 453 | 84.68 | tblastn |
| 1494 | LYM181H4 | maize\|gb170\|DR452216 | 3001 | 366 | 80.8 | blastp |
| 1494 | LYM181H4 | maize\|gb170\|DR452216 | 3001 | 453 | 81.25 | tblastn |
| 1495 | LYM181H5 | rice\|gb170\|OS07G32010 | 3002 | 366 | 82.8 | blastp |
| 1496 | LYM181H6 | sorghum\|09v1\|SB02G034110 | 3003 | 366 | 83.5 | blastp |
| 1497 | LYM181H2 | wheat\|gb164\|BE425377 | 3004 | 453 | 87.16 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1498 | LYM181 H3 | wheat\|gb164\|BG905028 | 3005 | 453 | 93.58 | tblastn |
| 1499 | LYM182 H8 | *brachypodium*\|09v1\|GT780326 | 3006 | 367 | 87.64 | tblastn |
| 1500 | LYM182 H9 | maize\|gb170\|AI795737 | 3007 | 367 | 84.27 | tblastn |
| 1501 | LYM182 H10 | millet\|09v1\|EVO454PM084568 | 3008 | 367 | 82.02 | tblastn |
| 1502 | LYM182 H11 | rice\|gb170\|OS04G33300 | 3009 | 367 | 82.02 | tblastn |
| 1503 | LYM182 H12 | *sorghum*\|09v1\|SB06G015280 | 3010 | 367 | 83.15 | tblastn |
| 1504 | LYM182 H13 | sugarcane\|gb157.3\|CA066047 | 3011 | 367 | 83.15 | tblastn |
| 1505 | LYM182 H6 | switchgrass\|gb167\|FE610729 | 3012 | 367 | 82.02 | tblastn |
| 1506 | LYM182 H7 | switchgrass\|gb167\|FL699214 | 3013 | 367 | 83.15 | tblastn |
| 1507 | LYM182 H8 | wheat\|gb164\|BF200136 | 3014 | 367 | 95.51 | tblastn |
| 1508 | LYM184 H5 | *brachypodium*\|09v1\|DV476770 | 3015 | 454 | 82.68 | tblastn |
| 1509 | LYM184 H6 | *brachypodium*\|09v1\|GT762544 | 3016 | 454 | 82.61 | tblastn |
| 1510 | LYM184 H7 | *brachypodium*\|09v1\|SRR031799S0153720 | 3017 | 454 | 82.68 | tblastn |
| 1511 | LYM184 H3 | *leymus*\|gb166\|EG385150 | 3018 | 454 | 84.8 | blastp |
| 1512 | LYM184 H8 | maize\|gb170\|AI691210 | 3019 | 382 | 100 | blastp |
| 1512 | LYM184 H8 | maize\|gb170\|AI691210 | 3019 | 454 | 80.87 | tblastn |
| 1513 | LYM206 H2 | *sorghum*\|09v1\|SB07G021090 | 3020 | 382 | 84.5 | blastp |
| 1513 | LYM206 H2 | *sorghum*\|09v1\|SB07G021090 | 3020 | 454 | 80.52 | tblastn |
| 1514 | LYM184 H4 | switchgrass\|gb167\|FL704827 | 3021 | 454 | 80.5 | blastp |
| 1515 | LYM184 H5 | wheat\|gb164\|AL821254 | 3022 | 368 | 82.66 | tblastn |
| 1515 | LYM184 H5 | wheat\|gb164\|AL821254 | 3022 | 454 | 86.96 | tblastn |
| 1516 | LYM185 H1 | *pseudoroegneria*\|gb167\|FF360278 | 3023 | 455 | 91.53 | tblastn |
| 1517 | LYM185 H2 | wheat\|gb164\|BG906077 | 3024 | 455 | 85.31 | tblastn |
| 1518 | LYM186 H4 | *brachypodium*\|09v1\|GT761126 | 3025 | 370 | 90.7 | blastp |
| 1519 | LYM186 H5 | maize\|gb170\|BE552887 | 3026 | 370 | 82.5 | tblastn |
| 1520 | LYM186 H6 | rice\|gb170\|OS10G39930 | 3027 | 370 | 86.3 | blastp |
| 1521 | LYM186 H7 | *sorghum*\|09v1\|SB01G030050 | 3028 | 370 | 86.5 | blastp |
| 1522 | LYM186 H4 | wheat\|gb164\|BE429425 | 3029 | 370 | 97.6 | blastp |
| 1523 | LYM188 H8 | *brachypodium*\|09v1\|DV475481 | 3030 | 371 | 92.4 | blastp |
| 1523 | LYM188 H8 | *brachypodium*\|09v1\|DV475481 | 3030 | 456 | 89.41 | tblastn |
| 1524 | LYM188 H9 | maize\|gb170\|AI622726 | 3031 | 371 | 87.2 | blastp |
| 1524 | LYM188 H9 | maize\|gb170\|AI622726 | 3031 | 456 | 83.47 | tblastn |
| 1525 | LYM188 H10 | maize\|gb170\|AW424865 | 3032 | 371 | 86 | blastp |
| 1525 | LYM188 H10 | maize\|gb170\|AW424865 | 3032 | 456 | 83.9 | tblastn |
| 1526 | LYM188 H11 | millet\|09v1\|EVO454PM011140 | 3033 | 456 | 85.17 | tblastn |
| 1527 | LYM188 H3 | *pseudoroegneria*\|gb167\|FF341644 | 3034 | 456 | 80.5 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1528 | LYM188H12 | rice\|gb170\|OS03G53960 | 3035 | 371 | 88.2 | blastp |
| 1528 | LYM188H12 | rice\|gb170\|OS03G53960 | 3035 | 456 | 84.75 | tblastn |
| 1529 | LYM188H13 | sorghum\|09v1\|SB01G007950 | 3036 | 371 | 87.4 | blastp |
| 1529 | LYM188H13 | sorghum\|09v1\|SB01G007950 | 3036 | 456 | 84.32 | tblastn |
| 1530 | LYM188H14 | sugarcane\|gb157.3\|BQ530106 | 3037 | 371 | 87.4 | blastp |
| 1530 | LYM188H14 | sugarcane\|gb157.3\|BQ530106 | 3037 | 456 | 84.32 | tblastn |
| 1531 | LYM188H7 | switchgrass\|gb167\|FL709807 | 3038 | 456 | 84.32 | tblastn |
| 1532 | LYM188H8 | wheat\|gb164\|CA742940 | 3039 | 456 | 81.78 | tblastn |
| 1533 | LYM193H1 | leymus\|gb166\|EG381914 | 3040 | 459 | 87.1 | tblastn |
| 1534 | LYM193H2 | wheat\|gb164\|BQ236678 | 3041 | 459 | 85.26 | tblastn |
| 1535 | LYM194H0 | brachypodium\|09v1\|SRR031796S0004815 | 3042 | 375 | 84.8 | blastp |
| 1536 | LYM194H1 | maize\|gb170\|BQ539102 | 3043 | 375 | 82.1 | blastp |
| 1537 | LYM194H2 | sorghum\|09v1\|SB06G015320 | 3044 | 375 | 84.9 | blastp |
| 1538 | LYM194H3 | switchgrass\|gb167\|FE645079 | 3045 | 375 | 82.9 | blastp |
| 1539 | LYM194H4 | wheat\|gb164\|BE518078 | 3046 | 375 | 96.3 | blastp |
| 1540 | LYM197H2 | sugarcane\|gb157.3\|BQ536804 | 3047 | 377 | 88.57 | tblastn |
| 1541 | LYM198H1 | sorghum\|09v1\|SB01G045460 | 3048 | 378 | 85.5 | blastp |
| 1542 | LYM201H1 | aquilegia\|gb157.3\|DR915888 | 3049 | 379 | 82.4 | blastp |
| 1543 | LYM201H19 | arabidopsis lyrata\|09v1\|JGIAL022871 | 3050 | 379 | 80.07 | tblastn |
| 1544 | LYM201H2 | artemisia\|gb164\|EY033288 | 3051 | 379 | 80.5 | blastp |
| 1545 | LYM201H3 | brapa\|gb162\|CV433700 | 3052 | 379 | 80.3 | blastp |
| 1546 | LYM201H20 | brachypodium\|09v1\|DV471345 | 3053 | 379 | 93.8 | blastp |
| 1547 | LYM201H21 | brachypodium\|09v1\|GT759255 | 3054 | 379 | 81.2 | blastp |
| 1548 | LYM201H22 | cassava\|09v1\|DQ138370 | 3055 | 379 | 82.2 | blastp |
| 1549 | LYM201H23 | cassava\|09v1\|FF380539 | 3056 | 379 | 81.3 | blastp |
| 1550 | LYM201H24 | castorbean\|09v1\|EE256048 | 3057 | 379 | 81.4 | blastp |
| 1551 | LYM201H25 | chestnut\|gb170\|SRR006295S0006313 | 3058 | 379 | 80.6 | blastp |
| 1552 | LYM201H7 | cotton\|gb164\|AI728378 | 3059 | 379 | 81.7 | blastp |
| 1553 | LYM201H8 | cotton\|gb164\|CO070970 | 3060 | 379 | 82 | blastp |
| 1554 | LYM201H26 | cucumber\|09v1\|AM731598 | 3061 | 379 | 81.7 | blastp |
| 1555 | LYM201H27 | lotus\|09v1\|BI419437 | 3062 | 379 | 80.5 | blastp |
| 1556 | LYM201H28 | maize\|gb170\|AI978254 | 3063 | 379 | 98.2 | blastp |
| 1557 | LYM201H29 | maize\|gb170\|DR971118 | 3064 | 379 | 80.1 | blastp |
| 1558 | LYM201H30 | medicago\|09v1\|AW684099 | 3065 | 379 | 80.7 | blastp |
| 1559 | LYM201H31 | oak\|gb170\|CU656181 | 3066 | 379 | 82.56 | tblastn |
| 1560 | LYM201H32 | poplar\|gb170\|BI069637 | 3067 | 379 | 81.3 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1561 | LYM201 H33 | poplar\|gb170\|BU887151 | 3068 | 379 | 80.7 | blastp |
| 1562 | LYM201 H34 | rice\|gb170\|OS02G34560 | 3069 | 379 | 95.2 | blastp |
| 1563 | LYM201 H35 | *solanum phureja*\|09v1\|SPHBG123984 | 3070 | 379 | 81.4 | blastp |
| 1564 | LYM201 H36 | *solanum phureja*\|09v1\|SPHBG129477 | 3071 | 379 | 81.2 | blastp |
| 1565 | LYM201 H37 | *sorghum*\|09v1\|SB04G022350 | 3072 | 379 | 98.4 | blastp |
| 1566 | LYM201 H15 | soybean\|gb168\|AL367670 | 3073 | 379 | 80.7 | blastp |
| 1567 | LYM201 H16 | soybean\|gb168\|AW684099 | 3074 | 379 | 80.5 | blastp |
| 1568 | LYM201 H38 | sugarcane\|gb157.3\|CA065291 | 3075 | 379 | 98.6 | blastp |
| 1569 | LYM201 H18 | switchgrass\|gb167\|FE641755 | 3076 | 379 | 98.2 | blastp |
| 1570 | LYM201 H39 | tomato\|09v1\|BG123984 | 3077 | 379 | 81.4 | blastp |
| 1571 | LYM201 H40 | tomato\|09v1\|BG129477 | 3078 | 379 | 81.2 | blastp |
| 1572 | LYM201 H19 | wheat\|gb164\|BE403168 | 3079 | 379 | 93.2 | blastp |
| 1573 | LYM203 H9 | barley\|gb157SOLEXA\|BI949918 | 3080 | 380 | 84.7 | blastp |
| 1574 | LYM203 H10 | *lolium*\|09v1\|AU247009 | 3081 | 380 | 85.2 | blastp |
| 1575 | LYM203 H11 | maize\|gb170\|AI629675 | 3082 | 380 | 95.7 | blastp |
| 1576 | LYM203 H12 | millet\|09v1\|EVO454PM058394 | 3083 | 380 | 81.7 | blastp |
| 1577 | LYM203 H13 | rice\|gb170\|OS02G08380 | 3084 | 380 | 89.2 | blastp |
| 1578 | LYM203 H14 | *sorghum*\|09v1\|SB04G005460 | 3085 | 380 | 96.8 | blastp |
| 1579 | LYM203 H15 | sugarcane\|gb157.3\|CA119568 | 3086 | 380 | 94.1 | blastp |
| 1580 | LYM203 H6 | switchgrass\|gb167\|DN142920 | 3087 | 380 | 95.2 | blastp |
| 1581 | LYM203 H7 | switchgrass\|gb167\|FE617741 | 3088 | 380 | 95.7 | blastp |
| 1582 | LYM203 H8 | wheat\|gb164\|BQ801966 | 3089 | 380 | 85.7 | blastp |
| 1583 | LYM203 H9 | wheat\|gb164\|BQ903230 | 3090 | 380 | 86.2 | blastp |
| 1584 | LYM206 H3 | maize\|gb170\|AW055997 | 3091 | 382 | 84.1 | blastp |
| 1585 | LYM207 H2 | maize\|gb170\|BM340289 | 3092 | 383 | 86.5 | blastp |
| 1586 | LYM207 H3 | *sorghum*\|09v1\|SB06G023870 | 3093 | 383 | 94.3 | blastp |
| 1587 | LYM207 H2 | switchgrass\|gb167\|FE601320 | 3094 | 383 | 82.3 | blastp |
| 1588 | LYM208 H6 | maize\|gb170\|AI691368 | 3095 | 384 | 94.4 | blastp |
| 1589 | LYM208 H7 | rice\|gb170\|OS09G01690 | 3096 | 384 | 82 | blastp |
| 1590 | LYM208 H8 | *sorghum*\|09v1\|SB01G032070 | 3097 | 384 | 92.1 | blastp |
| 1591 | LYM208 H9 | *sorghum*\|09v1\|SB08G002510 | 3098 | 384 | 86.6 | blastp |
| 1592 | LYM208 H5 | switchgrass\|gb167\|FE612629 | 3099 | 384 | 90.4 | blastp |
| 1593 | LYM208 H6 | switchgrass\|gb167\|FL729765 | 3100 | 384 | 90.4 | blastp |
| 1594 | LYM212 H6 | barley\|gb157SOLEXA\|BF623682 | 3101 | 385 | 80.3 | blastp |
| 1595 | LYM212 H7 | maize\|gb170\|AI677474 | 3102 | 385 | 88.5 | blastp |
| 1596 | LYM212 H8 | rice\|gb170\|OS03G07910 | 3103 | 385 | 80.11 | tblastn |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1597 | LYM212 H9 | sorghum|09v1|SB01G045480 | 3104 | 385 | 92.5 | blastp |
| 1598 | LYM212 H10 | sugarcane|gb157.3|CA088789 | 3105 | 385 | 92 | blastp |
| 1599 | LYM212 H6 | wheat|gb164|BE402242 | 3106 | 385 | 80.38 | tblastn |
| 1600 | LYM213 H1 | maize|gb170|AW282249 | 3107 | 386 | 90.9 | blastp |
| 1601 | LYM213 H2 | sorghum|09v1|SB06G018770 | 3108 | 386 | 91.7 | blastp |
| 1602 | LYM215 H2 | switchgrass|gb167|FE618086 | 3109 | 387 | 90.42 | tblastn |
| 1603 | LYM217 H3 | sorghum|09v1|SB01G043910 | 3110 | 388 | 88.2 | blastp |
| 1604 | LYM217 H4 | sugarcane|gb157.3|CA136491 | 3111 | 388 | 87.7 | blastp |
| 1605 | LYM217 H3 | switchgrass|gb167|FE606442 | 3112 | 388 | 86.7 | blastp |
| 1606 | LYM221 H1 | brachypodium|09v1|GT792319 | 3113 | 391 | 83.8 | blastp |
| 1606 | LYM221 H1 | brachypodium|09v1|GT792319 | 3113 | 461 | 81.3 | blastp |
| 1607 | LYM221 H2 | rice|gb170|OS03G24870 | 3114 | 391 | 82.9 | blastp |
| 1607 | LYM221 H2 | rice|gb170|OS03G24870 | 3114 | 461 | 80.5 | blastp |
| 1608 | LYM221 H3 | sorghum|09v1|SB01G034610 | 3115 | 391 | 90.7 | blastp |
| 1608 | LYM221 H3 | sorghum|09v1|SB01G034610 | 3115 | 461 | 88.7 | blastp |
| 1609 | LYM224 H2 | brachypodium|09v1|GT762108 | 3116 | 393 | 82.4 | blastp |
| 1610 | LYM224 H3 | sorghum|09v1|SB02G040000 | 3117 | 393 | 92.9 | blastp |
| 1611 | LYM224 H2 | switchgrass|gb167|FE617506 | 3118 | 393 | 83.19 | tblastn |
| 1612 | LYM227 H1 | sorghum|09v1|SB01G043140 | 3119 | 394 | 88.3 | blastp |
| 1613 | LYM228 H1 | sorghum|09v1|SB09G006910 | 3120 | 395 | 85 | blastp |
| 1613 | LYM228 H1 | sorghum|09v1|SB09G006910 | 3120 | 462 | 83.7 | blastp |
| 1614 | LYM232 H3 | sorghum|09v1|SB02G000450 | 3121 | 396 | 80.4 | blastp |
| 1615 | LYM232 H4 | sugarcane|gb157.3|CA073189 | 3122 | 396 | 80.8 | blastp |
| 1616 | LYM232 H3 | switchgrass|gb167|FL849399 | 3123 | 396 | 80.7 | blastp |
| 1617 | LYM233 H0 | brachypodium|09v1|TMPLOS01G70020T1 | 3124 | 397 | 99.6 | blastp |
| 1618 | LYM234 H0 | rice|gb170|OS07G38290 | 3125 | 398 | 81.3 | blastp |
| 1619 | LYM236 H99 | apple|gb171|CN488568 | 3126 | 399 | 89.1 | blastp |
| 1620 | LYM236 H100 | apple|gb171|CN883100 | 3127 | 399 | 89.6 | blastp |
| 1621 | LYM236 H3 | aquilegia|gb157.3|DR919774 | 3128 | 399 | 87.4 | blastp |
| 1622 | LYM236 H101 | arabidopsis lyrata|09v1|JGIAL005113 | 3129 | 399 | 83.9 | blastp |
| 1623 | LYM236 H102 | arabidopsis lyrata|09v1|JGIAL006646 | 3130 | 399 | 86.89 | tblastn |
| 1624 | LYM236 H4 | arabidopsis|gb165|AT1G54340 | 3131 | 399 | 83.5 | blastp |
| 1625 | LYM236 H5 | arabidopsis|gb165|AT1G65930 | 3132 | 399 | 87.1 | blastp |
| 1626 | LYM236 H6 | artemisia|gb164|EY034635 | 3133 | 399 | 87.9 | blastp |
| 1627 | LYM236 H7 | avocado|gb164|CO995120 | 3134 | 399 | 91.3 | blastp |
| 1628 | LYM236 H8 | b oleracea|gb161|DY028218 | 3135 | 399 | 87.2 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1629 | LYM236H9 | b rapa\|gb162\|CX269094 | 3136 | 399 | 87.2 | blastp |
| 1630 | LYM236H10 | b rapa\|gb162\|GFXAF258246X1 | 3137 | 399 | 84.3 | tblastn |
| 1631 | LYM236H11 | b rapa\|gb162\|L47856 | 3138 | 399 | 87.2 | blastp |
| 1632 | LYM236H103 | barley\|gb157SOLEXA\|AL502504 | 3139 | 399 | 89.3 | blastp |
| 1633 | LYM236H13 | basilicum\|gb157.3\|DY322368 | 3140 | 399 | 87.7 | blastp |
| 1634 | LYM236H14 | bean\|gb167\|CA896841 | 3141 | 399 | 87.9 | blastp |
| 1635 | LYM236H104 | brachypodium\|09v1\|DV478973 | 3142 | 399 | 85.3 | blastp |
| 1636 | LYM236H105 | brachypodium\|09v1\|DV482439 | 3143 | 399 | 90.5 | blastp |
| 1637 | LYM236H17 | cacao\|gb167\|DQ448875 | 3144 | 399 | 89.2 | blastp |
| 1638 | LYM236H18 | canola\|gb161\|BQ704958 | 3145 | 399 | 87.2 | blastp |
| 1639 | LYM236H19 | canola\|gb161\|CD817340 | 3146 | 399 | 87.2 | blastp |
| 1640 | LYM236H20 | canola\|gb161\|CD833108 | 3147 | 399 | 83.9 | blastp |
| 1641 | LYM236H21 | canola\|gb161\|CX189442 | 3148 | 399 | 86.5 | blastp |
| 1642 | LYM236H22 | canola\|gb161\|DY011390 | 3149 | 399 | 87.2 | blastp |
| 1643 | LYM236H106 | cassava\|09v1\|CK642610 | 3150 | 399 | 90.1 | blastp |
| 1644 | LYM236H107 | cassava\|09v1\|DV457942 | 3151 | 399 | 87.5 | blastp |
| 1645 | LYM236H108 | castorbean\|09v1\|EE256632 | 3152 | 399 | 86.1 | blastp |
| 1646 | LYM236H109 | castorbean\|09v1\|EE259479 | 3153 | 399 | 90.6 | blastp |
| 1647 | LYM236H26 | centaurea\|gb166\|EH731203 | 3154 | 399 | 81.2 | blastp |
| 1648 | LYM236H27 | centaurea\|gb166\|EL932337 | 3155 | 399 | 86.6 | blastp |
| 1649 | LYM236H110 | chestnut\|gb170\|SRR006295S0002580 | 3156 | 399 | 82.27 | tblastn |
| 1650 | LYM236H111 | chestnut\|gb170\|SRR006295S0002701 | 3157 | 399 | 89.6 | blastp |
| 1651 | LYM236H112 | cichorium\|gb171\|EH675189 | 3158 | 399 | 87.3 | blastp |
| 1652 | LYM236H113 | cichorium\|gb171\|EH683726 | 3159 | 399 | 89.1 | blastp |
| 1653 | LYM236H30 | citrus\|gb166\|AF176669 | 3160 | 399 | 90.6 | blastp |
| 1654 | LYM236H31 | citrus\|gb166\|CD573911 | 3161 | 399 | 85.1 | blastp |
| 1655 | LYM236H32 | coffea\|gb157.2\|DV663279 | 3162 | 399 | 87.8 | blastp |
| 1656 | LYM236H33 | cotton\|gb164\|AI727260 | 3163 | 399 | 87.2 | blastp |
| 1657 | LYM236H34 | cotton\|gb164\|BF278588 | 3164 | 399 | 83.5 | blastp |
| 1658 | LYM236H35 | cowpea\|gb166\|FC458136 | 3165 | 399 | 89.1 | blastp |
| 1659 | LYM236H36 | cynara\|gb167\|GE577243 | 3166 | 399 | 86.47 | tblastn |
| 1660 | LYM236H37 | cynara\|gb167\|GE579663 | 3167 | 399 | 88.6 | blastp |
| 1661 | LYM236H38 | dandelion\|gb161\|DY804243 | 3168 | 399 | 86.96 | tblastn |
| 1662 | LYM236H39 | eucalyptus\|gb166\|X97063 | 3169 | 399 | 88 | blastp |
| 1663 | LYM236H40 | fescue\|gb161\|CK801045 | 3170 | 399 | 89.8 | blastp |
| 1664 | LYM236H41 | fescue\|gb161\|DT674724 | 3171 | 399 | 90 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1665 | LYM236H42 | ginger\|gb164\|DY360289 | 3172 | 399 | 91.3 | blastp |
| 1666 | LYM236H43 | grape\|gb160\|BM436755 | 3173 | 399 | 89.9 | blastp |
| 1667 | LYM236H44 | kiwi\|gb166\|FG396670 | 3174 | 399 | 88.2 | blastp |
| 1668 | LYM236H45 | kiwi\|gb166\|FG397107 | 3175 | 399 | 88.7 | blastp |
| 1669 | LYM236H46 | kiwi\|gb166\|FG397291 | 3176 | 399 | 89.4 | blastp |
| 1670 | LYM236H47 | lettuce\|gb157.2\|DW088948 | 3177 | 399 | 87.4 | blastp |
| 1671 | LYM236H48 | leymus\|gb166\|CD809160 | 3178 | 399 | 89.6 | blastp |
| 1672 | LYM236H49 | liriodendron\|gb166\|CK762229 | 3179 | 399 | 88.2 | blastp |
| 1673 | LYM236H114 | lotus\|09v1\|AW428686 | 3180 | 399 | 89.4 | blastp |
| 1674 | LYM236H115 | lotus\|09v1\|BP033879 | 3181 | 399 | 83.7 | blastp |
| 1675 | LYM236H51 | lovegrass\|gb167\|DN480596 | 3182 | 399 | 90.8 | blastp |
| 1676 | LYM236H116 | maize\|gb170\|AI600815 | 3183 | 399 | 93.7 | blastp |
| 1677 | LYM236H117 | maize\|gb170\|AW313297 | 3184 | 399 | 92.2 | blastp |
| 1678 | LYM236H118 | maize\|gb170\|W21690 | 3185 | 399 | 91.3 | blastp |
| 1679 | LYM236H119 | medicago\|09v1\|AW191201 | 3186 | 399 | 88.2 | blastp |
| 1680 | LYM236H120 | medicago\|09v1\|AW689032 | 3187 | 399 | 84.9 | blastp |
| 1681 | LYM236H121 | millet\|09v1\|CD725798 | 3188 | 399 | 92.5 | blastp |
| 1682 | LYM236H122 | millet\|09v1\|EVO454PM002708 | 3189 | 399 | 94.2 | blastp |
| 1683 | LYM236H123 | monkeyflower\|09v1\|DV206036 | 3190 | 399 | 87.4 | blastp |
| 1684 | LYM236H56 | nicotiana benthamiana\|gb162\|CK291144 | 3191 | 399 | 86.5 | blastp |
| 1685 | LYM236H57 | oil palm\|gb166\|EL684429 | 3192 | 399 | 87.3 | blastp |
| 1686 | LYM236H124 | peanut\|gb171\|CD038682 | 3193 | 399 | 87.9 | blastp |
| 1687 | LYM236H125 | pea\|09v1\|CD860585 | 3194 | 399 | 89.6 | blastp |
| 1688 | LYM236H126 | pepper\|gb171\|BM061761 | 3195 | 399 | 88 | blastp |
| 1689 | LYM236H127 | pepper\|gb171\|CA516582 | 3196 | 399 | 85.3 | blastp |
| 1690 | LYM236H128 | petunia\|gb171\|DC240208 | 3197 | 399 | 88.2 | blastp |
| 1691 | LYM236H129 | physcomitrella\|10v1\|AW497149 | 3198 | 399 | 82.2 | blastp |
| 1692 | LYM236H62 | pine\|gb157.2\|AW010292 | 3199 | 399 | 85.6 | blastp |
| 1693 | LYM236H63 | pine\|gb157.2\|BX249826 | 3200 | 399 | 85.6 | blastp |
| 1694 | LYM236H130 | poplar\|gb170\|AI161956 | 3201 | 399 | 89.6 | blastp |
| 1695 | LYM236H131 | poplar\|gb170\|BI127706 | 3202 | 399 | 86.6 | blastp |
| 1696 | LYM236H132 | poplar\|gb170\|BI131610 | 3203 | 399 | 86.8 | blastp |
| 1697 | LYM236H133 | poplar\|gb170\|BU821063 | 3204 | 399 | 90.4 | blastp |
| 1698 | LYM236H66 | potato\|gb157.2\|BG591093 | 3205 | 399 | 88 | blastp |
| 1699 | LYM236H67 | prunus\|gb167\|AF367443 | 3206 | 399 | 89.4 | blastp |
| 1700 | LYM236H68 | radish\|gb164\|EV526847 | 3207 | 399 | 85.8 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1701 | LYM236 H69 | radish\|gb164\|EV531225 | 3208 | 399 | 86.9 | blastp |
| 1702 | LYM236 H134 | rice\|gb170\|OS01G14580 | 3209 | 399 | 84.8 | blastp |
| 1703 | LYM236 H135 | rice\|gb170\|OS01G46610 | 3210 | 399 | 93 | blastp |
| 1704 | LYM236 H72 | rye\|gb164\|BE494776 | 3211 | 399 | 86.17 | tblastn |
| 1705 | LYM236 H73 | safflower\|gb162\|EL372795 | 3212 | 399 | 87.3 | blastp |
| 1706 | LYM236 H74 | safflower\|gb162\|EL374725 | 3213 | 399 | 89.1 | blastp |
| 1707 | LYM236 H136 | *solanum phureja*\|09v1\|SPHBG131802 | 3214 | 399 | 86.3 | blastp |
| 1708 | LYM236 H137 | *solanum phureja*\|09v1\|SPHBG629432 | 3215 | 399 | 87.7 | blastp |
| 1709 | LYM236 H138 | *sorghum*\|09v1\|SB03G029840 | 3216 | 399 | 92 | blastp |
| 1710 | LYM236 H139 | *sorghum*\|09v1\|SB09G029110 | 3217 | 399 | 94.7 | blastp |
| 1711 | LYM236 H77 | soybean\|gb168\|AW257518 | 3218 | 399 | 88.7 | blastp |
| 1712 | LYM236 H78 | soybean\|gb168\|AW689032 | 3219 | 399 | 85.6 | blastp |
| 1713 | LYM236 H79 | soybean\|gb168\|FF554826 | 3220 | 399 | 84.7 | blastp |
| 1714 | LYM236 H80 | soybean\|gb168\|SOYIDH | 3221 | 399 | 89.4 | blastp |
| 1715 | LYM236 H81 | spikemoss\|gb165\|FE441231 | 3222 | 399 | 84.2 | blastp |
| 1716 | LYM236 H82 | spikemoss\|gb165\|FE443181 | 3223 | 399 | 82.3 | blastp |
| 1717 | LYM236 H83 | spruce\|gb162\|CO225856 | 3224 | 399 | 85 | blastp |
| 1718 | LYM236 H84 | strawberry\|gb164\|DV438767 | 3225 | 399 | 82.6 | blastp |
| 1719 | LYM236 H140 | sugarcane\|gb157.3\|BU103347 | 3226 | 399 | 94.5 | blastp |
| 1720 | LYM236 H141 | sugarcane\|gb157.3\|CA070718 | 3227 | 399 | 92.5 | blastp |
| 1721 | LYM236 H87 | sunflower\|gb162\|CD846861 | 3228 | 399 | 86.6 | blastp |
| 1722 | LYM236 H88 | sunflower\|gb162\|CD854278 | 3229 | 399 | 87.9 | blastp |
| 1723 | LYM236 H89 | switchgrass\|gb167\|DN142415 | 3230 | 399 | 92 | blastp |
| 1724 | LYM236 H90 | switchgrass\|gb167\|DN143508 | 3231 | 399 | 95.4 | blastp |
| 1725 | LYM236 H91 | switchgrass\|gb167\|DN150237 | 3232 | 399 | 95.2 | blastp |
| 1726 | LYM236 H92 | switchgrass\|gb167\|DN151575 | 3233 | 399 | 92.2 | blastp |
| 1727 | LYM236 H93 | *thellungiella*\|gb167\|DN774112 | 3234 | 399 | 87.14 | tblastn |
| 1728 | LYM236 H94 | tobacco\|gb162\|DV158343 | 3235 | 399 | 83.3 | blastp |
| 1729 | LYM236 H95 | tobacco\|gb162\|X77944 | 3236 | 399 | 88.5 | blastp |
| 1730 | LYM236 H142 | tomato\|09v1\|BG131802 | 3237 | 399 | 85.6 | blastp |
| 1731 | LYM236 H143 | tomato\|09v1\|BG629432 | 3238 | 399 | 87.3 | blastp |
| 1732 | LYM236 H98 | *triphysaria*\|gb164\|DR171747 | 3239 | 399 | 88.4 | blastp |
| 1733 | LYM236 H99 | wheat\|gb164\|BE442540 | 3240 | 399 | 84.1 | blastp |
| 1734 | LYM238 H0 | rice\|gb170\|OS05G45080 | 3241 | 400 | 95.4 | blastp |
| 1735 | LYM240 H9 | barley\|gb157SOLEXA\|AL508021 | 3242 | 402 | 91.9 | blastp |
| 1736 | LYM240 H10 | *brachypodium*\|09v1\|GT810642 | 3243 | 402 | 91.9 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1737 | LYM240 H11 | maize\|gb170\|DR972790 | 3244 | 402 | 84.2 | blastp |
| 1738 | LYM240 H12 | sorghum\|09v1\|SB02G038240 | 3245 | 402 | 84.2 | blastp |
| 1739 | LYM240 H13 | sugarcane\|gb157.3\|CA075929 | 3246 | 402 | 82.3 | blastp |
| 1740 | LYM240 H6 | switchgrass\|gb167\|FE597498 | 3247 | 402 | 81.6 | blastp |
| 1741 | LYM240 H7 | switchgrass\|gb167\|FE610847 | 3248 | 402 | 80 | blastp |
| 1742 | LYM240 H8 | switchgrass\|gb167\|FL960804 | 3249 | 402 | 81.6 | blastp |
| 1743 | LYM240 H9 | wheat\|gb164\|CA674491 | 3250 | 402 | 89.93 | tblastn |
| 1744 | LYM242 H7 | barley\|gb157SOLEXA\|BE412570 | 3251 | 404 | 82.2 | blastp |
| 1745 | LYM242 H8 | brachypodium\|09v1\|GT764573 | 3252 | 404 | 86.1 | blastp |
| 1746 | LYM242 H9 | maize\|gb170\|AI746053 | 3253 | 404 | 83.4 | blastp |
| 1747 | LYM242 H10 | millet\|09v1\|EVO454PM008771 | 3254 | 404 | 85 | blastp |
| 1748 | LYM242 H11 | sorghum\|09v1\|SB03G003160 | 3255 | 404 | 82.6 | blastp |
| 1749 | LYM242 H12 | sugarcane\|gb157.3\|BQ534251 | 3256 | 404 | 83.8 | blastp |
| 1750 | LYM242 H5 | switchgrass\|gb167\|DN143169 | 3257 | 404 | 85.1 | blastp |
| 1751 | LYM242 H6 | switchgrass\|gb167\|FE654179 | 3258 | 404 | 85 | blastp |
| 1752 | LYM242 H7 | wheat\|gb164\|BE403285 | 3259 | 404 | 82.6 | blastp |
| 1753 | LYM248 H3 | brachypodium\|09v1\|GT773582 | 3260 | 407 | 84.5 | blastp |
| 1754 | LYM248 H4 | maize\|gb170\|AI966957 | 3261 | 407 | 88.5 | blastp |
| 1755 | LYM248 H5 | sorghum\|09v1\|SB04G000645 | 3262 | 407 | 88.2 | blastp |
| 1756 | LYM248 H2 | switchgrass\|gb167\|DN149511 | 3263 | 407 | 81.1 | blastp |
| 1757 | LYM248 H3 | wheat\|gb164\|BE418033 | 3264 | 407 | 84.89 | tblastn |
| 1758 | LYM250 H0 | rice\|gb170\|OS09G38700 | 3265 | 409 | 100 | tblastn |
| 1758 | LYM250 H0 | rice\|gb170\|OS09G38700 | 3265 | 463 | 97.78 | tblastn |
| 1759 | LYM251 H1 | antirrhinum\|gb166\|AJ560114 | 3266 | 410 | 82 | blastp |
| 1760 | LYM251 H76 | apple\|gb171\|CN492643 | 3267 | 410 | 80.1 | blastp |
| 1761 | LYM251 H77 | arabidopsis lyrata\|09v1\|JGIAL012198 | 3268 | 410 | 81.4 | blastp |
| 1762 | LYM251 H3 | arabidopsis\|gb165\|AT2G17380 | 3269 | 410 | 80.7 | blastp |
| 1763 | LYM251 H4 | arabidopsis\|gb165\|AT4G35410 | 3270 | 410 | 80.12 | tblastn |
| 1764 | LYM251 H5 | b oleracea\|gb161\|AM385265 | 3271 | 410 | 81.4 | blastp |
| 1765 | LYM251 H6 | b rapa\|gb162\|L33527 | 3272 | 410 | 81.4 | blastp |
| 1766 | LYM251 H7 | banana\|gb167\|FF558300 | 3273 | 410 | 81.37 | tblastn |
| 1767 | LYM251 H78 | barley\|gb157SOLEXA\|BE421807 | 3274 | 410 | 81.4 | blastp |
| 1768 | LYM251 H9 | basilicum\|gb157.3\|DY343154 | 3275 | 410 | 80.12 | tblastn |
| 1769 | LYM251 H11 | bean\|gb167\|CV536707 | 3276 | 410 | 80.1 | blastp |
| 1770 | LYM251 H79 | brachypodium\|09v1\|DV469153 | 3277 | 410 | 82.6 | blastp |
| 1771 | LYM251 H13 | canola\|gb161\|CN726086 | 3278 | 410 | 81.4 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1772 | LYM251 H80 | cassava\|09v1\|CK650427 | 3279 | 410 | 80.12 | tblastn |
| 1773 | LYM251 H81 | cassava\|09v1\|DV448885 | 3280 | 410 | 81.4 | blastp |
| 1774 | LYM251 H82 | castorbean\|09v1\|XM002514342 | 3281 | 410 | 81.4 | blastp |
| 1775 | LYM251 H16 | catharanthus\|gb166\|EG554670 | 3282 | 410 | 81.4 | blastp |
| 1776 | LYM251 H17 | centaurea\|gb166\|EH737707 | 3283 | 410 | 81.4 | blastp |
| 1777 | LYM251 H18 | centaurea\|gb166\|EH782010 | 3284 | 410 | 81.4 | blastp |
| 1778 | LYM251 H83 | chestnut\|gb170\|SRR006295S0001854 | 3285 | 410 | 80.1 | blastp |
| 1779 | LYM251 H84 | chickpea\|09v2\|DY475463 | 3286 | 410 | 80.12 | tblastn |
| 1780 | LYM251 H85 | cichorium\|gb171\|EH677909 | 3287 | 410 | 81.4 | blastp |
| 1781 | LYM251 H86 | cichorium\|gb171\|EH681849 | 3288 | 410 | 80.7 | blastp |
| 1782 | LYM251 H21 | citrus\|gb166\|CF419015 | 3289 | 410 | 82 | blastp |
| 1783 | LYM251 H22 | clover\|gb162\|BB935136 | 3290 | 410 | 81.4 | blastp |
| 1784 | LYM251 H23 | cowpea\|gb166\|FF383763 | 3291 | 410 | 80.1 | blastp |
| 1785 | LYM251 H87 | cucumber\|09v1\|CK085508 | 3292 | 410 | 80.1 | blastp |
| 1786 | LYM251 H24 | dandelion\|gb161\|DY822878 | 3293 | 410 | 80.1 | blastp |
| 1787 | LYM251 H25 | eucalyptus\|gb166\|CT981708 | 3294 | 410 | 80.7 | blastp |
| 1788 | LYM251 H88 | fern\|gb171\|DK949355 | 3295 | 410 | 80.1 | blastp |
| 1789 | LYM251 H26 | fescue\|gb161\|DT702820 | 3296 | 410 | 82.6 | blastp |
| 1790 | LYM251 H89 | gerbera\|09v1\|AJ756319 | 3297 | 410 | 80.7 | blastp |
| 1791 | LYM251 H27 | grape\|gb160\|CB008191 | 3298 | 410 | 82 | blastp |
| 1792 | LYM251 H28 | grape\|gb160\|CD799819 | 3299 | 410 | 82 | blastp |
| 1793 | LYM251 H29 | ipomoea\|gb157.2\|CJ751066 | 3300 | 410 | 81.4 | blastp |
| 1794 | LYM251 H90 | jatropha\|09v1\|GO247140 | 3301 | 410 | 80.7 | blastp |
| 1795 | LYM251 H30 | lettuce\|gb157.2\|DW045452 | 3302 | 410 | 81.4 | blastp |
| 1796 | LYM251 H31 | liriodendron\|gb166\|CK762515 | 3303 | 410 | 83.2 | blastp |
| 1797 | LYM251 H91 | maize\|gb170\|AA979856 | 3304 | 410 | 83.23 | tblastn |
| 1798 | LYM251 H92 | maize\|gb170\|AI619342 | 3305 | 410 | 83.2 | blastp |
| 1799 | LYM251 H93 | maize\|gb170\|AW134457 | 3306 | 410 | 91.3 | tblastn |
| 1800 | LYM251 H94 | medicago\|09v1\|MSU93094 | 3307 | 410 | 82 | blastp |
| 1801 | LYM251 H36 | melon\|gb165\|DV633583 | 3308 | 410 | 80.1 | blastp |
| 1802 | LYM251 H95 | millet\|09v1\|EVO454PM010186 | 3309 | 410 | 83.2 | blastp |
| 1803 | LYM251 H96 | millet\|09v1\|EVO454PM104784 | 3310 | 410 | 91.93 | tblastn |
| 1804 | LYM251 H97 | monkeyflower\|09v1\|GR007448 | 3311 | 410 | 82.6 | blastp |
| 1805 | LYM251 H37 | nuphar\|gb166\|DT588573 | 3312 | 410 | 82 | blastp |
| 1806 | LYM251 H98 | oak\|gb170\|DN949793 | 3313 | 410 | 80.1 | blastp |
| 1807 | LYM251 H38 | papaya\|gb165\|EX261560 | 3314 | 410 | 81.4 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1808 | LYM251 H99 | peanut\|gb171\|EH046845 | 3315 | 410 | 82 | blastp |
| 1809 | LYM251 H100 | pepper\|gb171\|BM068291 | 3316 | 410 | 83.2 | blastp |
| 1810 | LYM251 H101 | petunia\|gb171\|FN005056 | 3317 | 410 | 82.6 | blastp |
| 1811 | LYM251 H42 | pine\|gb157.2\|AA556857 | 3318 | 410 | 81.4 | blastp |
| 1812 | LYM251 H43 | pine\|gb157.2\|AW289837 | 3319 | 410 | 81.4 | blastp |
| 1813 | LYM251 H102 | poplar\|gb170\|AI165130 | 3320 | 410 | 80.1 | blastp |
| 1814 | LYM251 H45 | poppy\|gb166\|FG613763 | 3321 | 410 | 80.1 | blastp |
| 1815 | LYM251 H46 | potato\|gb157.2\|BF054079 | 3322 | 410 | 82.6 | blastp |
| 1816 | LYM251 H47 | pseudoroegneria\|gb167\|FF342572 | 3323 | 410 | 80.7 | blastp |
| 1817 | LYM251 H48 | radish\|gb164\|EV525206 | 3324 | 410 | 80.7 | blastp |
| 1818 | LYM251 H49 | radish\|gb164\|EV528593 | 3325 | 410 | 80.7 | blastp |
| 1819 | LYM251 H50 | radish\|gb164\|EV534996 | 3326 | 410 | 81.4 | blastp |
| 1820 | LYM251 H51 | radish\|gb164\|EV565677 | 3327 | 410 | 81.4 | blastp |
| 1821 | LYM251 H103 | rice\|gb170\|OS03G57040 | 3328 | 410 | 82.6 | blastp |
| 1822 | LYM251 H53 | rye\|gb164\|BE637009 | 3329 | 410 | 80.7 | blastp |
| 1823 | LYM251 H54 | safflower\|gb162\|EL402398 | 3330 | 410 | 81.4 | blastp |
| 1824 | LYM251 H104 | solanum phureja\|09v1\|SPHBG126373 | 3331 | 410 | 82.6 | blastp |
| 1825 | LYM251 H105 | sorghum\|09v1\|SB01G003840 | 3332 | 410 | 91.3 | tblastn |
| 1826 | LYM251 H106 | sorghum\|09v1\|SB01G006180 | 3333 | 410 | 83.2 | blastp |
| 1827 | LYM251 H57 | soybean\|gb168\|AW685285 | 3334 | 410 | 81.4 | blastp |
| 1828 | LYM251 H58 | soybean\|gb168\|BQ154723 | 3335 | 410 | 80.1 | blastp |
| 1829 | LYM251 H59 | spruce\|gb162\|Z93754 | 3336 | 410 | 80.7 | blastp |
| 1830 | LYM251 H107 | sugarcane\|gb157.3\|BQ533200 | 3337 | 410 | 83.2 | blastp |
| 1831 | LYM251 H108 | sugarcane\|gb157.3\|BU103624 | 3338 | 410 | 83.2 | blastp |
| 1832 | LYM251 H62 | sunflower\|gb162\|CD854801 | 3339 | 410 | 81.4 | blastp |
| 1833 | LYM251 H63 | sunflower\|gb162\|DY917387 | 3340 | 410 | 81.4 | blastp |
| 1834 | LYM251 H64 | sunflower\|gb162\|EL485634 | 3341 | 410 | 81.4 | blastp |
| 1835 | LYM251 H65 | switchgrass\|gb167\|DN152225 | 3342 | 410 | 83.2 | blastp |
| 1836 | LYM251 H66 | switchgrass\|gb167\|DN152580 | 3343 | 410 | 82 | blastp |
| 1837 | LYM251 H67 | switchgrass\|gb167\|FL827716 | 3344 | 410 | 92.5 | blastp |
| 1838 | LYM251 H68 | thellungiella\|gb167\|DN776639 | 3345 | 410 | 80.7 | blastp |
| 1839 | LYM251 H69 | tobacco\|gb162\|CV020782 | 3346 | 410 | 82 | blastp |
| 1840 | LYM251 H109 | tomato\|09v1\|BG126373 | 3347 | 410 | 83.2 | blastp |
| 1841 | LYM251 H71 | triphysaria\|gb164\|EY017996 | 3348 | 410 | 80.7 | blastp |
| 1842 | LYM251 H72 | walnuts\|gb166\|EL892983 | 3349 | 410 | 80.1 | blastp |
| 1843 | LYM251 H73 | walnuts\|gb166\|EL903496 | 3350 | 410 | 80.1 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1844 | LYM251 H74 | wheat\|gb164\|BE444356 | 3351 | 410 | 81.4 | blastp |
| 1845 | LYM251 H75 | wheat\|gb164\|BE498579 | 3352 | 410 | 81.4 | blastp |
| 1846 | LYM251 H76 | wheat\|gb164\|BQ905308 | 3353 | 410 | 81.4 | blastp |
| 1847 | LYM255 H3 | brachypodium\|09v1\|DV486276 | 3354 | 413 | 83.9 | blastp |
| 1848 | LYM255 H4 | maize\|gb170\|AA072446 | 3355 | 413 | 80.8 | blastp |
| 1849 | LYM255 H5 | sorghum\|09v1\|SB04G034000 | 3356 | 413 | 82 | blastp |
| 1850 | LYM255 H3 | switchgrass\|gb167\|FE606184 | 3357 | 413 | 83.8 | blastp |
| 1851 | LYM260 H0 | rice\|gb170\|OS09G38800 | 3358 | 414 | 80.5 | blastp |
| 1852 | LYM263 H0 | maize\|gb170\|AI673859 | 3359 | 416 | 87.47 | tblastn |
| 1853 | LYM183 H8 | brachypodium\|09v1\|DV474476 | 3360 | 417 | 90.5 | blastp |
| 1853 | LYM183 H8 | brachypodium\|09v1\|DV474476 | 3360 | 464 | 90.5 | blastp |
| 1854 | LYM183 H1 | cenchrus\|gb166\|EB655853 | 3361 | 417 | 83.5 | blastp |
| 1854 | LYM183 H1 | cenchrus\|gb166\|EB655853 | 3361 | 464 | 83.5 | blastp |
| 1855 | LYM183 H2 | leymus\|gb166\|EG375719 | 3362 | 417 | 94.2 | blastp |
| 1855 | LYM183 H2 | leymus\|gb166\|EG375719 | 3362 | 464 | 94.2 | blastp |
| 1856 | LYM183 H9 | maize\|gb170\|AI964673 | 3363 | 417 | 85.2 | blastp |
| 1856 | LYM183 H9 | maize\|gb170\|AI964673 | 3363 | 464 | 85.2 | blastp |
| 1857 | LYM183 H10 | rice\|gb170\|OS03G60780 | 3364 | 417 | 84.8 | blastp |
| 1857 | LYM183 H10 | rice\|gb170\|OS03G60780 | 3364 | 464 | 84.8 | blastp |
| 1858 | LYM183 H11 | sorghum\|09v1\|SB01G003070 | 3365 | 417 | 84.4 | blastp |
| 1858 | LYM183 H11 | sorghum\|09v1\|SB01G003070 | 3365 | 464 | 84.4 | blastp |
| 1859 | LYM183 H12 | sugarcane\|gb157.3\|CA111823 | 3366 | 417 | 83.6 | blastp |
| 1859 | LYM183 H12 | sugarcane\|gb157.3\|CA111823 | 3366 | 464 | 83.6 | blastp |
| 1860 | LYM183 H6 | switchgrass\|gb167\|DN151763 | 3367 | 417 | 83.4 | blastp |
| 1860 | LYM183 H6 | switchgrass\|gb167\|DN151763 | 3367 | 464 | 83.4 | blastp |
| 1861 | LYM183 H7 | wheat\|gb164\|BE515616 | 3368 | 417 | 93.9 | tblastn |
| 1861 | LYM183 H7 | wheat\|gb164\|BE515616 | 3368 | 464 | 93.63 | tblastn |
| 1862 | LYM183 H8 | wheat\|gb164\|BQ160803 | 3369 | 417 | 94.7 | blastp |
| 1862 | LYM183 H8 | wheat\|gb164\|BQ160803 | 3369 | 464 | 94.7 | blastp |
| 1863 | LYM256 H2 | rice\|gb170\|OS05G45110 | 3370 | 418 | 87.3 | blastp |
| 1864 | LYM256 H3 | rice\|gb170\|OS10G07970 | 3371 | 418 | 81.09 | tblastn |
| 1865 | LYM200 H0 | sorghum\|09v1\|SB04G005600 | 3372 | 419 | 86.5 | blastp |
| 1866 | LYM267 H1 | sorghum\|09v1\|SB01G044240 | 3373 | 420 | 88.3 | blastp |
| 1867 | LYM268 H1 | sugarcane\|gb157.3\|CA079076 | 3374 | 421 | 81.6 | blastp |
| 1868 | LYM270 H0 | sorghum\|09v1\|SB02G040045 | 3375 | 422 | 82.3 | blastp |
| 1869 | LYM271 H7 | barley\|gb157SOLEXA\|BG344953 | 3376 | 423 | 89.9 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1870 | LYM271H8 | brachypodium|09v1|GT838823 | 3377 | 423 | 89.9 | blastp |
| 1871 | LYM271H9 | rice|gb170|OS07G43460 | 3378 | 423 | 91.1 | blastp |
| 1872 | LYM271H10 | sorghum|09v1|SB02G040020 | 3379 | 423 | 96.5 | blastp |
| 1873 | LYM271H11 | sugarcane|gb157.3|CA118167 | 3380 | 423 | 89.53 | tblastn |
| 1874 | LYM271H6 | switchgrass|gb167|FL691032 | 3381 | 423 | 94.2 | blastp |
| 1875 | LYM271H7 | wheat|gb164|CJ664209 | 3382 | 423 | 91.5 | blastp |
| 1876 | LYM273H4 | brachypodium|09v1|DV469687 | 3383 | 425 | 83.3 | blastp |
| 1877 | LYM273H5 | maize|gb170|AW355978 | 3384 | 425 | 85.2 | blastp |
| 1878 | LYM273H6 | sorghum|09v1|SB03G044410 | 3385 | 425 | 84 | blastp |
| 1879 | LYM273H4 | wheat|gb164|BE518377 | 3386 | 425 | 85 | blastp |
| 1880 | LYM274H0 | rice|gb170|OS01G70240 | 3387 | 426 | 100 | blastp |
| 1880 | LYM274H0 | rice|gb170|OS01G70240 | 3387 | 466 | 89.2 | blastp |
| 1881 | LYM278H9 | maize|gb170|LLDQ244681 | 3388 | 428 | 95.2 | blastp |
| 1882 | LYM278H2 | rye|gb164|Z23257 | 3389 | 428 | 92.86 | tblastn |
| 1883 | LYM278H3 | wheat|gb164|AL821264 | 3390 | 428 | 95.3 | blastp |
| 1884 | LYM278H4 | wheat|gb164|BE516723 | 3391 | 428 | 94 | blastp |
| 1885 | LYM278H5 | wheat|gb164|BF200402 | 3392 | 428 | 86.9 | tblastn |
| 1886 | LYM278H6 | wheat|gb164|BF474423 | 3393 | 428 | 92.86 | tblastn |
| 1887 | LYM278H7 | wheat|gb164|BG909462 | 3394 | 428 | 89.3 | blastp |
| 1888 | LYM278H8 | wheat|gb164|BQ579097 | 3395 | 428 | 95.24 | tblastn |
| 1889 | LYM278H9 | wheat|gb164|CA650349 | 3396 | 428 | 83.3 | blastp |
| 1890 | LYM284H16 | barley|gb157SOLEXA|BE438857 | 3397 | 430 | 86.4 | blastp |
| 1891 | LYM284H17 | brachypodium|09v1|DV474685 | 3398 | 430 | 84.3 | blastp |
| 1892 | LYM284H18 | brachypodium|09v1|DV488161 | 3399 | 430 | 88.2 | blastp |
| 1893 | LYM284H3 | fescue|gb161|DT674446 | 3400 | 430 | 86.91 | tblastn |
| 1894 | LYM284H19 | maize|gb170|AI637256 | 3401 | 430 | 88.5 | blastp |
| 1895 | LYM284H20 | maize|gb170|AI861131 | 3402 | 430 | 84.3 | blastp |
| 1896 | LYM284H21 | maize|gb170|BM501276 | 3403 | 430 | 83.8 | blastp |
| 1897 | LYM284H22 | rice|gb170|OS01G43020 | 3404 | 430 | 81.4 | blastp |
| 1898 | LYM284H23 | rice|gb170|OS01G46570 | 3405 | 430 | 84.6 | blastp |
| 1899 | LYM284H24 | sorghum|09v1|SB03G027960 | 3406 | 430 | 80.6 | blastp |
| 1900 | LYM284H25 | sorghum|09v1|SB03G029790 | 3407 | 430 | 85.1 | blastp |
| 1901 | LYM284H26 | sorghum|09v1|SB09G029130 | 3408 | 430 | 87.2 | blastp |
| 1902 | LYM284H27 | sugarcane|gb157.3|BQ533889 | 3409 | 430 | 84.5 | blastp |
| 1903 | LYM284H12 | switchgrass|gb167|DN151636 | 3410 | 430 | 81 | blastp |
| 1904 | LYM284H13 | switchgrass|gb167|FE634580 | 3411 | 430 | 85.4 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1905 | LYM284 H14 | switchgrass\|gb167\|FL712120 | 3412 | 430 | 89.53 | tblastn |
| 1906 | LYM284 H15 | wheat\|gb164\|BE400789 | 3413 | 430 | 88.1 | blastp |
| 1907 | LYM284 H16 | wheat\|gb164\|BF200804 | 3414 | 430 | 80.4 | blastp |
| 1908 | LYM285 H3 | brachypodium\|09v1\|DV476342 | 3415 | 431 | 89.2 | blastp |
| 1909 | LYM285 H4 | maize\|gb170\|AI372298 | 3416 | 431 | 88.1 | blastp |
| 1910 | LYM285 H5 | rice\|gb170\|OS01G69900 | 3417 | 431 | 99.82 | tblastn |
| 1911 | LYM285 H6 | sorghum\|09v1\|SB03G044210 | 3418 | 431 | 89.3 | blastp |
| 1912 | LYM285 H3 | switchgrass\|gb167\|DN142770 | 3419 | 431 | 89.75 | tblastn |
| 1913 | LYM288 H6 | brachypodium\|09v1\|DV471350 | 3420 | 433 | 83.3 | blastp |
| 1914 | LYM288 H1 | leymus\|gb166\|EG377996 | 3421 | 433 | 84.7 | blastp |
| 1915 | LYM288 H7 | maize\|gb170\|AI977924 | 3422 | 433 | 84.5 | blastp |
| 1916 | LYM288 H8 | sorghum\|09v1\|SB02G039240 | 3423 | 433 | 83.9 | blastp |
| 1917 | LYM288 H9 | sugarcane\|gb157.3\|CA067537 | 3424 | 433 | 85.8 | blastp |
| 1918 | LYM288 H5 | switchgrass\|gb167\|DN151710 | 3425 | 433 | 85.3 | blastp |
| 1919 | LYM288 H6 | switchgrass\|gb167\|FE610990 | 3426 | 433 | 85.3 | blastp |
| 1920 | LYM289 H39 | barley\|gb157SOLEXA\|AL500321 | 3427 | 434 | 91.1 | blastp |
| 1921 | LYM289 H40 | barley\|gb157SOLEXA\|AV915627 | 3428 | 434 | 92.7 | blastp |
| 1922 | LYM289 H41 | barley\|gb157SOLEXA\|BF624195 | 3429 | 434 | 98.2 | blastp |
| 1923 | LYM289 H42 | barley\|gb157SOLEXA\|BF627133 | 3430 | 434 | 92.7 | blastp |
| 1924 | LYM289 H43 | barley\|gb157SOLEXA\|BQ739963 | 3431 | 434 | 92.7 | blastp |
| 1925 | LYM289 H44 | brachypodium\|09v1\|GFXEF059989X41 | 3432 | 434 | 81.8 | blastp |
| 1926 | LYM289 H7 | cacao\|gb167\|CU568933 | 3433 | 434 | 85.5 | blastp |
| 1927 | LYM289 H8 | fescue\|gb161\|CK801501 | 3434 | 434 | 90.9 | blastp |
| 1928 | LYM289 H9 | fescue\|gb161\|DT683663 | 3435 | 434 | 90.9 | blastp |
| 1929 | LYM289 H10 | leymus\|gb166\|EG376287 | 3436 | 434 | 96.4 | blastp |
| 1930 | LYM289 H45 | lolium\|09v1\|AU246683 | 3437 | 434 | 89.1 | blastp |
| 1931 | LYM289 H11 | lovegrass\|gb167\|DN480351 | 3438 | 434 | 87.3 | blastp |
| 1932 | LYM289 H46 | maize\|gb170\|AI637242 | 3439 | 434 | 81.8 | blastp |
| 1933 | LYM289 H47 | maize\|gb170\|LLEC865320 | 3440 | 434 | 81.8 | blastp |
| 1934 | LYM289 H48 | maize\|gb170\|T12715 | 3441 | 434 | 87.3 | blastp |
| 1935 | LYM289 H49 | millet\|09v1\|CD724594 | 3442 | 434 | 80 | blastp |
| 1936 | LYM289 H50 | millet\|09v1\|EB410971 | 3443 | 434 | 87.3 | blastp |
| 1937 | LYM289 H15 | oat\|gb164\|CN818354 | 3444 | 434 | 90.9 | blastp |
| 1938 | LYM289 H16 | pineapple\|gb157.2\|DT337702 | 3445 | 434 | 80 | blastp |
| 1939 | LYM289 H51 | rice\|gb170\|OS06G05120 | 3446 | 434 | 83.6 | blastp |
| 1940 | LYM289 H52 | sorghum\|09v1\|SB09G005410 | 3447 | 434 | 80 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1941 | LYM289 H53 | sorghum|09v1|SB10G002980 | 3448 | 434 | 87.3 | blastp |
| 1942 | LYM289 H54 | sugarcane|gb157.3|CA117495 | 3449 | 434 | 87.3 | blastp |
| 1943 | LYM289 H55 | sugarcane|gb157.3|CA149658 | 3450 | 434 | 81.8 | blastp |
| 1944 | LYM289 H56 | sugarcane|gb157.3|CF575668 | 3451 | 434 | 87.3 | blastp |
| 1945 | LYM289 H23 | switchgrass|gb167|DN144776 | 3452 | 434 | 80 | blastp |
| 1946 | LYM289 H24 | switchgrass|gb167|DN144989 | 3453 | 434 | 89.1 | blastp |
| 1947 | LYM289 H25 | switchgrass|gb167|FE607508 | 3454 | 434 | 89.1 | blastp |
| 1948 | LYM289 H26 | switchgrass|gb167|FL736037 | 3455 | 434 | 81.8 | blastp |
| 1949 | LYM289 H27 | wheat|gb164|AL811119 | 3456 | 434 | 98.2 | blastp |
| 1950 | LYM289 H28 | wheat|gb164|BE443789 | 3457 | 434 | 96.4 | blastp |
| 1951 | LYM289 H29 | wheat|gb164|BG907098 | 3458 | 434 | 98.2 | blastp |
| 1952 | LYM289 H30 | wheat|gb164|BM136571 | 3459 | 434 | 96.4 | blastp |
| 1953 | LYM289 H31 | wheat|gb164|BQ804261 | 3460 | 434 | 96.4 | blastp |
| 1954 | LYM289 H32 | wheat|gb164|CA616586 | 3461 | 434 | 81.8 | blastp |
| 1955 | LYM289 H33 | wheat|gb164|CA640178 | 3462 | 434 | 98.2 | blastp |
| 1956 | LYM289 H34 | wheat|gb164|CA643784 | 3463 | 434 | 98.2 | blastp |
| 1957 | LYM289 H35 | wheat|gb164|CA733972 | 3464 | 434 | 80.36 | tblastn |
| 1958 | LYM289 H36 | wheat|gb164|CD896873 | 3465 | 434 | 82.1 | blastp |
| 1959 | LYM289 H37 | wheat|gb164|CJ586709 | 3466 | 434 | 89.1 | blastp |
| 1960 | LYM289 H38 | wheat|gb164|CJ646970 | 3467 | 434 | 80 | blastp |
| 1961 | LYM289 H39 | wheat|gb164|CJ903378 | 3468 | 434 | 96.4 | blastp |
| 1962 | LYM290 H10 | barley|gb157SOLEXA|BE412989 | 3469 | 435 | 82.9 | blastp |
| 1963 | LYM290 H11 | brachypodium|09v1|GT759831 | 3470 | 435 | 81.9 | blastp |
| 1964 | LYM290 H12 | rice|gb170|OS04G20230 | 3471 | 435 | 82.9 | blastp |
| 1965 | LYM290 H3 | rye|gb164|BE495099 | 3472 | 435 | 81.9 | blastp |
| 1966 | LYM290 H13 | sorghum|09v1|SB01G009390 | 3473 | 435 | 95.2 | blastp |
| 1967 | LYM290 H14 | sorghum|09v1|SB06G004500 | 3474 | 435 | 94.8 | blastp |
| 1968 | LYM290 H15 | sugarcane|gb157.3|BQ535968 | 3475 | 435 | 95.7 | blastp |
| 1969 | LYM290 H16 | sugarcane|gb157.3|CA136629 | 3476 | 435 | 80.3 | blastp |
| 1970 | LYM290 H8 | switchgrass|gb167|FE622978 | 3477 | 435 | 91.4 | blastp |
| 1971 | LYM290 H9 | wheat|gb164|BE430090 | 3478 | 435 | 83.3 | blastp |

TABLE 2-continued

Homologues of the identified genes/polypeptides for increasing yield, fiber yield, fiber quality, growth rate, vigor, biomass, growth rate, abiotic stress tolerance, nitrogen use efficiency, water use efficiency and fertilizer use efficiency of a plant

| Nucl. SEQ ID NO: | Gene Name | cluster name | Polyp. SEQ ID NO: | Homolog. to SEQ ID NO: | % global identity | Algor. |
|---|---|---|---|---|---|---|
| 1972 | LYM290 H10 | wheat\|gb164\|BF199524 | 3479 | 435 | 82.4 | blastp |
| 1973 | LYM293 H0 | rice\|gb170\|OS09G38510 | 3480 | 437 | 91.8 | blastp |

Table 2: Provided are the homologous polypeptides and polynucleotides of the genes for increasing yield (e.g., oil yield, seed yield, fiber yield and/or quality), growth rate, vigor, biomass, abiotic stress tolerance, nitrogen use efficiency, water use efficiency and fertilizer use efficiency genes of a plant which are listed in Table 1 above. Homology was calculated as % of identity over the aligned sequences. The query sequences were polynucleotide sequences SEQ ID NOs: 1-239 and polypeptide SEQ ID NOs: 240-465 and the subject sequences are protein sequences identified in the database based on greater than 80% identity to the predicted translated sequences of the query nucleotide sequences or to the polypeptide sequences.
"Nucl." = polynucleotide;
"polyp." = polypeptide;
"Algor." = algorithm (used for sequence alignment and determination of percent homology).

The following sequences were found to be 100% identical: SEQ ID NO: 4 is identical to SEQ ID NO: 478; SEQ ID NO: 24 is identical to SEQ ID NO: 914; SEQ ID NO: 79 is identical to SEQ ID NO: 1050; SEQ ID NO: 132 is identical to SEQ ID NO: 3608; SEQ ID NO: 163 is identical to SEQ ID NO: 1734; SEQ ID NO: 249 is identical to SEQ ID NO: 2100, 2101, 2103, and 2108; SEQ ID NO: 321 is identical to SEQ ID NO: 2771; SEQ ID NO: 382 is identical to SEQ ID NO: 3019; SEQ ID NO: 387 is identical to SEQ ID NO: 2945; SEQ ID NO426 is identical to SEQ ID NO: 3387; SEQ ID NO: 446 is identical to SEQ ID NO: 2946; SEQ ID NO: 449 is identical to SEQ ID NO: 3705; SEQ ID NO: 2005 is identical to SEQ ID NO: 2011 and 2012; SEQ ID NO: 2007 is identical to SEQ ID NO: 2043 and 2045; SEQ ID NO: 2038 is identical to SEQ ID NO: 2039; SEQ ID NO: 2071 is identical to SEQ ID NO: 2072; SEQ ID NO: 2075 is identical to SEQ ID NO:2076, 2078, 2079, 2083, 2084, 2086, 2089, 2090, 2092, 2093, 2095, 2120, 2122, 2235, 2236, 2238, 2239, 2277, and 2278; SEQ ID NO: 2080 is identical to SEQ ID NO: 2155, 2176, 2179, 2248, and 2268; SEQ ID NO: 2102 is identical to SEQ ID NO: 2193; SEQ ID NO: 2105 is identical to SEQ ID NO: 2147, 2181, 2196, 2197, 2210, 2211, 2213, 2254, and 2256; SEQ ID NO: 2125 is identical to SEQ ID NO: 2126 and 2127; SEQ ID NO: 2130 is identical to SEQ ID NO: 2131, 2214, 2228, 2231, and 2251; SEQ ID NO: 2134 is identical to SEQ ID NO: 2247; SEQ ID NO: 2144 is identical to SEQ ID NO: 2153 and 2201; SEQ ID NO: 2188 is identical to SEQ ID NO: 2191, 2253, 2264, and 2271; SEQ ID NO: 2189 is identical to SEQ ID NO: 2202, 2252, 2265, 2266, 2270, and 2272; SEQ ID NO: 2215 is identical to SEQ ID NO: 2250 and 2284; SEQ ID NO: 2218 is identical to SEQ ID NO: 2219; SEQ ID NO: 2220 is identical to SEQ ID NO: 2221 and 2258; SEQ ID NO: 2356 is identical to SEQ ID NO: 2357 and 2359; SEQ ID NO: 2380 is identical to SEQ ID NO: 2402; SEQ ID NO: 2384 is identical to SEQ ID NO: 2387; SEQ ID NO: 2463 is identical to SEQ ID NO:2464; SEQ ID NO: 2481 is identical to SEQ ID NO: 2483; SEQ ID NO: 2485 is identical to SEQ ID NO: 2486; SEQ ID NO: 2533 is identical to SEQ ID NO: 2538; SEQ ID NO: 2582 is identical to SEQ ID NO: 2583; SEQ ID NO: 2588 is identical to SEQ ID NO: 2594, 2603, 2621, and 2629; SEQ ID NO: 2589 is identical to SEQ ID NO:2590, 2591, 2592, 2595, 2596, 2601, 2604, 2605, 2623, 2624, 2626, 2627, 2630, 2756, 2757, 2758, 2760, 2761, 2762, 2764, 2765, and 2807; SEQ ID NO:2593 is identical to SEQ ID NO:2632, and 2767; SEQ ID NO: 2600 is identical to SEQ ID NO: 2622; SEQ ID NO: 2606 is identical to SEQ ID NO: 2610; SEQ ID NO: 2607 is identical to SEQ ID NO: 2609; SEQ ID NO: 2625 is identical to SEQ ID NO: 2713; SEQ ID NO: 2638 is identical to SEQ ID NO: 2639; SEQ ID NO: 2644 is identical to SEQ ID NO: 2727; SEQ ID NO: 2645 is identical to SEQ ID NO: 2726; SEQ ID NO: 2665 is identical to SEQ ID NO: 2719; SEQ ID NO: 2687 is identical to SEQ ID NO: 2689; SEQ ID NO: 2691 is identical to SEQ ID NO: 2693 and 2698; SEQ ID NO: 2694 is identical to SEQ ID NO: 2697; SEQ ID NO: 2712 is identical to SEQ ID NO: 2816, 2817 and 2818; SEQ ID NO: 2748 is identical to SEQ ID NO: 2749, 2778 and 2815; SEQ ID NO: 2750 is identical to SEQ ID NO: 2751 and 2776; SEQ ID NO: 2779 is identical to SEQ ID NO: 2790 and 2794; SEQ ID NO: 2801 is identical to SEQ ID NO: 2804; SEQ ID NO: 2873 is identical to SEQ ID NO: 2880; SEQ ID NO: 2876 is identical to SEQ ID NO: 2881; SEQ ID NO: 2877 is identical to SEQ ID NO: 2879; SEQ ID NO: 2908 is identical to SEQ ID NO: 2909; SEQ ID NO: 3135 is identical to SEQ ID NO: 3136; SEQ ID NO: 3138 is identical to SEQ ID NO: 3145; SEQ ID NO: 3268 is identical to SEQ ID NO: 3271, 3272, 3278, 3326, and 3327; SEQ ID NO: 3274 is identical to SEQ ID NO: 3351, 3352, and 3353; SEQ ID NO: 3277 is identical to SEQ ID NO: 3296; SEQ ID NO: 3285 is identical to SEQ ID NO: 3313; SEQ ID NO: 3287 is identical to SEQ ID NO: 3302; SEQ ID NO: 3309 is identical to SEQ ID NO: 3333, 3337, 3338, and 3342; SEQ ID NO: 3318 is identical to SEQ ID NO: 3319; SEQ ID NO: 3322 is identical to SEQ ID NO: 3331; SEQ ID NO: 3428 is identical to SEQ ID NO: 3430 3431; SEQ ID NO: 3434 is identical to SEQ ID NO: 3435; SEQ ID NO: 3439 is identical to SEQ ID NO: 3440 and 3461; SEQ ID NO: 3448 is identical to SEQ ID NO: 3449 and 3451; SEQ ID NO: 3453 is identical to SEQ ID NO: 3454; SEQ ID NO: 3456 is identical to SEQ ID NO: 3458, 3462 and 3463; SEQ ID NO: 3457 is identical to SEQ ID NO: 3459 and 3468;

The output of the functional genomics approach described herein is a set of genes highly predicted to improve yield and/or other agronomic important traits such as growth rate, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcriptom and High Throughput Correlation Analysis Using 44K Barley Oligonucleotide Micro-Array In order to produce a high throughput correlation analysis, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

RNA extraction—Five tissues at different developmental stages [meristem, flower, booting spike, stem, flag leaf], representing different plant characteristics, were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA).

For convenience, each micro-array expression information tissue type has received a Set ID as summarized in Table 3 below.

TABLE 3

| Barley transcriptom expression sets | |
|---|---|
| Expression Set | Set ID |
| Meristem | A |
| Flower | B |
| Booting spike | C |
| Stem | D |
| Flag leaf | E |

Table 3

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—Image J 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 4

| Barley standard descriptors | | | |
|---|---|---|---|
| Trait | Parameter | Range | Description |
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 4.

Grains per spike—At the end of the experiment (50% of the spikes were dry) all spikes from plots within blocks A-D are collected. The total number of grains from 5 spikes that were manually threshed was counted. The average grain per spike is calculated by dividing the total grain number by the number of spikes.

Grain average size (cm)—At the end of the experiment (50% of the spikes were dry) all spikes from plots within blocks A-D are collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D are collected. The total grains from 5 spikes that were manually threshed were counted and weight. The average weight was calculated by dividing the total weight by the total grain number.

Grain yield per spike (gr)—At the end of the experiment (50% of the spikes were dry) all spikes from plots within blocks A-D are collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D are collected. The five chosen spikes per plant were measured using measuring tape excluding the awns.

Spike number analysis—At the end of the experiment (50% of the spikes were dry) all spikes from plots within blocks A-D are collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for barley)—The harvest index is calculated using Formula VI.

Harvest Index=Average spike dry weight per plant/(Average vegetative dry weight per plant+Average spike dry weight per plant)  Formula VI

TABLE 5

Barley correlated parameters (vectors)

| Correlated parameter with (units) | Correlation Id |
|---|---|
| Grains per spike (numbers) | 1 |
| Grains size (mm²) | 2 |
| Grain weight (miligrams) | 3 |
| Grain Yield per spike (gr/spike) | 4 |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |
| Stem pigmentation (scoring 1-5) | 11 |
| Vegetative dry weight (gram) | 12 |
| Harvest Index (ratio) | 13 |

Table 5.

Experimental Results 13 different Barley accessions were grown and characterized for 13 parameters as described above. The average for each of the measured parameter was calculated using the JMP software and values are summarized in Tables 6 and 7 below. Subsequent correlation analysis between the various transcriptom sets (Table 3) and the average parameters, was conducted. Follow, results were integrated to the database.

TABLE 6

Measured parameters of correlation Ids in Barley accessions

| Accession/Parameter | 6 | 10 | 3 | 5 | 2 | 1 | 7 |
|---|---|---|---|---|---|---|---|
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada park | 37.42 | 65.15 | 28.76 | 11.83 | 0.24 | 17.27 | 1.92 |
| Havarim stream | 61.92 | 58.92 | 17.87 | 9.90 | 0.17 | 17.73 | 3.17 |
| Jordan est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale Efraim | ND | 52.80 | 25.22 | 8.86 | 0.22 | 13.47 | 3.60 |
| Mt Arbel | 40.63 | 60.88 | 34.99 | 11.22 | 0.28 | 14.07 | 3.50 |
| Mt Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot Kdumim | 50.60 | 60.40 | 37.13 | 10.18 | 0.27 | 14.36 | 2.47 |
| Oren canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 6. Provided are the values of each of the parameters measured in Barley accessions according to the following correlation identifications (Correlation Ids): 6 = Spikes per plant; 10 = Days to flowering; 3 = Grain weight; 5 = Spike length; 2 = Grains Size; 1 = Grains per spike; 7 = Growth habit.

TABLE 7

Barley accessions, additional measured parameters

| Accession/Parameter | 8 | 9 | 4 | 11 | 12 | 13 |
|---|---|---|---|---|---|---|
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada park | 1.69 | 138.77 | 2.58 | 1.69 | 68.49 | 0.40 |
| Havarim stream | 1.08 | 114.58 | 1.57 | 1.75 | 53.39 | 0.44 |
| Jordan est | 1.42 | 127.75 | 3.03 | 2.33 | 68.30 | 0.43 |
| Klil | 1.69 | 129.38 | 2.52 | 2.31 | 74.17 | 0.40 |
| Maale Efraim | 1.30 | 103.89 | 1.55 | 1.70 | 35.35 | 0.52 |
| Mt Arbel | 1.19 | 121.63 | 2.62 | 2.19 | 58.33 | 0.48 |
| Mt Harif | 1.00 | 126.80 | 2.30 | 2.30 | 62.23 | 0.44 |
| Neomi | 1.17 | 99.83 | 1.68 | 1.83 | 38.32 | 0.49 |
| Neot Kdumim | 1.60 | 121.40 | 2.68 | 3.07 | 68.31 | 0.45 |
| Oren canyon | 1.08 | 118.42 | 2.35 | 1.58 | 56.15 | ND |
| Yeruham | 1.17 | 117.17 | 1.67 | 2.17 | 42.68 | ND |

Table 7. Provided are the values of each of the parameters measured in Barley accessions according to the following correlation identifications (Correlation Ids): 8 = Hairiness of basal leaves; 9 = Plant height; 4 = Grain yield per spike; 11 = Stem pigmentation; 12 = Vegetative dry weight; 13 = Harvest Index.

TABLE 8

Correlation between the expression level of the selected polynucleotides of the invention and their homologues in specific tissues or developmental stages and the phenotypic performance across Barley ecotypes

| Gene Name | Expression Set | Correlation Vector | R | P |
|---|---|---|---|---|
| LYM26 | A | 12 | 0.87938 | 0.00178 |
| LYM26 | A | 4 | 0.86421 | 0.00265 |
| LYM26 | A | 12 | 0.85977 | 0.00069 |
| LYM26 | A | 4 | 0.84991 | 0.00092 |
| LYM26 | A | 9 | 0.83315 | 0.00145 |
| LYM26 | A | 9 | 0.81930 | 0.00689 |
| LYM26 | A | 5 | 0.81231 | 0.00238 |
| LYM26 | A | 5 | 0.80624 | 0.00867 |
| LYM26 | C | 1 | 0.74897 | 0.00799 |
| LYM26 | C | 1 | 0.73316 | 0.02461 |
| LYM26 | A | 10 | 0.72560 | 0.02691 |
| LYM51 | A | 10 | 0.93629 | 0.00020 |
| LYM51 | A | 12 | 0.92036 | 0.00043 |
| LYM51 | A | 5 | 0.88679 | 0.00144 |
| LYM51 | A | 9 | 0.87500 | 0.00201 |
| LYM51 | A | 10 | 0.85681 | 0.00075 |
| LYM51 | A | 4 | 0.82050 | 0.00674 |
| LYM51 | A | 5 | 0.78204 | 0.00445 |
| LYM51 | A | 9 | 0.77050 | 0.00552 |
| LYM51 | A | 12 | 0.74603 | 0.00838 |

TABLE 8-continued

Correlation between the expression level of the selected polynucleotides of the invention and their homologues in specific tissues or developmental stages and the phenotypic performance across Barley ecotypes

| Gene Name | Expression Set | Correlation Vector | R | P |
|---|---|---|---|---|
| LYM51 | A | 4 | 0.71036 | 0.01430 |
| LYM59 | A | 4 | 0.88939 | 0.00133 |
| LYM59 | A | 3 | 0.80853 | 0.00834 |
| LYM59 | A | 2 | 0.80307 | 0.00915 |
| LYM59 | A | 12 | 0.79319 | 0.01075 |
| LYM59 | A | 5 | 0.73433 | 0.02426 |
| LYM59 | A | 10 | 0.72556 | 0.02693 |
| LYM66 | A | 1 | 0.77697 | 0.01376 |
| LYM66 | A | 1 | 0.75508 | 0.00722 |
| LYM82 | A | 10 | 0.88760 | 0.00140 |
| LYM82 | A | 12 | 0.86378 | 0.00061 |
| LYM82 | A | 12 | 0.85529 | 0.00329 |
| LYM82 | A | 10 | 0.84623 | 0.00102 |
| LYM82 | A | 9 | 0.83000 | 0.00562 |
| LYM82 | A | 9 | 0.82602 | 0.00173 |
| LYM82 | A | 4 | 0.81534 | 0.00222 |
| LYM82 | A | 4 | 0.79017 | 0.01127 |
| LYM82 | A | 5 | 0.78467 | 0.00424 |
| LYM82 | A | 5 | 0.76164 | 0.01709 |
| LYM84 | C | 2 | 0.79418 | 0.01058 |
| LYM84 | B | 2 | 0.79145 | 0.01928 |
| LYM84 | C | 3 | 0.77694 | 0.01377 |
| LYM84 | B | 3 | 0.75502 | 0.03033 |
| LYM84 | A | 2 | 0.70823 | 0.01473 |
| LYM99 | C | 7 | 0.75021 | 0.01989 |
| LYM99 | A | 7 | 0.72294 | 0.02776 |
| LYM95 | B | 2 | 0.81158 | 0.00436 |
| LYM95 | B | 3 | 0.77615 | 0.00830 |
| LYM95 | B | 10 | 0.73186 | 0.01612 |
| LYM95 | C | 2 | 0.72471 | 0.02719 |
| LYM95 | B | 5 | 0.71170 | 0.02097 |
| LYM100 | A | 3 | 0.77258 | 0.01467 |
| LYM100 | A | 4 | 0.76559 | 0.01619 |
| LYM100 | A | 2 | 0.72628 | 0.02670 |
| LYM105 | A | 4 | 0.80126 | 0.00943 |
| LYM105 | A | 2 | 0.80060 | 0.00953 |
| LYM105 | A | 3 | 0.78770 | 0.01171 |
| LYM105 | A | 8 | 0.71795 | 0.02939 |
| LYM105 | B | 1 | 0.71160 | 0.04775 |
| LYM137 | C | 5 | 0.91789 | 0.00007 |
| LYM137 | C | 4 | 0.87211 | 0.00046 |
| LYM137 | C | 10 | 0.86290 | 0.00063 |
| LYM137 | C | 12 | 0.85934 | 0.00070 |
| LYM137 | C | 9 | 0.82372 | 0.00183 |
| LYM137 | C | 3 | 0.73788 | 0.02323 |
| LYM137 | C | 2 | 0.71562 | 0.03017 |
| LYM140 | C | 6 | 0.83623 | 0.00968 |
| LYM142 | B | 6 | 0.85850 | 0.01338 |
| LYM142 | A | 4 | 0.80126 | 0.00943 |
| LYM142 | A | 2 | 0.80060 | 0.00953 |
| LYM142 | A | 3 | 0.78770 | 0.01171 |
| LYM142 | A | 8 | 0.73208 | 0.01042 |
| LYM142 | A | 8 | 0.71795 | 0.02939 |
| LYM142 | B | 1 | 0.71160 | 0.04775 |
| LYM148 | A | 4 | 0.79887 | 0.00318 |
| LYM148 | A | 12 | 0.76743 | 0.00583 |
| LYM148 | A | 4 | 0.76342 | 0.01668 |
| LYM148 | A | 9 | 0.74349 | 0.00873 |
| LYM148 | A | 5 | 0.70612 | 0.01516 |
| LYM149 | B | 7 | 0.75092 | 0.03177 |
| LYM156 | C | 2 | 0.79406 | 0.00352 |
| LYM156 | C | 2 | 0.77724 | 0.01371 |
| LYM156 | A | 2 | 0.76712 | 0.00586 |
| LYM156 | A | 3 | 0.73707 | 0.00965 |
| LYM156 | C | 3 | 0.71152 | 0.01407 |
| LYM156 | B | 3 | 0.70014 | 0.05315 |
| LYM157 | A | 4 | 0.78681 | 0.01187 |
| LYM157 | A | 3 | 0.73234 | 0.02485 |
| LYM157 | A | 12 | 0.72729 | 0.02639 |
| LYM160 | A | 12 | 0.87825 | 0.00184 |
| LYM160 | A | 10 | 0.82699 | 0.00596 |
| LYM160 | A | 12 | 0.82567 | 0.00174 |
| LYM160 | A | 9 | 0.80855 | 0.00834 |
| LYM160 | A | 9 | 0.80222 | 0.00297 |
| LYM160 | A | 10 | 0.74770 | 0.00815 |
| LYM160 | A | 5 | 0.72266 | 0.02785 |
| LYM160 | A | 5 | 0.71752 | 0.01292 |
| LYM154 | C | 2 | 0.92810 | 0.00004 |
| LYM154 | C | 3 | 0.90313 | 0.00014 |
| LYM154 | C | 4 | 0.85169 | 0.00088 |
| LYM154 | C | 5 | 0.73538 | 0.00991 |
| LYM154 | C | 10 | 0.71818 | 0.01280 |
| LYM154 | C | 12 | 0.70985 | 0.01440 |
| LYM155 | C | 6 | 0.72312 | 0.04266 |
| LYM155 | C | 1 | 0.70598 | 0.01519 |
| LYM180 | C | 1 | 0.76320 | 0.00628 |
| LYM180 | B | 6 | 0.75133 | 0.05153 |
| LYM181 | C | 6 | 0.78450 | 0.02115 |
| LYM184 | B | 6 | 0.82395 | 0.02266 |
| LYM184 | B | 6 | 0.73704 | 0.01501 |
| LYM189 | A | 10 | 0.81585 | 0.00733 |
| LYM189 | A | 12 | 0.81256 | 0.00777 |
| LYM189 | A | 9 | 0.72388 | 0.02746 |
| LYM189 | A | 5 | 0.71589 | 0.03008 |
| LYM192 | A | 2 | 0.86386 | 0.00061 |
| LYM192 | A | 3 | 0.80919 | 0.00255 |
| LYM192 | A | 3 | 0.77612 | 0.01393 |
| LYM278 | A | 4 | 0.90217 | 0.00088 |
| LYM278 | A | 4 | 0.87108 | 0.00048 |
| LYM278 | A | 12 | 0.81518 | 0.00742 |
| LYM278 | A | 3 | 0.79925 | 0.00975 |
| LYM278 | A | 3 | 0.78102 | 0.00454 |
| LYM278 | A | 12 | 0.76569 | 0.00601 |
| LYM278 | A | 2 | 0.73983 | 0.00925 |
| LYM38 | A | 4 | 0.97624 | 0.00001 |
| LYM38 | A | 12 | 0.82191 | 0.00191 |
| LYM38 | A | 8 | 0.82190 | 0.00656 |
| LYM38 | A | 3 | 0.82153 | 0.00193 |
| LYM38 | A | 5 | 0.81079 | 0.00246 |
| LYM52 | B | 8 | 0.88462 | 0.00352 |
| LYM52 | A | 2 | 0.80812 | 0.00261 |
| LYM52 | A | 4 | 0.80802 | 0.00841 |
| LYM52 | A | 3 | 0.78340 | 0.01251 |
| LYM52 | A | 12 | 0.77364 | 0.01444 |
| LYM52 | A | 9 | 0.75221 | 0.01938 |
| LYM52 | A | 5 | 0.74914 | 0.02016 |
| LYM52 | A | 8 | 0.71086 | 0.03181 |
| LYM56 | A | 3 | 0.85797 | 0.00073 |
| LYM56 | A | 4 | 0.85130 | 0.00089 |
| LYM56 | A | 2 | 0.82071 | 0.00196 |
| LYM56 | A | 8 | 0.76236 | 0.01692 |
| LYM56 | A | 12 | 0.72510 | 0.01157 |
| LYM83 | A | 9 | 0.87556 | 0.00198 |
| LYM83 | A | 5 | 0.87005 | 0.00050 |
| LYM83 | A | 12 | 0.82187 | 0.00191 |
| LYM90 | C | 4 | 0.86848 | 0.00238 |
| LYM90 | C | 3 | 0.81261 | 0.00777 |
| LYM90 | C | 12 | 0.77921 | 0.01332 |
| LYM90 | C | 2 | 0.76512 | 0.01629 |
| LYM93 | A | 9 | 0.86630 | 0.00056 |
| LYM93 | A | 12 | 0.78696 | 0.00405 |
| LYM93 | A | 5 | 0.76542 | 0.00604 |
| LYM106 | A | 3 | 0.79483 | 0.01047 |
| LYM106 | A | 2 | 0.75674 | 0.01825 |
| LYM106 | C | 6 | 0.73962 | 0.03596 |
| LYM159 | C | 1 | 0.82807 | 0.00584 |
| LYM159 | B | 8 | 0.79356 | 0.01873 |
| LYM161 | C | 3 | 0.89287 | 0.00119 |
| LYM161 | C | 2 | 0.88206 | 0.00165 |
| LYM161 | A | 6 | 0.85373 | 0.00699 |
| LYM161 | C | 4 | 0.74623 | 0.02093 |
| LYM178 | C | 6 | 0.83756 | 0.00945 |
| LYM182 | A | 6 | 0.93567 | 0.00063 |
| LYM185 | C | 4 | 0.76455 | 0.01642 |
| LYM185 | A | 1 | 0.75952 | 0.01759 |
| LYM185 | A | 6 | 0.70292 | 0.01584 |

TABLE 8-continued

Correlation between the expression level of the selected polynucleotides of the invention and their homologues in specific tissues or developmental stages and the phenotypic performance across Barley ecotypes

| Gene Name | Expression Set | Correlation Vector | R | P |
|---|---|---|---|---|
| LYM186 | A | 6 | 0.86003 | 0.00616 |
| LYM188 | A | 6 | 0.82774 | 0.00166 |
| LYM188 | C | 2 | 0.73602 | 0.02377 |
| LYM188 | C | 3 | 0.71072 | 0.03186 |
| LYM194 | A | 2 | 0.89053 | 0.00024 |
| LYM194 | A | 3 | 0.82982 | 0.00157 |
| LYM289 | A | 9 | 0.77609 | 0.01394 |
| LYM289 | A | 5 | 0.77182 | 0.01483 |

Table 8. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.)] Corr. Vec. = correlation vector specified in Tables 5, 6 and 7; Exp. Set = expression set specified in Table 3.

Example 4

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

RNA extraction—Five tissues at different developmental stages including root, leaf, flower at anthesis, seed at 5 days after flowering (DAF) and seed at 12 DAF, representing different plant characteristics, were sampled and RNA was extracted as described in Example 3 above. For convenience, each micro-array expression information tissue type has received a Set ID as summarized in Table 9 below.

TABLE 9

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Table 9: Provided are the identification (ID) letters of each of the *Arabidopsis* expression sets (A-E). DAF = days after flowering.

Yield components and vigor related parameters assessment—eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula VII.

Relative growth rate of root coverage=Regression coefficient of root coverage along time course.   Formula VII:

Vegetative growth rate analysis—was calculated according to Formula VIII. The analysis was ended with the appearance of overlapping plants.

Relative vegetative growth rate area=Regression coefficient of vegetative area along time course.   Formula VIII For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula IX.

Seed Oil yield=Seed yield per plant (gr) * Oil % in seed    Formula IX:

Harvest Index (seed)—The harvest index was calculated using Formula IV (described above): Harvest Index=Average seed yield per plant/ Average dry weight.

Experimental Results

Nine different *Arabidopsis* ecotypes were grown and characterized for 18 parameters (named as vectors).

TABLE 10

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 10. Provided are the *Arabidopsis* correlated parameters (correlation ID Nos. 1-18). Abbreviations: Cm = centimeter(s); gr = gram(s); mg = milligram(s).

The characterized values are summarized in Tables 11 and 12 below.

TABLE 11

Measured parameters in *Arabidopsis* ecotypes

| Ecotype | 15 | 16 | 12 | 11 | 5 | 17 | 10 | 13 | 14 |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 11. Provided are the values of each of the parameters measured in *Arabidopsis* ecotypes: 15 = Seed yield per plant (gram); 16 = oil yield per plant (mg); 12 = oil % per seed; 11 = 1000 seed weight (gr); 5 = dry matter per plant (gr); 17 = harvest index; 10 = total leaf area per plant (cm); 13 = seeds per silique; 14 = Silique length (cm).

TABLE 12

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 12. Provided are the values of each of the parameters measured in *Arabidopsis* ecotypes: 6 = Vegetative growth rate ($cm^2$/day) until 8 true leaves; 3 = relative root growth (cm/day) (day 13); 2 = Root length day 7 (cm); 1 = Root length day 13 (cm); 4 = fresh weight per plant (gr) at bolting stage; 9 = Lamima length (cm); 8 = Lamina width (cm); 18 = Leaf width/length; 7 = Blade circularity.

Table 13, below, provides selected genes of some embodiments of the invention, the characterized parameters (which are used as x axis for correlation) and the correlated tissue transcriptom along with the correlation value (R, calculated using Pearson correlation). When the correlation coefficient (R) between the levels of a gene's expression in a certain tissue and a phenotypic performance across ecotypes is high in absolute value (between 0.5-1), there is an association between the gene (specifically the expression level of this gene) and the phenotypic character.

TABLE 13

Correlation between the expression level of selected genes in specific tissues or developmental stages and the phenotypic performance across *Arabidopsis* ecotypes

| Gene Name | Expression Set | Correlation Vector | R | P |
|---|---|---|---|---|
| LYM88 | E | 13 | 0.75035 | 0.03198 |
| LYM89 | D | 10 | 0.88062 | 0.00886 |
| LYM89 | D | 4 | 0.84712 | 0.01614 |
| LYM89 | A | 6 | 0.84690 | 0.00797 |
| LYM89 | D | 5 | 0.83715 | 0.01879 |
| LYM89 | D | 6 | 0.70174 | 0.07884 |
| LYM152 | E | 14 | 0.85500 | 0.00682 |

Table 13. Provided are the correlations between the expression level of yield improving genes and their homologs in specific tissues or developmental stages (expression sets) and the phenotypic performance (correlation vector) across *Arabidopsis* ecotypes. The phenotypic characters [correlation (Corr.) vector (Vec.)] include yield (seed yield, oil yield, oil content), biomass, growth rate and/or vigor components as described in Tables 10-12. Exp. Set = expression set according to Table 9 hereinabove.

Example 5

Production of *Arabidopsis* Transcriptom and High Throughput Correlation Analysis of Normal and Nitrogen Limiting Conditions Using 44K *Arabidopsis* Oligonucleotide Micro-Array In order to produce a high throughput correlation analysis, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol:// World Wide Web (dot) davidmlane (dot) com/hyperstat/ A34739 (dot) html].

Experimental Procedures

RNA extraction—Two tissues of plants [leaves and stems] growing at two different nitrogen fertilization levels (1.5 mM Nitrogen or 6 mM Nitrogen) were sampled and RNA was extracted as described in Examples 3 above. For convenience, each micro-array expression information tissue type has received a Set ID as summarized in Table 14 below.

TABLE 14

Tissues used for *Arabidopsis* transcriptom expression sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 14: Provided are the identification (ID) letters of each of the *Arabidopsis* expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5×Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 15, hereinbelow.

TABLE 15

*Arabidopsis* correlated parameters (vectors)

| Correlated parameter with | Correlation Id |
|---|---|
| N 1.5 mM; Rosette Area at day 8 [cm$^2$] | 1 |
| N 1.5 mM; Rosette Area at day 10 [cm$^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [cm$^2$] | 6 |
| N 1.5 mM; RGR of Rosette Area at day 3 [cm$^2$/day] | 7 |
| N 1.5 mM; t50 Flowering [day] | 8 |
| N 1.5 mM; Dry Weight [gr/plant] | 9 |
| N 1.5 mM; Seed Yield [gr/plant] | 10 |
| N 1.5 mM; Harvest Index | 11 |
| N 1.5 mM; 1000 Seeds weight [gr] | 12 |
| N 1.5 mM; seed yield/rosette area at day 10 [gr/cm$^2$] | 13 |
| N 1.5 mM; seed yield/leaf blade [gr/cm$^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr] | 17 |
| N 1.5 mM; DW/N level [gr/SPAD unit] | 18 |
| N 1.5 mM; seed yield/N level [gr/SPAD unit] | 19 |
| N 6 mM; Rosette Area at day 8 [cm$^2$] | 20 |
| N 6 mM; Rosette Area at day 10 [cm$^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [cm$^2$/gr] | 26 |
| N 6 mM; t50 Flowering [day] | 27 |
| N 6 mM; Dry Weight [gr/plant] | 28 |
| N 6 mM; Seed Yield [gr/plant] | 29 |
| N 6 mM; Harvest Index | 30 |
| N 6 mM; 1000 Seeds weight [gr] | 31 |
| N 6 mM; seed yield/rosette area day at day 10 [gr/cm$^2$] | 32 |
| N 6 mM; seed yield/leaf blade [gr/cm$^2$] | 33 |
| N 6 mM; N level/FW | 34 |
| N 6 mM; DW/N level [gr/SPAD unit] | 35 |
| N 6 mM; N level/DW (SPAD unit/gr plant) | 36 |
| N 6 mM; Seed yield/N unit [gr/SPAD unit] | 37 |

Table 15. Provided are the *Arabidopsis* correlated parameters (vectors). "N" = Nitrogen at the noted concentrations; "gr." = grams; "SPAD" = chlorophyll levels; "t50" = time where 50% of plants flowered; "gr/SPAD unit" = plant biomass expressed in grams per unit of nitrogen in plant measured by SPAD. "DW" = Plant Dry Weight; "FW" = Plant Fresh weight; "N level/DW" = plant Nitrogen level measured in SPAD unit per plant biomass [gr]; "DW/N level" = plant biomass per plant [gr]/SPAD unit; Rosette Area (measured using digital analysis); Plot Coverage at the indicated day [%] (calculated by the dividing the total plant area with the total plot area); Leaf Blade Area at the indicated day [cm$^2$] (measured using digital analysis); RGR (relative growth rate) of Rosette Area at the indicated day [cm$^2$/day]; t50 Flowering [day] (the day in which 50% of plant flower); seed yield/rosette area at day 10 [gr/cm$^2$] (calculated); seed yield/leaf blade [gr/cm$^2$] (calculated); seed yield/N level [gr/SPAD unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate of the rosette and the leaves was calculated according to Formulas XIV and XVII, respectively.

Seed yield and 1000 seeds weight—At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (seed)—The harvest index was calculated using Formula IV as described above [Harvest Index=Average seed yield per plant/ Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr]/SPAD unit], plant DW per nitrogen unit [DW/ N level=plant biomass per plant [g]/SPAD unit], and nitrogen level per gram of biomass [N level/DW=SPAD unit/ plant biomass per plant (gr)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software. Subsequent correlation analysis between the various transcriptom sets (Table 14) was conducted. Following are the results integrated to the database.

TABLE 16

Correlation between the expression level of selected genes of the invention and their homologs in tissues under limiting or normal nitrogen fertilization and the phenotypic performance across *Arabidopsis* ecotypes

| Gene Name | Expression Set | Correlation Vector | R | P |
| --- | --- | --- | --- | --- |
| LYM88 | C | 17 | 0.93533 | 0.01955 |
| LYM88 | D | 16 | 0.79502 | 0.01044 |
| LYM8_H1 | D | 31 | 0.745282 | 0.021184 |
| LYM10_H7 | C | 24 | 0.895562 | 0.000458 |
| LYM10_H7 | C | 5 | 0.77817 | 0.008026 |
| LYM10_H7 | C | 21 | 0.725922 | 0.017459 |
| LYM10_H7 | C | 2 | 0.717752 | 0.019423 |
| LYM10_H8 | C | 8 | 0.850748 | 0.001806 |
| LYM10_H8 | C | 27 | 0.7752 | 0.008432 |
| LYM10_H8 | C | 15 | 0.77175 | 0.008921 |
| LYM10_H9 | A | 1 | 0.844351 | 0.002119 |
| LYM10_H9 | A | 2 | 0.755723 | 0.01146 |
| LYM10_H9 | A | 20 | 0.733447 | 0.015776 |
| LYM10_H9 | A | 21 | 0.722114 | 0.018356 |
| LYM14_H2 | B | 27 | 0.892136 | 0.000519 |
| LYM14_H2 | B | 8 | 0.830273 | 0.002942 |
| LYM14_H2 | C | 8 | 0.816286 | 0.003967 |
| LYM14_H2 | C | 8 | 0.794197 | 0.006071 |
| LYM14_H2 | C | 27 | 0.767463 | 0.009557 |
| LYM14_H2 | C | 27 | 0.733255 | 0.015818 |
| LYM14_H2 | D | 1 | 0.725116 | 0.027066 |
| LYM14_H3 | B | 15 | 0.855842 | 0.001582 |
| LYM14_H3 | C | 8 | 0.802977 | 0.005158 |
| LYM14_H3 | B | 8 | 0.79811 | 0.005651 |
| LYM14_H3 | B | 12 | 0.792747 | 0.006233 |
| LYM14_H3 | B | 27 | 0.785721 | 0.007057 |
| LYM14_H3 | C | 27 | 0.734206 | 0.015613 |
| LYM14_H3 | A | 9 | 0.720081 | 0.018848 |
| LYM137_H11 | C | 20 | 0.815207 | 0.004055 |
| LYM137_H11 | C | 21 | 0.79814 | 0.005648 |
| LYM137_H11 | D | 5 | 0.754601 | 0.018779 |
| LYM137_H11 | C | 24 | 0.701843 | 0.023676 |
| LYM152_H1 | D | 5 | 0.714383 | 0.030592 |
| LYM152_H1 | D | 5 | 0.713442 | 0.030914 |
| LYM236_H4 | B | 27 | 0.937557 | 6.17E−05 |
| LYM236_H4 | B | 8 | 0.921247 | 0.000153 |
| LYM236_H4 | B | 15 | 0.865782 | 0.001204 |
| LYM236_H4 | B | 28 | 0.709595 | 0.02153 |
| LYM236_H5 | A | 10 | 0.737484 | 0.014922 |
| LYM236_H5 | B | 10 | 0.71158 | 0.021004 |

Table 16. Provided are the correlations (R) between the expression levels of yield improving genes and their homologs in tissues (leaves or stems) under limiting (1.5 mM Nitrogen) or normal (6 mM Nitrogen) conditions (Expression sets) and the phenotypic performance in various yield (seed yield, oil yield, oil content), biomass, growth rate and/or vigor components [Correlation (Corr.) vector (Vec.)] under limiting or normal Nitrogen conditions. Corr. Vec. = correlation vector according to Table 15 hereinabove; Exp. Set = expression set according to Table 14 hereinabove.

Example 6

Production of *Sorghum* Transcriptom and High Throughput Correlation Analysis with ABST Related Parametrers Using 44K *Sorghum* Oligonucleotide Micro-Arrays In order to produce a high throughput correlation analysis, the present inventors utilized a *Sorghum* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *Sorghum* genes and transcripts. In order to define correlations between the levels of RNA expression with ABST and yield components or vigor related parameters, various plant characteristics of 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotype Grown Under Severe Drought Conditions Experimental Procedures 17 *Sorghum* varieties were grown in 3 repetitive plots, in field. Briefly, the growing protocol was as follows: sorghum seeds were sown in soil and grown under normal condition until around 35 days from sowing, around V8 (Last leaf visible, but still rolled up, ear beginning to swell). At this point, irrigation was stopped, and severe drought stress was developed. In order to define correlations between the levels of RNA expression with drought, yield components or vigor related parameters, the 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

RNA extraction—All 10 selected *Sorghum* varieties were sample per each treatment. Plant tissues [Flag leaf, Flower meristem and Flower] growing under severe drought stress and plants grown under Normal conditions were sampled and RNA was extracted as described in Examples 3 above. For convenience, each micro-array expression information tissue type has received a Set ID as summarized in Table 17 below.

TABLE 17

*Sorghum* transcriptom expression sets

| Expression Set | Set ID |
| --- | --- |
| *Sorghum* field/Normal/flower meristem | 1 |
| *Sorghum* field/Normal/flower | 2 |
| *Sorghum* field/Normal/flag leaf | 3 |
| Drought Stress: Flag leaf | 4 |

Table 17: Provided are the *sorghum* transcriptom expression sets 1, 2, 3 and 4. Flag leaf = the leaf below the flower; Flower meristem = Apical meristem following panicle initiation; Flower = the flower at the anthesis day. Expression sets 1, 2 and 3 are from plants grown under normal conditions. Expression set 4 derived from plants grown under drought conditions.

The following parameters were collected using digital imaging system:

Average Grain Area ($cm^2$)—At the end of the growing period the grains were separated from the Plant 'Head'. A sample of ~200 grains were weight, photographed and images were processed using the below described image processing system. The grain area was measured from those images and was divided by the number of grains.

Average Grain Length (cm)—At the end of the growing period the grains were separated from the Plant 'Head'. A sample of ~200 grains were weight, photographed and images were processed using the below described image processing system. The sum of grain lengths (longest axis) was measured from those images and was divided by the number of grains.

Head Average Area ($cm^2$) At the end of the growing period 5 'Heads' were, photographed and images were processed using the below described image processing system. The 'Head' area was measured from those images and was divided by the number of 'Heads'.

Head Average Length (cm) At the end of the growing period 5 'Heads' were, photographed and images were processed using the below described image processing system. The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight/Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gr—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr based on plot) and for 5 (FW Head/Plant gr based on 5 plants).

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Relative Growth Rate was calculated using Formulas X and XI.

Relative growth rate of plant height=Regression coefficient of plant height along time course.    Formula X Relative growth rate of plant leaf number=Regression coefficient of plant leaf number along time course.    Formula XI SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative dry weight and Heads—At the end of the experiment (when Inflorescence were dry) all Inflorescence and vegetative material from plots within blocks A-C were collected. The biomass and Heads weight of each plot was separated, measured and divided by the number of Heads.

Dry weight=total weight of the vegetative portion above ground (excluding roots) after drying at 70° C. in oven for 48 hours;

Harvest Index (HI) (*Sorghum*)—The harvest index was calculated using Formula XII.

Harvest Index=Average grain dry weight per Head/
(Average vegetative dry weight per Head+Average Head dry weight)    Formula XII:

FW Heads/(FW Heads+FW Plants)—The total fresh weight of heads and their respective plant biomass were measured at the harvest day. The heads weight was divided by the sum of weights of heads and plants.

Experimental Results 16 different sorghum varieties were grown and characterized for different parameters: The average for each of the measured parameter was calculated using the JMP software (Tables 19-20) and a subsequent correlation analysis between the various transcriptom sets (Table 17) and the average parameters, was conducted (Tables 21). Results were then integrated to the database.

TABLE 18

*Sorghum* correlated parameters (vectors)

| Correlation Vector | Correlation Id |
|---|---|
| Average Seed Area cm2-normal | A |
| Average Seed Length cm-normal | B |
| FW/Plant gr based on plot-normal | C |
| FW Head/Plant gr based on 5 plants-normal | D |
| FW Head/Plant gr based on plot-normal | E |
| FW Heads/(FW Heads + FW Plants) based on plot-normal | F |
| Head Average Area cm2-normal | G |
| Head Average Length cm-normal | H |
| HI-normal | J |
| Leaf SPAD 64 Days Post Sowing-normal | K |
| Relative Growth Rate of Leaf Num-normal | L |
| Relative Growth Rate of Plant Height-normal | M |
| Total Seed Weight/Head gr based on plot-normal | N |
| Total Seed Weight/Head gr based on 5 heads-normal | O |

Table 18. Provided are the *Sorghum* correlated parameters (vectors). "gr." = grams; "SPAD" = chlorophyll levels; "FW" = Plant Fresh weight; "normal" = standard growth conditions.

TABLE 19

Measured parameters in *Sorghum* accessions

| Seed Id | A | B | C | D | E | F | G | H | J |
|---|---|---|---|---|---|---|---|---|---|
| 20 | 0.1047 | 0.3856 | 162.6 | 406.5 | 175.2 | 0.51 | 120.1 | 25.58 | 200.7 |
| 21 | 0.1124 | 0.4017 | 212.6 | 518 | 223.5 | 0.5101 | 167.6 | 26.84 | 127 |
| 22 | 0.1313 | 0.4446 | 334.8 | 148 | 56.4 | 0.1154 | 85.14 | 21.02 | 51.8 |
| 24 | 0.1293 | 0.4496 | 313.5 | 423 | 111.6 | 0.2626 | 157.3 | 26.84 | 122.4 |
| 25 | | | | | | 0.1204 | | | 54.53 |
| 26 | | | | | | 0.177 | | | 93.92 |
| 27 | 0.1098 | 0.3999 | 151.1 | 423.5 | 126.2 | 0.4591 | 168.5 | 31.33 | 327.3 |
| 28 | 0.1134 | 0.4054 | 137.6 | 386.5 | 107.7 | 0.4316 | 109.3 | 23.18 | 231.5 |
| 29 | 0.1022 | 0.3837 | 168 | 409.5 | 123.9 | 0.4249 | 135.1 | 25.7 | 241.4 |
| 30 | 0.118 | 0.4186 | 129 | 328.9 | 102.8 | 0.4416 | 169 | 28.82 | 304.1 |
| 31 | 0.1205 | 0.4302 | 97.62 | 391 | 82.33 | 0.4581 | 156.1 | 28.13 | 335.6 |
| 32 | 0.1106 | 0.4003 | 99.32 | 435.8 | 77.59 | 0.4473 | 112.1 | 22.97 | 349.6 |
| 33 | 0.1165 | 0.4094 | 112.2 | 429.5 | 91.17 | 0.4474 | 154.7 | 28.09 | 293.2 |
| 34 | 0.108 | 0.4008 | 157.4 | 441 | 150.4 | 0.5134 | 171.7 | 30 | 410.9 |
| 35 | 0.1048 | 0.3947 | 130.5 | 415.8 | 109.1 | 0.4595 | 168.5 | 30.54 | 285.1 |

TABLE 19-continued

Measured parameters in *Sorghum* accessions

| Seed Id | A | B | C | D | E | F | G | H | J |
|---|---|---|---|---|---|---|---|---|---|
| 36 | 0.1097 | 0.3953 | 135.7 | 429.5 | 107.6 | 0.4425 | 162.5 | 27.17 | 282.7 |
| 37 | 0.1053 | 0.3924 | 209.2 | 428.5 | 130.9 | 0.3856 | 170.5 | 29.26 | 204 |

Table 19: Provided are the values of each of the parameters (as described above) measured in *Sorghum* accessions (Seed ID) under normal and drought conditions. Growth conditions are specified in the experimental procedure section.

TABLE 20

Additional measured parameters in *Sorghum* accessions

| Seed Id | L | M | N | O |
|---|---|---|---|---|
| 20 | 0.1032 | 1.891 | 31.12 | 47.4 |
| 21 |  | 1.622 | 26.35 | 46.3 |
| 22 | 0.2128 | 3.418 | 18.72 | 28.37 |
| 24 | 0.1862 | 2.425 | 38.38 | 70.4 |
| 25 | 0.1898 | 3.118 |  |  |
| 26 | 0.1599 | 3.323 |  |  |
| 27 | 0.1957 | 2.178 | 47.67 | 63.45 |
| 28 | 0.1694 | 2.188 | 31 | 44.45 |
| 29 | 0.1821 | 2.572 | 39.99 | 56.65 |
| 30 |  | 2.046 | 38.36 | 60 |
| 31 |  | 2.069 | 32.1 | 45.45 |
| 32 | 0.1754 | 2.547 | 32.69 | 58.19 |
| 33 | 0.117 | 2.327 | 32.79 | 70.6 |
| 34 | 0.207 | 3.039 | 51.53 | 70.1 |
| 35 | 0.1859 | 2.335 | 35.71 | 53.95 |
| 36 | 0.151 | 2.516 | 38.31 | 59.87 |
| 37 | 0.24 | 2.81 | 42.44 | 52.65 |

Table 20: Provided are the values of each of the parameters (as described above) measured in *Sorghum* accessions (Seed ID) under normal and drought conditions. Growth conditions are specified in the experimental procedure section.

TABLE 21

Correlation between the expression level of selected genes of some embodiments of the invention in various tissues and the phenotypic performance under normal or abiotic stress conditions across *Sorghum* accessions

| Gene Name | Cluster Name | Exp. Set | Corr. Vec. | R | P |
|---|---|---|---|---|---|
| LYM174 | sorghum\|gb161.crp\|AW284303 | 1 | J | 0.746 | 0.013251 |
| LYM263 | sorghum\|gb161.crp\|AI622410 | 2 | O | 0.860 | 0.00292 |
| LYM263 | sorghum\|gb161.crp\|AI622410 | 2 | J | 0.847 | 0.00196 |
| LYM5 H21 | sorghum\|09v1\|SB04G031180 | 1 | B | 0.898 | 0.00101 |
| LYM5 H21 | sorghum\|09v1\|SB04G031180 | 1 | A | 0.896 | 0.00107 |
| LYM8 H23 | sorghum\|09v1\|SB01G000490 | 1 | O | 0.755 | 0.018718 |
| LYM8 H23 | sorghum\|09v1\|SB01G000490 | 2 | O | 0.714 | 0.030884 |
| LYM10 H272 | sorghum\|09v1\|SB04G005280 | 3 | L | 0.756 | 0.029952 |
| LYM14 H44 | sorghum\|09v1\|SB02G044050 | 2 | E | 0.769 | 0.015504 |
| LYM24 H10 | sorghum\|09v1\|SB03G044280 | 2 | C | 0.774 | 0.014343 |
| LYM24 H10 | sorghum\|09v1\|SB03G044280 | 3 | B | 0.743 | 0.021898 |
| LYM24 H10 | sorghum\|09v1\|SB03G044280 | 3 | A | 0.728 | 0.026226 |
| LYM35 H7 | sorghum\|09v1\|SB06G031730 | 2 | E | 0.823 | 0.006385 |
| LYM73 H8 | sorghum\|09v1\|SB07G004300 | 1 | E | 0.748 | 0.02039 |
| LYM82 H16 | sorghum\|09v1\|SB10G002420 | 3 | J | 0.783 | 0.007439 |
| LYM82 H16 | sorghum\|09v1\|SB10G002420 | 3 | N | 0.780 | 0.013111 |
| LYM82 H16 | sorghum\|09v1\|SB10G002420 | 3 | O | 0.726 | 0.02673 |
| LYM82 H16 | sorghum\|09v1\|SB10G002420 | 3 | G | 0.723 | 0.027818 |
| LYM111 H10 | sorghum\|09v1\|SB03G036350 | 3 | C | 0.892 | 0.00122 |
| LYM111 H10 | sorghum\|09v1\|SB03G036350 | 3 | A | 0.753 | 0.019062 |
| LYM111 H10 | sorghum\|09v1\|SB03G036350 | 3 | B | 0.702 | 0.035192 |
| LYM119 H1 | sorghum\|09v1\|SB05G003680 | 2 | C | 0.759 | 0.017691 |
| LYM131 H19 | sorghum\|09v1\|SB06G027970 | 1 | E | 0.841 | 0.004488 |
| LYM131 H19 | sorghum\|09v1\|SB06G027970 | 3 | B | 0.787 | 0.011775 |
| LYM131 H19 | sorghum\|09v1\|SB06G027970 | 3 | A | 0.762 | 0.017013 |
| LYM131 H19 | sorghum\|09v1\|SB06G027970 | 1 | F | 0.700 | 0.024184 |
| LYM131 H20 | sorghum\|09v1\|SB07G006320 | 1 | E | 0.854 | 0.003353 |
| LYM137 H285 | sorghum\|09v1\|SB06G021660 | 2 | F | 0.747 | 0.013056 |
| LYM137 H285 | sorghum\|09v1\|SB06G021660 | 1 | E | 0.716 | 0.030132 |
| LYM137 H286 | sorghum\|09v1\|SB10G005240 | 1 | E | 0.786 | 0.012037 |
| LYM140 H27 | sorghum\|09v1\|SB06G028990 | 1 | C | 0.772 | 0.014832 |
| LYM148 H14 | sorghum\|09v1\|SB10G026570 | 1 | B | 0.812 | 0.007885 |
| LYM148 H14 | sorghum\|09v1\|SB10G026570 | 1 | A | 0.770 | 0.015311 |
| LYM148 H14 | sorghum\|09v1\|SB10G026570 | 1 | C | 0.768 | 0.015705 |
| LYM162 H7 | sorghum\|09v1\|SB03G043995 | 1 | N | 0.837 | 0.004911 |
| LYM215 H2 | sorghum\|09v1\|SB03G043980 | 1 | N | 0.718 | 0.029262 |
| LYM178 H13 | sorghum\|09v1\|SB03G008890 | 3 | B | 0.862 | 0.002833 |
| LYM178 H13 | sorghum\|09v1\|SB03G008890 | 3 | A | 0.792 | 0.010892 |
| LYM178 H14 | sorghum\|09v1\|SB07G001060 | 2 | A | 0.768 | 0.01572 |
| LYM179 H0 | sorghum\|09v1\|SB08G006470 | 1 | O | 0.818 | 0.006992 |
| LYM109 H2 | sorghum\|09v1\|SB05G003660 | 1 | B | 0.762 | 0.017077 |

TABLE 21-continued

Correlation between the expression level of selected genes of some embodiments of the invention in various tissues and the phenotypic performance under normal or abiotic stress conditions across Sorghum accessions

| Gene Name | Cluster Name | Exp. Set | Corr. Vec. | R | P |
|---|---|---|---|---|---|
| LYM109 H2 | sorghum\|09v1\|SB05G003660 | 3 | A | 0.751 | 0.019579 |
| LYM109 H2 | sorghum\|09v1\|SB05G003660 | 1 | A | 0.732 | 0.025074 |
| LYM112 H2 | sorghum\|09v1\|SB02G039985 | 1 | B | 0.827 | 0.005944 |
| LYM112 H2 | sorghum\|09v1\|SB02G039985 | 3 | B | 0.790 | 0.011246 |
| LYM112 H2 | sorghum\|09v1\|SB02G039985 | 1 | A | 0.789 | 0.011426 |
| LYM112 H2 | sorghum\|09v1\|SB02G039985 | 3 | A | 0.701 | 0.035452 |
| LYM123 H7 | sorghum\|09v1\|SB06G031680 | 1 | B | 0.769 | 0.015524 |
| LYM181 H6 | sorghum\|09v1\|SB02G034110 | 1 | B | 0.740 | 0.022556 |
| LYM181 H6 | sorghum\|09v1\|SB02G034110 | 3 | N | 0.724 | 0.027264 |
| LYM181 H6 | sorghum\|09v1\|SB02G034110 | 3 | O | 0.702 | 0.035114 |
| LYM182 H12 | sorghum\|09v1\|SB06G015280 | 1 | E | 0.767 | 0.015834 |
| LYM206 H2 | sorghum\|09v1\|SB07G021090 | 3 | N | 0.795 | 0.010488 |
| LYM188 H13 | sorghum\|09v1\|SB01G007950 | 1 | E | 0.788 | 0.011658 |
| LYM198 H1 | sorghum\|09v1\|SB01G045460 | 1 | E | 0.829 | 0.005689 |
| LYM201 H37 | sorghum\|09v1\|SB04G022350 | 2 | N | 0.741 | 0.022246 |
| LYM201 H37 | sorghum\|09v1\|SB04G022350 | 2 | D | 0.709 | 0.032326 |
| LYM201 H37 | sorghum\|09v1\|SB04G022350 | 2 | H | 0.701 | 0.035468 |
| LYM207 H3 | sorghum\|09v1\|SB06G023870 | 3 | K | 0.781 | 0.007669 |
| LYM207 H3 | sorghum\|09v1\|SB06G023870 | 1 | E | 0.768 | 0.015595 |
| LYM207 H3 | sorghum\|09v1\|SB06G023870 | 3 | O | 0.718 | 0.029344 |
| LYM207 H3 | sorghum\|09v1\|SB06G023870 | 1 | N | 0.716 | 0.02988 |
| LYM208 H8 | sorghum\|09v1\|SB01G032070 | 1 | N | 0.734 | 0.024302 |
| LYM208 H8 | sorghum\|09v1\|SB01G032070 | 1 | E | 0.701 | 0.03525 |
| LYM212 H9 | sorghum\|09v1\|SB01G045480 | 1 | E | 0.841 | 0.004537 |
| LYM221 H3 | sorghum\|09v1\|SB01G034610 | 2 | A | 0.728 | 0.02604 |
| LYM221 H3 | sorghum\|09v1\|SB01G034610 | 2 | C | 0.721 | 0.028264 |
| LYM224 H3 | sorghum\|09v1\|SB02G040000 | 3 | C | 0.835 | 0.005096 |
| LYM224 H3 | sorghum\|09v1\|SB02G040000 | 3 | L | 0.827 | 0.011397 |
| LYM224 H3 | sorghum\|09v1\|SB02G040000 | 3 | M | 0.708 | 0.021888 |
| LYM232 H3 | sorghum\|09v1\|SB02G000450 | 1 | O | 0.808 | 0.00839 |
| LYM232 H3 | sorghum\|09v1\|SB02G000450 | 1 | N | 0.759 | 0.017814 |
| LYM236 H139 | sorghum\|09v1\|SB09G029110 | 1 | A | 0.859 | 0.00303 |
| LYM236 H139 | sorghum\|09v1\|SB09G029110 | 1 | B | 0.836 | 0.004971 |
| LYM248 H5 | sorghum\|09v1\|SB04G000645 | 3 | L | 0.878 | 0.004118 |
| LYM248 H5 | sorghum\|09v1\|SB04G000645 | 1 | N | 0.868 | 0.002424 |
| LYM183 H11 | sorghum\|09v1\|SB01G003070 | 1 | E | 0.832 | 0.005437 |
| LYM183 H11 | sorghum\|09v1\|SB01G003070 | 1 | N | 0.749 | 0.020124 |
| LYM267 H1 | sorghum\|09v1\|SB01G044240 | 2 | A | 0.797 | 0.010102 |
| LYM267 H1 | sorghum\|09v1\|SB01G044240 | 2 | B | 0.753 | 0.019206 |
| LYM267 H1 | sorghum\|09v1\|SB01G044240 | 1 | H | 0.707 | 0.033248 |
| LYM267 H1 | sorghum\|09v1\|SB01G044240 | 1 | O | 0.705 | 0.033872 |
| LYM267 H1 | sorghum\|09v1\|SB01G044240 | 1 | N | 0.705 | 0.033976 |
| LYM270 H0 | sorghum\|09v1\|SB02G040045 | 1 | E | 0.820 | 0.006742 |
| LYM271 H10 | sorghum\|09v1\|SB02G040020 | 1 | N | 0.780 | 0.013152 |
| LYM273 H6 | sorghum\|09v1\|SB03G044410 | 3 | B | 0.955 | 5.91E-05 |
| LYM273 H6 | sorghum\|09v1\|SB03G044410 | 3 | A | 0.950 | 8.6E-05 |
| LYM284 H24 | sorghum\|09v1\|SB03G027960 | 1 | E | 0.867 | 0.00247 |
| LYM289 H52 | sorghum\|09v1\|SB09G005410 | 3 | O | 0.928 | 0.000307 |
| LYM289 H52 | sorghum\|09v1\|SB09G005410 | 3 | N | 0.830 | 0.005588 |
| LYM289 H52 | sorghum\|09v1\|SB09G005410 | 3 | H | 0.781 | 0.012924 |
| LYM289 H52 | sorghum\|09v1\|SB09G005410 | 3 | G | 0.714 | 0.03066 |
| LYM289 H52 | sorghum\|09v1\|SB09G005410 | 3 | D | 0.704 | 0.03412 |
| LYM290 H13 | sorghum\|09v1\|SB01G009390 | 1 | E | 0.766 | 0.01617 |

Table 21. Provided are the correlations (R) between the expression levels of yield improving genes and their homologs in tissues (Flag leaf, Flower meristem and Flower; Expression (Exp.) sets) and the phenotypic performance in various yield, biomass, growth rate and/or vigor components [Correlation (Corr.) vector (Vec.)] under stress conditions or normal conditions across Sorghum accessions.

Sorghum vigor related parameters under 100 mM NaCl and low temperature (10±2° C.)—Ten Sorghum varieties were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

RNA extraction—All 10 selected Sorghum varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described in Example 3 above.

TABLE 22

Sorghum transcriptom expression sets

| Expression Set | Set ID |
|---|---|
| Sorghum roots under cold | 1 |
| Sorghum vegetative meristem NaCl | 2 |
| Sorghum vegetative meristem under low nitrogen | 3 |
| Sorghum vegetative meristem under cold conditions | 4 |
| Sorghum roots under NaCl | 5 |
| Sorghum vegetative meristem under normal conditions | 6 |
| Sorghum roots under low nitrogen | 7 |
| Sorghum roots under normal | 8 |

Table 22: Provided are the Sorghum transcriptom expression sets. Cold conditions = 10 ± 2° C.; NaCl = 100 mM NaCl; low nitrogen = 1.2 mM Nitrogen; Normal conditions = 16 mM Nitrogen.

Experimental Results 10 different Sorghum varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameter was calculated using the JMP software and values are summarized in Table 24 below. Subsequent correlation analysis between the various transcriptom sets and the average parameters were conducted (Table 25). Results were then integrated to the database.

TABLE 23

Sorghum correlated parameters (vectors)

| Correlation Vector | Corr. Id |
|---|---|
| DW Root/Plant - Cold | A |
| DW Root/Plant - 100 mM NaCl | B |
| DW Shoot/Plant - Low Nitrogen | C |
| DW Root/Plant - Low Nitrogen | D |
| Leaf number TP-3* - Cold | E |
| Leaf number TP-3* - 100 mM NaCl | F |
| Plant Height TP-3* - 100 mM NaCl | G |
| DW Shoot/Plant - Cold | H |
| DW Shoot/Plant - Normal | I |
| Plant Height TP-3* - Low Nitrogen | J |
| Leaf number TP-3* - Low Nitrogen | K |
| DW Shoot/Plant - 100 mM NaCl | L |
| Leaf number TP-3* - Normal | M |

Table 23: Provided are the Sorghum correlated parameters. Cold conditions = 10 ± 2° C.; NaCl = 100 mM NaCl; low nitrogen = 1.2 mM Nitrogen; Normal conditions = 16 mM Nitrogen *TP-3 refers to time point 3.

TABLE 24

Sorghum accessions, measured parameters

| Seed ID | F | B | L | G | E | A | H | M | I |
|---|---|---|---|---|---|---|---|---|---|
| 20 | 3.67 | 0.35 | 0.66 | 14.63 | 3.88 | 0.83 | 1.03 | 4.17 | 0.81 |
| 22 | 3.88 | 1.45 | 2.43 | 16.31 | 4.16 | 0.95 | 1.34 | 4.48 | 1.89 |
| 26 | 4.28 | 1.49 | 2.40 | 20.56 | 4.52 | 1.47 | 1.71 | 4.93 | 2.51 |
| 27 | 4.03 | 0.81 | 1.61 | 14.70 | 4.28 | 1.06 | 1.28 | 4.53 | 1.26 |
| 28 | 3.97 | 1.03 | 1.77 | 16.43 | 4.33 | 0.71 | 1.12 | 4.52 | 1.55 |
| 29 | 3.98 | 0.95 | 1.66 | 16.12 | 4.17 | 1.38 | 1.69 | 4.64 | 1.50 |
| 30 | 3.90 | 2.00 | 2.23 | 15.61 | 3.94 | 2.04 | 2.24 | 4.49 | 1.93 |
| 31 | 4.18 | 1.39 | 2.76 | 18.71 | 4.26 | 1.03 | 1.26 | 4.79 | 1.95 |
| 34 | 3.70 | 1.29 | 1.29 | 13.65 | 4.20 | 1.01 | 1.08 | 4.37 | 1.48 |
| 37 | 3.82 | 1.76 | 1.55 | 15.72 | 4.04 | 1.01 | 1.02 | 4.54 | 1.85 |

Table 24: Provided are the measured parameters under 100 mM NaCl and low temperature (8-10° C.) conditions of Sorghum accessions (Seed ID) according to the Correlation ID numbers (described in Table 23 above) as follows: F [100 mM NaCl: leaf Number]; B [100 mM NaCl: Root DW]; L [100 mM NaCl: Shoot DW]; G [100 mM NaCl: Plant height]; E [low temperature: leaf Number]; A [low temperature: Root DW]; H [low temperature: Shoot DW];; M [Normal: leaf Number]; I [Normal: Shoot DW].

TABLE 25

Correlation between the expression level of selected genes of some embodiments of the invention in roots and the phenotypic performance under normal or abiotic stress conditions across Sorghum accessions

| Gene Name | Cluster Id | Exp. Set | Corr. Vec. | R | P |
|---|---|---|---|---|---|
| LYM263 | sorghum\|gb161.crp\|AI622410 | 5 | G | 0.705635 | 0.183016 |
| LYM263 | sorghum\|gb161.crp\|AI622410 | 5 | F | 0.908761 | 0.032626 |
| LYM263 | sorghum\|gb161.crp\|AI622410 | 8 | I | 0.836212 | 0.004969 |
| LYM2 H8 | sorghum\|09v1\|SB07G004285 | 1 | A | 0.73969 | 0.01447 |
| LYM4 H11 | sorghum\|09v1\|SB03G000920 | 2 | B | 0.83675 | 0.00491 |
| LYM4 H11 | sorghum\|09v1\|SB03G000920 | 2 | B | 0.73187 | 0.02499 |
| LYM4 H11 | sorghum\|09v1\|SB03G000920 | 4 | E | 0.70634 | 0.03342 |
| LYM14 H43 | sorghum\|09v1\|SB01G038730 | 1 | A | 0.71433 | 0.02029 |
| LYM19 H12 | sorghum\|09v1\|SB05G009990 | 5 | F | 0.97628 | 0.00437 |
| LYM19 H12 | sorghum\|09v1\|SB05G009990 | 5 | G | 0.88580 | 0.04552 |
| LYM24 H10 | sorghum\|09v1\|SB03G044280 | 4 | H | 0.75256 | 0.01929 |
| LYM24 H10 | sorghum\|09v1\|SB03G044280 | 4 | H | 0.74948 | 0.02008 |
| LYM73 H8 | sorghum\|09v1\|SB07G004300 | 5 | F | 0.97233 | 0.00550 |
| LYM73 H8 | sorghum\|09v1\|SB07G004300 | 5 | F | 0.92449 | 0.02462 |
| LYM73 H8 | sorghum\|09v1\|SB07G004300 | 4 | E | 0.73646 | 0.02364 |
| LYM83 H12 | sorghum\|09v1\|SB09G026370 | 2 | F | 0.70736 | 0.03305 |
| LYM129 H4 | sorghum\|09v1\|SB03G044510 | 1 | E | 0.72429 | 0.01784 |
| LYM129 H4 | sorghum\|09v1\|SB03G044510 | 2 | F | 0.72339 | 0.02761 |
| LYM129 H4 | sorghum\|09v1\|SB03G044510 | 6 | I | 0.71891 | 0.02907 |
| LYM129 H4 | sorghum\|09v1\|SB03G044510 | 6 | I | 0.71123 | 0.03168 |
| LYM129 H4 | sorghum\|09v1\|SB03G044510 | 2 | F | 0.70792 | 0.03285 |
| LYM140 H27 | sorghum\|09v1\|SB06G028990 | 2 | G | 0.80589 | 0.00873 |
| LYM140 H27 | sorghum\|09v1\|SB06G028990 | 2 | F | 0.78965 | 0.01136 |
| LYM140 H27 | sorghum\|09v1\|SB06G028990 | 6 | I | 0.71625 | 0.02996 |
| LYM153 H9 | sorghum\|09v1\|SB10G003440 | 4 | H | 0.78966 | 0.01136 |
| LYM153 H9 | sorghum\|09v1\|SB10G003440 | 4 | H | 0.73143 | 0.02512 |
| LYM153 H9 | sorghum\|09v1\|SB10G003440 | 4 | A | 0.71026 | 0.03202 |

TABLE 25-continued

Correlation between the expression level of selected genes of some embodiments of the invention in roots and the phenotypic performance under normal or abiotic stress conditions across *Sorghum* accessions

| Gene Name | Cluster Id | Exp. Set | Corr. Vec. | R | P |
|---|---|---|---|---|---|
| LYM115 H0 | sorghum\|09v1\|SB01G043900 | 2 | F | 0.74903 | 0.02019 |
| LYM188 H13 | sorghum\|09v1\|SB01G007950 | 5 | F | 0.87882 | 0.04971 |
| LYM203 H14 | sorghum\|09v1\|SB04G005460 | 2 | B | 0.78001 | 0.01316 |
| LYM217 H3 | sorghum\|09v1\|SB01G043910 | 5 | B | 0.94269 | 0.01633 |
| LYM217 H3 | sorghum\|09v1\|SB01G043910 | 5 | B | 0.93691 | 0.01884 |
| LYM228 H1 | sorghum\|09v1\|SB09G006910 | 1 | A | 0.72334 | 0.01806 |
| LYM232 H3 | sorghum\|09v1\|SB02G000450 | 2 | L | 0.77653 | 0.01385 |
| LYM232 H3 | sorghum\|09v1\|SB02G000450 | 2 | F | 0.72326 | 0.02766 |
| LYM240 H12 | sorghum\|09v1\|SB02G038240 | 4 | H | 0.76382 | 0.01659 |
| LYM240 H12 | sorghum\|09v1\|SB02G038240 | 2 | L | 0.73895 | 0.02293 |
| LYM251 H106 | sorghum\|09v1\|SB01G006180 | 5 | F | 0.95275 | 0.01224 |
| LYM284 H24 | sorghum\|09v1\|SB03G027960 | 6 | M | 0.76300 | 0.01677 |
| LYM289 H53 | sorghum\|09v1\|SB10G002980 | 5 | G | 0.91500 | 0.02936 |

Table 25. Provided are the correlations (R) between the expression levels yield improving genes and their homologs in various tissues [Expression (Exp.) sets] and the phenotypic performance [yield, biomass, growth rate and/or vigor components (Correlation vector)] under abiotic stress conditions (salinity) or normal conditions across *sorghum* accessions. Corr. Vec. = correlation vector as described hereinabove (Table 23).

Example 7

Gene Cloning and Generation of Binary Vectors for Plant Expression

To validate their role in improving oil content, plant yield, seed yield, biomass, fiber yield and/or quality, growth rate, ABST, NUE and/or vigor, selected genes were over-expressed in plants, as follows.

Cloning Strategy

Genes listed in Examples 1-6 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal conditions. Total RNA was extracted as described in Example 3 above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products were purified using PCR purification kit (Qiagen). In case where the entire coding sequence was not found, RACE kit from Invitrogen (RACE=R apid A ccess to cDNA E nds) was used to access the full cDNA transcript of the gene from the RNA samples described above.

In case genomic DNA was cloned, as in the case of LYM122 (SEQ ID NO:3739) and LYM273 (SEQ ID NO:3738), the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction did not result in a satisfactory product for sequencing), an additional primer (or two) of the nested PCR primers were used. Table 26 below provides primers used for cloning of selected genes.

TABLE 26

The PCR primers used for cloning the genes of some embodiments of the invention into high copy vectors

| Gene Name | Restriction Enzymes used for cloning | Primers used for amplification |
|---|---|---|
| LYM1 | SalI, XbaI | LYM1_NF_SalI (SEQ ID NO: 3740) AAAGTCGACAGTAGGCAATCATGTGTGAGG LYM1_NR_XbaI (SEQ ID NO: 3741) AATTCTAGACTAAGCTAGAGAGCTCGACTAATGC |
| LYM10 | XhoI, KpnI | LYM10 NF XhoI (SEQ ID NO: 3742) ATACTCGAGTCTCCAACCTTGCGAAGG LYM10 EF XhoI (SEQ ID NO: 3743) ATACTCGAGAACCCGATCTCTCCAACC LYM10 NR KpnI (SEQ ID NO: 3744) TATGGTACCCCTGCGAATTCTTGCCTTAG LYM10 ER KpnI (SEQ ID NO: 3745) TATGGTACCTGACGCCACCCTCAACTC |

TABLE 26-continued

The PCR primers used for cloning the genes of some embodiments of the invention into high copy vectors

| Gene Name | Restriction Enzymes used for cloning | Primers used for amplification |
|---|---|---|
| LYM100 | SalI, XbaI | LYM100_NF_SalI (SEQ ID NO: 3746)<br>AAAGTCGACAGGAAACCCTAACGAAGATACC<br>LYM100_EF_SalI (SEQ ID NO: 3747)<br>AAAGTCGACGGAAACATACAGGTCGATTGAG<br>LYM100_NR_XbaI (SEQ ID NO: 3748)<br>AAATCTAGAGGGAAAGTTTAGTAGCACCAAC<br>LYM100_ER_XbaI (SEQ ID NO: 3749)<br>AAATCTAGAATATAACGTTAGAGCGGAGTGG |
| LYM102 | BamHI, XhoI | LYM102_NF_BamHI (SEQ ID NO: 3750)<br>AAAGGATCCGAGCTGCTGATTGTGAGTCAAG<br>LYM102_NR_XhoI (SEQ ID NO: 3751)<br>AAACTCGAGCTAGGACAGCACTTCAGATAAGACC |
| LYM103 | BamHI, XhoI | LYM103_NF_BamHI (SEQ ID NO: 3752)<br>AAAGGATCCCGACCGAGTCAATCAATCC<br>LYM103_NR_XhoI (SEQ ID NO: 3753)<br>AAACTCGAGAACAAGTATGACAGGCCAACTC |
| LYM105 | BamHI, XhoI | LYM105_NF_BamHI (SEQ ID NO: 3754)<br>AAAGGATCCTAGCTAGCTTACTCCACAGTGC<br>LYM105_EF_BamHI (SEQ ID NO: 3755)<br>AAAGGATCCAGCCACACGCTTAGCTTAGC<br>LYM105_NR_XhoI (SEQ ID NO: 3756)<br>AAACTCGAGCGAGCAGAAATTAACAGCTAAC<br>LYM105_ER_XhoI (SEQ ID NO: 3757)<br>AAACTCGAGACTACAGATCCAAAGCACGAAC |
| LYM106 | SalI, XbaI | LYM106_NF_SalI (SEQ ID NO: 3758)<br>AAAGTCGACACTCAACGTAGTTCCTCACCTG<br>LYM106_NR_XbaI (SEQ ID NO: 3759)<br>AAATCTAGAAAGCTTTAGTTCTAGCACACGAC |
| LYM107 | BamHI, XhoI | LYM107_NF_BamHI (SEQ ID NO: 3760)<br>AAAGGATCCGTACTCCTATATTAGGCTCGCTC<br>LYM107_EF_BamHI (SEQ ID NO: 3761)<br>AAAGGATCCCTGCGTACTCCTATATTAGGCTC<br>LYM107_NR_XhoI (SEQ ID NO: 3762)<br>AAACTCGAGAATTTGGTATCAGAAACCTTGC<br>LYM107_ER_XhoI (SEQ ID NO: 3763)<br>AATCTCGAGTGAATCACTCAGTGTGCATGAC |
| LYM109 | XhoI, StuI | LYM109_F2_XhoI (SEQ ID NO: 3764)<br>AAACTCGAGCCCAGCGGACTCCTACTCTG<br>LYM109_F2_XhoI (SEQ ID NO: 3764)<br>AAACTCGAGCCCAGCGGACTCCTACTCTG<br>LYM109_R2_StuI (SEQ ID NO: 3765)<br>TTTAGGCCTTCACAGTCTTACAAGTCCGATTGCC<br>LYM109_R2_StuI (SEQ ID NO: 3765)<br>TTTAGGCCTTCACAGTCTTACAAGTCCGATTGCC |
| LYM110 | BamHI, XhoI | LYM110_NF_BamHI (SEQ ID NO: 3766)<br>AAAGGATCCGAACCAAACCTCGGAGAAAC<br>LYM110_NR_XhoI (SEQ ID NO: 3767)<br>AAACTCGAGACCATCACCTGTAATACAACTACC |
| LYM111 | XhoI, SacI | LYM111_NF_XhoI (SEQ ID NO: 3768)<br>AAACTCGAGGAATCTGGTTGCTCATCTCATC<br>LYM111_EF_XhoI (SEQ ID NO: 3769)<br>AAACTCGAGCTTCACAACGGACGAGAGG<br>LYM111_NR_SacI (SEQ ID NO: 3770)<br>AAAGAGCTCATAATCGTTGGAACTTGGAATC<br>LYM111_ER_SacI (SEQ ID NO: 3771)<br>AAAGAGCTCACAGCTTATCCCTACATGCTTC |
| LYM112 | BamHI, XhoI | LYM112_NF_BamHI (SEQ ID NO: 3772)<br>AAAGGATCCTCAATTGAATCAGATGCTCCAC<br>LYM112_EF_BamHI (SEQ ID NO: 3773)<br>AAAGGATCCATTCCTTTGACCGATTTCTTG<br>LYM112_NR_XhoI (SEQ ID NO: 3774)<br>AAACTCGAGCTAATTAAGACAAATCAGTGGCACC<br>LYM112_ER_XhoI (SEQ ID NO: 3775)<br>AAACTCGAGACAGAAGGTCGATGTTGATCTG |

TABLE 26-continued

The PCR primers used for cloning the genes of some
embodiments of the invention into high copy vectors

| Gene Name | Restriction Enzymes used for cloning | Primers used for amplification |
|---|---|---|
| LYM113 | SalI, XbaI | LYM113_NF_SalI (SEQ ID NO: 3776) AAAGTCGACTTCTTGATCTAAATTTGGGTGG LYM113_EF_SalI (SEQ ID NO: 3777) AAAGTCGACACTAGCTCTGCACTTTCCCTG LYM113_NR_XbaI (SEQ ID NO: 3778) AAATCTAGAGATTCAAGTGCGTTGTCTGTC LYM113_ER_XbaI (SEQ ID NO: 3779) AAATCTAGACTTGGTATTTACAGGACAATCG |
| LYM115 | BamHI, XhoI | LYM115_F_BamHI (SEQ ID NO: 3780) AAAGGATCCTCGCCGCAGATGGAAGTCT LYM115_ER_XhoI (SEQ ID NO: 3781) TTTCTCGAGCAAACTCGTCTGGAGATGGG |
| LYM116 | SalI, XbaI | LYM116_EF_SalI (SEQ ID NO: 3782) AAAGTCGACTTGGCTCCGGATATCGCA LYM116_ER_XbaI (SEQ ID NO: 3783) AAATCTAGAAGGCAGATGTTCATAACCACAC |
| LYM117 | | LYM117_F2_BamHI (SEQ ID NO: 3784) AAAGGATCCCGTCGTCAAGTGCTGGC LYM117_R2_EcoRV (SEQ ID NO: 3785) AGTGATATCTCAATGTTTAGGGTCTCGGCATG |
| LYM119 | SalI, XbaI | LYM119_NF_SalI (SEQ ID NO: 3786) AAAGTCGACATCGAGTTGTTCGTCCGTC LYM119_NR_XbaI (SEQ ID NO: 3787) AAATCTAGAACACCAAGCGTACATCTCAGAC |
| LYM12 | XhoI, KpnI | LYM12 EF XhoI (SEQ ID NO: 3788) TTACTCGAGTGCTTCTCTTCTTTCCTCTCTG LYM12 ER KpnI (SEQ ID NO: 3789) ATAGGTACCTCACAGCAAACTAACATGAACCG |
| LYM120 | BamHI, XhoI | LYM120_NF_BamHI (SEQ ID NO: 3790) AAAGGATCCGGAAGTCCGGAGTTGGAAG LYM120_NR_XhoI (SEQ ID NO: 3791) AAACTCGAGCAGTCACTCACACGCTACTACG |
| LYM121 | BamHI, XhoI | LYM121_NF_BamHI (SEQ ID NO: 3792) AAAGGATCCACTGCTGACCAACTTCAGTGTC LYM121_EF_BamHI (SEQ ID NO: 3793) AAAGGATCCGACAAGGCTATCACATCCAATC LYM121_NR_XhoI (SEQ ID NO: 3794) AAACTCGAGTTCTAAAGAAACAATCACGCAC LYM121_ER_XhoI (SEQ ID NO: 3795) AAACTCGAGAGCAGAAGAAACTAGGCATGTG |
| LYM122_G | | LYM122_EF_BamHI (SEQ ID NO: 3796) AAAGGATCCTGCAGCCCTGACACACAAC LYM122_ER_XhoI (SEQ ID NO: 3797) AAACTCGAGACCATCATGTAATACCCACCTC |
| LYM125 | | LYM125_EF_BamHI (SEQ ID NO: 3798) AAAGGATCCCTGTGCTTGGAGTAGACACGAG LYM125_ER_KpnI (SEQ ID NO: 3799) AAAGGTACCGGAGAATTTGGATCAGTGCAG |
| LYM127 | | LYM127_F2_BamHI (SEQ ID NO: 3800) TTTGGATCCCTTCTTGCTGTCGAACACCAG LYM127_R2_XhoI (SEQ ID NO: 3801) TTTCTCGAGGTCATGGGATTCTTGTCAGATACTAG |
| LYM128 | BamHI, XhoI | LYM128_NF_BamHI (SEQ ID NO: 3802) TTTGGATCCTTCACACCTCACCGAGCG LYM128_EF_BamHI (SEQ ID NO: 3803) AAAGGATCCAACCCGTTCACACCTCACC LYM128_NR_XhoI (SEQ ID NO: 3804) AAACTCGAGGATCACTTGACAATTACCGTGC LYM128_ER_XhoI (SEQ ID NO: 3805) AAACTCGAGTATGCTGATATGCCAGGTTTAC |

TABLE 26-continued

The PCR primers used for cloning the genes of some embodiments of the invention into high copy vectors

| Gene Name | Restriction Enzymes used for cloning | Primers used for amplification |
|---|---|---|
| LYM129 | SalI, XbaI | LYM129_NF_SalI (SEQ ID NO: 3806)<br>AAAGTCGACATTCAGTCTTGTCGGCTACATC<br>LYM129_EF_SalI (SEQ ID NO: 3807)<br>AAAGTCGACTAGATCAGCCTCGATTCATCTC<br>LYM129_NR_XbaI (SEQ ID NO: 3808)<br>AAATCTAGAGCTTAATCAGAAGAAACGAACC<br>LYM129_ER_XbaI (SEQ ID NO: 3809)<br>AAATCTAGAAATTGCACAATACATGAACACG |
| LYM13 | SalI, BamHI | LYM13_NF_SalI (SEQ ID NO: 3810)<br>AAAGTCGACCAAGCGGTAGGAGATGAGG<br>LYM13_NR_BamHI (SEQ ID NO: 3811)<br>AAAGGATCCTTATAACAACTATTCCCGGTAAGC |
| LYM130 | SalI, XbaI | LYM130_NF_SalI (SEQ ID NO: 3812)<br>AAAGTCGACAGAAATTAAGTTGCCGGAGAG<br>LYM130_NR_XbaI (SEQ ID NO: 3813)<br>AAATCTAGAATGCAGATGAGAGCTCAAGATG |
| LYM131 | SalI, XhoI | LYM131_NF_SalI (SEQ ID NO: 3814)<br>AAAGTCGACTCCCTACCCTAGTCGATCTCC<br>LYM131_EF_SalI (SEQ ID NO: 3815)<br>AAAGTCGACGACTCGTCTCCTCGTTGCTC<br>LYM131_NF_SalI (SEQ ID NO: 3814)<br>AAAGTCGACTCCCTACCCTAGTCGATCTCC<br>LYM131_ER_XhoI (SEQ ID NO: 3816)<br>AAACTCGAGTATAACACAGGCATAAAGCAGC |
| LYM132 | BamHI, XhoI | LYM132_EF_BamHI (SEQ ID NO: 3817)<br>AAAGGATCCATATTGGAATGCTTCTGTCGTC<br>LYM132_ER_XhoI (SEQ ID NO: 3818)<br>AAACTCGAGTACACGATAATCACAAACCACG |
| LYM134 | BamHI, XhoI | LYM134_NF_BamHI (SEQ ID NO: 3819)<br>AAAGGATCCATGGTGATTCGGTTGTTGTTAG<br>LYM134_EF_BamHI (SEQ ID NO: 3820)<br>AAAGGATCCATCGTTGAATTGATGGTGATTC<br>LYM134_NR_XhoI (SEQ ID NO: 3821)<br>AAACTCGAGTCATACGTCGAAGAACCAGAAC<br>LYM134_ER_XhoI (SEQ ID NO: 3822)<br>AAACTCGAGTGAAACTTTCGCCAACTACAC |
| LYM135 | | LYM135_NF_SalI (SEQ ID NO: 3823)<br>AAAGTCGACTTCTGATCTGCTCAGCTAAAGG<br>LYM135_NR_SacI (SEQ ID NO: 3824)<br>AAAGAGCTCCTGATGCACAAATATGGTAACG |
| LYM136 | BamHI, KpnI | LYM136_NF_BamHI (SEQ ID NO: 3825)<br>AAAGGATCCCCGGTTCTATGTGTAGGAAGAG<br>LYM136_EF_BamHI (SEQ ID NO: 3826)<br>AAAGGATCCCAGGATGAGTGTTGATCCATTC<br>LYM136_NR_KpnI (SEQ ID NO: 3827)<br>AAAGGTACCGTCACAAACGCCTCAACATATC<br>LYM136_ER_KpnI (SEQ ID NO: 3828)<br>AAAGGTACCTTCACCATATTGCTACGAAATC |
| LYM137 | SalI, XbaI | LYM137_NF_SalI (SEQ ID NO: 3829)<br>AAAGTCGACAGTTCAAGAGGCTGTCCTGAG<br>LYM137_NR_XbaI (SEQ ID NO: 3830)<br>AAATCTAGATCCAATAACATAAGAAACCACG |
| LYM138 | SalI, SacI | LYM138_EF_SalI (SEQ ID NO: 3831)<br>AAAGTCGACAACGAACCACTCTTCTGCATC<br>LYM138_ER_SacI (SEQ ID NO: 3832)<br>AAAGAGCTCGAAGCAACCTGGAAATAAACTC |
| LYM14 | EcoRV, PstI | LYM14_NF_EcoRV (SEQ ID NO: 3833)<br>AAAGATATCCTCCTCAGATCCACCACCAC<br>LYM14_NR_PstI (SEQ ID NO: 3834)<br>AATCTGCAGCTAAAATATTCAGGGCTTGTTG |

TABLE 26-continued

The PCR primers used for cloning the genes of some
embodiments of the invention into high copy vectors

| Gene Name | Restriction Enzymes used for cloning | Primers used for amplification |
|---|---|---|
| LYM140 | XhoI, SacI | LYM140_F_XhoI (SEQ ID NO: 3835)<br>AAACTCGAGCTCCAGCACACGGACGAG<br>LYM140_ER_SacI (SEQ ID NO: 3836)<br>AAAGAGCTCTACGAGTACGAATTATTGCCAG |
| LYM141 | | LYM141_NF_BamHI (SEQ ID NO: 3837)<br>AAAGGATCCACAAGCGTCTTCTTCGTCTTC<br>LYM141_NR_KpnI (SEQ ID NO: 3838)<br>AAAGGTACCCCATGCCACCCTTACTATACTC |
| LYM142 | SalI, SacI | LYM142_NF_SalB (SEQ ID NO: 3839)<br>TAAGTCGACCACACAGAGCACAGCACAGAG<br>LYM142_NR_SacB (SEQ ID NO: 3840)<br>TGAGCTCTGAACATGCGACCGTATGC |
| LYM143 | SalI, XbaI | LYM143_NF_SalI (SEQ ID NO: 3841)<br>AAAGTCGACCACTAGCGCACAGATCTCCTAC<br>LYM143_NR_XbaI (SEQ ID NO: 3842)<br>AAATCTAGAAATAGTGTCCATGAGACGAACG |
| LYM144 | SalI, EcoRV | LYM144_NF_SalI (SEQ ID NO: 3843)<br>AAAGTCGACACGACGAGGAGGAGGATG<br>LYM144_NR_EcoRV (SEQ ID NO: 3844)<br>AATGATATCACGCATGGATTTCTTTAAGTTG |
| LYM145 | BamHI, XhoI | LYM145_F2_BamHI (SEQ ID NO: 3845)<br>ATCGGATCCTAGCTTTGCCCAGTTTTGCT<br>LYM145_F2_BamHI (SEQ ID NO: 3845)<br>ATCGGATCCTAGCTTTGCCCAGTTTTGCT<br>LYM145_R2_XhoI (SEQ ID NO: 3846)<br>TTTCTCGAGCTATGCAGTTTTAGCCTAAGGCAAG<br>LYM145_R2_XhoI (SEQ ID NO: 3846)<br>TTTCTCGAGCTATGCAGTTTTAGCCTAAGGCAAG |
| LYM146 | | LYM146_F2_KpnI (SEQ ID NO: 3847)<br>AAAGGTACCCGAGGTCGTCACGCACAG<br>LYM146_R2_KpnI (SEQ ID NO: 3848)<br>AATGGTACCTGGGTGGTTAGACAGCAAGG |
| LYM147 | SalI, XbaI | LYM147_NF_SalI (SEQ ID NO: 3849)<br>AAAGTCGACCTCTGGCGCTCTCCTATACTC<br>LYM147_EF_SalI (SEQ ID NO: 3850)<br>AAAGTCGACAGTACGTGTACGTTTCAGGGAG<br>LYM147_NR_XbaI (SEQ ID NO: 3851)<br>AAATCTAGAAGTACCACTAGCAGAAAGGCAG<br>LYM147_ER_XbaI (SEQ ID NO: 3852)<br>AAATCTAGATGGCACCCAATACTAGTACCAC |
| LYM148 | BamHI, XhoI | LYM148_NF_BamHI (SEQ ID NO: 3853)<br>AAAGGATCCCTTACCCTTCCCTGAGATCC<br>LYM148_NR_XhoI (SEQ ID NO: 3854)<br>AAACTCGAGCTAACTACCAAAGTTCAAGCAGCTC |
| LYM149 | SalI, XbaI | LYM149_NF_SalI (SEQ ID NO: 3855)<br>AAAGTCGACACCATGAGTTCATAACAAGAAGG<br>LYM149_NR_XbaI (SEQ ID NO: 3856)<br>AAATCTAGACTAATACATGGAAGTGCAGACATGC |
| LYM15 | SalI, XbaI | LYM15_NF_SalI (SEQ ID NO: 3857)<br>AAAGTCGACAGGTACAGTATAGTATGACACCGAC<br>LYM15_NR_XbaI (SEQ ID NO: 3858)<br>AATTCTAGACTACTGTTAACCGCTGATTATATCC |
| LYM152 | SalI, XbaI | LYM152_NF_SalI (SEQ ID NO: 3859)<br>TTTGTCGACGAAGAAGAGATGGGAGTTTTCTC<br>LYM152_NR_XbaI (SEQ ID NO: 3860)<br>AAATCTAGAATTTCTGACATTACATTATAGTCTCG |
| LYM153 | SalI, XbaI | LYM153_NF_SalI (SEQ ID NO: 3861)<br>AAAGTCGACTTCTCCTCCTACGTTCTACTGG<br>LYM153_NR_XbaI (SEQ ID NO: 3862)<br>AAATCTAGACTAACAGGGTTTCTCCACTAAGTAAG |

TABLE 26-continued

The PCR primers used for cloning the genes of some
embodiments of the invention into high copy vectors

| Gene Name | Restriction Enzymes used for cloning | Primers used for amplification |
|---|---|---|
| LYM155 | SalI, XbaI | LYM155_NF_SalI (SEQ ID NO: 3863)<br>AAAGTCGACTCCACTATAAGCAACGCACC<br>LYM155_EF_SalI (SEQ ID NO: 3864)<br>AAAGTCGACGAAGGAAACTCGGTGACACG<br>LYM155_NR_XbaI (SEQ ID NO: 3865)<br>AAATCTAGAATGCCATGCTACTAAGAACCTAC<br>LYM155_ER_XbaI (SEQ ID NO: 3866)<br>AAATCTAGATAAACATCTCATGCCATGCTAC |
| LYM156 | StuI, StuI | LYM156_NF_StuI (SEQ ID NO: 3867)<br>TTTAGGCCTCAAGATCCGCAGAGATGATC<br>LYM156 NR StuI_2 (SEQ ID NO: 3868)<br>AAAAGGCCTTTAAGTGCTTGCGTCGTTTTACAG |
| LYM157_G | XbaI, SacI | LYM157_EF_Xba_B (SEQ ID NO: 3869)<br>AATCTAGACCTCGAGCCACCCACTTTC<br>LYM157_ER_Sac_B (SEQ ID NO: 3870)<br>TGAGCTCTCACCTTCATCTTGTCTTCACTGGT |
| LYM159 | SalI, XbaI | LYM159_NF_SalI (SEQ ID NO: 3871)<br>AAAGTCGACCTCTACCTTCTTCTTCGGTCAG<br>LYM159_NR_XbaI (SEQ ID NO: 3872)<br>AAATCTAGAAGCTTAGCTAGGCCAACAATAC |
| LYM16 | SalI, XbaI | LYM16 NF SalI (SEQ ID NO: 3873)<br>CTAGTCGACAAGAAATTGGCACAGAAATGG<br>LYM16 NR XbaI (SEQ ID NO: 3874)<br>TATTCTAGATCAAAGAGCCTAGTGAGCGTCTTC |
| LYM160 | SalI, XbaI | LYM160_F2_SalI (SEQ ID NO: 3875)<br>AAAGTCGACAGGCCAGACCAAAACCATG<br>LYM160_F2_SalI (SEQ ID NO: 3875)<br>AAAGTCGACAGGCCAGACCAAAACCATG<br>LYM160_NR_XbaI (SEQ ID NO: 3876)<br>AAATCTAGAAGAGTAACATGGACACACGACC<br>LYM160_R2_XbaI (SEQ ID NO: 3877)<br>AATTCTAGATCAGTACAAGAGCCAGATGTCTGA |
| LYM161 | BamHI, XhoI | LYM161_EF_BamHI (SEQ ID NO: 3878)<br>AAAGGATCCGAGAGAGGAGCAAAGATTCACC<br>LYM161_ER_XhoI (SEQ ID NO: 3879)<br>AAACTCGAGTACAGGATGGTTGGTCTTCTTC |
| LYM162 | BamHI, XhoI | LYM162_NF_BamHI (SEQ ID NO: 3880)<br>TTTGGATCCGCATCTAAGCCGAATTGAAG<br>LYM162_NR_XhoI (SEQ ID NO: 3881)<br>AAACTCGAGCTATTTCATGCTCAGTACCTGCAC |
| LYM164 | SalI, XbaI | LYM164_NF_SalI (SEQ ID NO: 3882)<br>AAAGTCGACATCCAGATGCTTCACATTCTTG<br>LYM164_NR_XbaI (SEQ ID NO: 3883)<br>AAATCTAGATCGAGTTTGACACGAACTTATG |
| LYM165 | | LYM165_F2_XhoI (SEQ ID NO: 3884)<br>AAACTCGAGCTACTCCGATCGGATCCTGAC<br>LYM165_R2_SacI (SEQ ID NO: 3885)<br>AAAGAGCTCAAACGACGCACGGTCTCAC |
| LYM17 | SmaI, KpnI | LYM17 NF X/SmaI (SEQ ID NO: 3886)<br>ATACCCGGGTCTCTCAAGATGGTGGTGCTG<br>LYM17 NR KpnI (SEQ ID NO: 3887)<br>TATGGTACCAAGGGCTTAGCAAATTCTTTC |
| LYM170 | SalI, XbaI | LYM170_NF_SalI (SEQ ID NO: 3888)<br>AAAGTCGACATTCTTCGACCTCCTAAACTCC<br>LYM170_EF_SalI (SEQ ID NO: 3889)<br>AAAGTCGACAGTCTCACACAGATCGCTTCAC<br>LYM170_NR_XbaI (SEQ ID NO: 3890)<br>AAATCTAGACTACCAACTCAGAACCAGGATGAG<br>LYM170_ER_XbaI (SEQ ID NO: 3891)<br>AAATCTAGACATACCTATAAGGCTATAACACTGC |

TABLE 26-continued

The PCR primers used for cloning the genes of some embodiments of the invention into high copy vectors

| Gene Name | Restriction Enzymes used for cloning | Primers used for amplification |
| --- | --- | --- |
| LYM172 | BamHI, XhoI | LYM172_NF_BamHI (SEQ ID NO: 3892) AAAGGATCCCTCGTCTTCGTCTACTCCACC LYM172_EF_BamHI (SEQ ID NO: 3893) AAAGGATCCCCTCACTCGTAGTCTCGTCTTC LYM172_NR_XhoI (SEQ ID NO: 3894) AAACTCGAGGGAGCTTTGGAGAATAACAAAC LYM172_ER_XhoI (SEQ ID NO: 3895) AAACTCGAGCAACAGGTAACTCATTTCCACC |
| LYM173 | BamHI, XhoI | LYM173_NF_BamHI (SEQ ID NO: 3896) AAAGGATCCTCATCAGTTCCCTGTTCTTCAG LYM173_NR_XhoI (SEQ ID NO: 3897) AAACTCGAGATGACTGGACTAAAGCAACCAC |
| LYM174 | BamHI, KpnI | LYM174_NF_BamHI (SEQ ID NO: 3898) AAAGGATCCCTCTTGCTAGGAGTAGCCTGC LYM174_NR_KpnI (SEQ ID NO: 3899) AAAGGTACCTATTATCCTACATGCCACATGC |
| LYM175 | SalI, XbaI | LYM175_NF_SalI (SEQ ID NO: 3900) AAAGTCGACCACTCCCTCTTATAGCCCACC LYM175_NR_XbaI (SEQ ID NO: 3901) AAATCTAGACTAAGTGTACAGTTCACGGCACG |
| LYM176 | SalI, XbaI | LYM176_NF_SalI (SEQ ID NO: 3902) AAAGTCGACTCTCGTTTCTCCTACCCTACAG LYM176_NR_XbaI (SEQ ID NO: 3903) AAATCTAGACTAACAGTTTCCAGTCAAAGCTACAG |
| LYM178 | SalI, XbaI | LYM178_NF_SalI (SEQ ID NO: 3904) AAAGTCGACCTATCCATCCGCCACAAGAC LYM178_NR_XbaI (SEQ ID NO: 3905) AAATCTAGAACACAAGACACCATTTCTGGAG |
| LYM179 | SalI, XhoI | LYM179_NF_SalI (SEQ ID NO: 3906) AAAGTCGACAGGATTTCTCTAGGATAGCAGC LYM179_EF_SalI (SEQ ID NO: 3907) AAAGTCGACCTCAGTCGAGCGAGGATTTC LYM179_NR_XhoI (SEQ ID NO: 3908) AAACTCGAGAAACAGAGCCTAACAGACATGG LYM179_ER_XhoI (SEQ ID NO: 3909) AAACTCGAGGGGATGTTTAGACTGCTACAGG |
| LYM180 | BamHI, XhoI | LYM180_NF_BamHI (SEQ ID NO: 3910) TATGGATCCCGACCTTTGATACCAAGCAAG LYM180_NR_XhoI (SEQ ID NO: 3911) TTACTCGAGCACGGATTAGTTTGTAGTAGCATGG |
| LYM181 | | LYM181_F2_BamHI (SEQ ID NO: 3912) AATGGATCCTAAAAATGGCGGCTGCTACTC LYM181_R2_EcoRV (SEQ ID NO: 3913) TTTGATATCTCATACACGGTTTCATATGGTCGG |
| LYM183 | | LYM183_EF_SalI (SEQ ID NO: 3914) AAAGTCGACATCAAACCAACGAGAGCACTAC LYM183_ER_XbaI (SEQ ID NO: 3915) AAATCTAGAACTTCAGTGTACTTTCCCTTGC |
| LYM184 | | LYM184_NF_BamHI (SEQ ID NO: 3916) AAAGGATCCAACACGACTTGTGAGTGAGAGC LYM184_EF_BamHI (SEQ ID NO: 3917) AAAGGATCCATATGAGTAACGCCATCAGGAG LYM184_NR_XhoI (SEQ ID NO: 3918) AAACTCGAGTGCCTCATTTAATCTTGGGTC LYM184_ER_XhoI (SEQ ID NO: 3919) AAACTCGAGGAAATTGCCTCATTTAATCTTG |

TABLE 26-continued

The PCR primers used for cloning the genes of some embodiments of the invention into high copy vectors

| Gene Name | Restriction Enzymes used for cloning | Primers used for amplification |
|---|---|---|
| LYM185 | BamHI, KpnI | LYM185_NF_BamHI (SEQ ID NO: 3920) AAAGGATCCAATTCGAGATATTTGGCTGTTC<br>LYM185_EF_BamHI (SEQ ID NO: 3921) AAAGGATCCAGATAGCAAGATAGTCCGGTTG<br>LYM185_NR_KpnI (SEQ ID NO: 3922) AAAGGTACCGGTCTATCACAAGCATCCTCAC<br>LYM185_ER_KpnI (SEQ ID NO: 3923) AAAGGTACCACCACCTTTGTGATTGTTTCTC |
| LYM186 | SalI, XbaI | LYM186_NF_SalI (SEQ ID NO: 3924) AAAGTCGACCGACCCAAATTGACATAACTC<br>LYM186_NR_XbaI (SEQ ID NO: 3925) AAATCTAGAATAGCTGGAACCTGGTATTGAC |
| LYM188 | BamHI, XhoI | LYM188_EF_BamHI (SEQ ID NO: 3926) AAAGGATCCCGAGCTAGGGTTAGGGTTTC<br>LYM188_ER_XhoI (SEQ ID NO: 3927) AAACTCGAGCAACAACTCACGCTACACATTC |
| LYM189 | SalI, XbaI | LYM189_NF_SalI (SEQ ID NO: 3928) AAAGTCGACCCACGTCCTAGAATGAAAGAG<br>LYM189_EF_SalI (SEQ ID NO: 3929) AAAGTCGACTTCCTCTGCTTCCCACAGC<br>LYM189_NR_XbaI (SEQ ID NO: 3930) AAATCTAGACTGTTCATTCACGGTTGCAC<br>LYM189_ER_XbaI (SEQ ID NO: 3931) AAATCTAGAGCAAATCTGTCGCTTTATTAGG |
| LYM19 | SalI, XbaI | LYM19_NF_SalI (SEQ ID NO: 3932) AAAGTCGACGAGAGAAGAGAGATGGTCCTCC<br>LYM19_NR_XbaI (SEQ ID NO: 3933) AAATCTAGATTATCATGCTGACTTCTTGCCAC |
| LYM192 | XhoI, EcoRV | LYM192_EF_XhoI (SEQ ID NO: 3934) AAACTCGAGTGAGCAGCGAGCCCTAAC<br>LYM192_R_EcoRV (SEQ ID NO: 3935) TTTGATATCTCACACTACTAGGGAGTGGAGTAGTAACTTGA |
| LYM193 | BamHI, XhoI | LYM193_NF_BamHI (SEQ ID NO: 3936) AAAGGATCCCTAGTAGTGTTCTTCCCATTCG<br>LYM193_EF_BamHI (SEQ ID NO: 3937) AAAGGATCCAACAATCCGTCCTTTCATTTG<br>LYM193_NR_XhoI (SEQ ID NO: 3938) AAACTCGAGTAAACGACAGCGGTACACATAC<br>LYM193_ER_XhoI (SEQ ID NO: 3939) AAACTCGAGTACATCTCTAGGCAGCAAACAG |
| LYM196 | | LYM196_NF_BamHI (SEQ ID NO: 3940) AAAGGATCCGAGGACACCGCTTGCTTTC<br>LYM196_NR_XhoI (SEQ ID NO: 3941) AAACTCGAGAACCTTGGATATGACCAATCAG |
| LYM197 | BamHI, XhoI | LYM197_EF_BamHI (SEQ ID NO: 3942) AAAGGATCCCTGTTGCCACATCTAGTGGTTC<br>LYM197_ER_XhoI (SEQ ID NO: 3943) AAACTCGAGCACAATTCAGCGATTATTTCAG |
| LYM198 | BamHI, XhoI | LYM198_F2_BamHI (SEQ ID NO: 3944) ATTGGATCCTTCATTTCCGCCATCCGT<br>LYM198_R2_XhoI (SEQ ID NO: 3945) AAACTCGAGCACCATCTCTTGCAGAAGGC |
| LYM2 | EcoRV, KpnI | LYM2_NF_EcoRV (SEQ ID NO: 3946) AAAGATATCCGGTAGGTAGATGAAATTAAGG<br>LYM2_NR_KpnI (SEQ ID NO: 3947) CGAGGTACCCTAATATGCAGGTCAGCACACAAG |

TABLE 26-continued

The PCR primers used for cloning the genes of some
embodiments of the invention into high copy vectors

| Gene Name | Restriction Enzymes used for cloning | Primers used for amplification |
|---|---|---|
| LYM20 | EcoRV, KpnI | LYM20 NF EcoRV (SEQ ID NO: 3948)<br>ATAGATATCACTCCGAATCCGACGCAC<br>LYM20 EF EcoRV (SEQ ID NO: 3949)<br>ATAGATATCGAGATCCCAACTCCGAATCC<br>LYM20 NR KpnI (SEQ ID NO: 3950)<br>TATGGTACCCTACGTAAATCTCAGCACATGC<br>LYM20 ER KpnI (SEQ ID NO: 3951)<br>TATGGTACCCTTCTGCAACGTTATTTGAGG |
| LYM200 | BamHI, XhoI | LYM200_NF_BamHI (SEQ ID NO: 3952)<br>AAAGGATCCACTTTACCGGGCTACCATTC<br>LYM200_EF_BamHI (SEQ ID NO: 3953)<br>AAAGGATCCTTACAAGAGCCTGTGAGCTGAG<br>LYM200_NR_XhoI (SEQ ID NO: 3954)<br>AAACTCGAGCTTATCTGGACCACACTTGGAC<br>LYM200_ER_XhoI (SEQ ID NO: 3955)<br>AAACTCGAGAAGAAATACATAGCCCTCCTCC |
| LYM201 | BamHI, XhoI | LYM201_NF_BamHI (SEQ ID NO: 3956)<br>AAAGGATCCGCCTCATCTCGGTTTACTATAAG<br>LYM201_NR_XhoI (SEQ ID NO: 3957)<br>AAACTCGAGAAGTAGACACAAACCATCCTGG |
| LYM203 | BamHI, XhoI | LYM203_EF_BamHI (SEQ ID NO: 3958)<br>AAAGGATCCTCTATCAAATCAGCCACCTGTC<br>LYM203_ER_XhoI (SEQ ID NO: 3959)<br>AAACTCGAGCTAGCAACTTTGTAGACCAGACGTG |
| LYM204 | | LYM204_NF_BamHI (SEQ ID NO: 3960)<br>AAAGGATCCCTACTACCAGACAGAGAGGACAGG<br>LYM204_EF_BamHI (SEQ ID NO: 3961)<br>TTTGGATCCGCTTTCTGGCATCGCTACTAC<br>LYM204_NR_XhoI (SEQ ID NO: 3962)<br>TGTCTCGAGTCAGTAGGAGTTTATGAGATGAACC<br>LYM204_ER_Xho (SEQ ID NO: 3963)<br>AAACTCGAGTCAACTCATCATCCGGAACATGGTAC |
| LYM206 | XhoI, EcoRV | LYM206_EF_XhoI (SEQ ID NO: 3964)<br>AAACTCGAGAATTCTAGCAAGGCAGCTCAG<br>LYM206_ER_EcoRV (SEQ ID NO: 4199)<br>AAAGATATCTAAAGGAGTCGTAGCCCTCTC |
| LYM207 | | LYM207_EF_BamHI (SEQ ID NO: 3966)<br>AAAGGATCCACTCTTCCAACCGCTCCTC<br>LYM207_ER_KpnI (SEQ ID NO: 4200)<br>AAAGGTACCCTAGTCTTGCGAAGTGCGAG |
| LYM208 | BamHI, XhoI | LYM208_F2_BamHI (SEQ ID NO: 3968)<br>AAAGGATCCTGCGGCTGAGTACAGACGAC<br>LYM208_R2_KpnI (SEQ ID NO: 3969)<br>AAAGGTACCCATCAATCCATGCTAATGTAGAGC |
| LYM21 | EcoRV, KpnI | LYM21_NF_EcoRV (SEQ ID NO: 3970)<br>AAAGATATCTCTCGCAGCACAAAGATGG<br>LYM21 NR KpnI (SEQ ID NO: 3971)<br>ATAGGTACCTCACCCTTAGTTCTTCACAGTGGTG |
| LYM212 | SalI, XbaI | LYM212_NF_SalI (SEQ ID NO: 3972)<br>AAAGTCGACCTGATACCCATCCATCCACC<br>LYM212_EF_SalI (SEQ ID NO: 3973)<br>AAAGTCGACACTGACAAACCGGACCCAC<br>LYM212_NR_XbaI (SEQ ID NO: 3974)<br>AAATCTAGACTAGCAGAGCCGAAGTAGTACGAG<br>LYM212_ER_XbaI (SEQ ID NO: 3975)<br>AAATCTAGACTAGAACGAAGTAGTACGAGCAAGC |
| LYM213 | BamHI, XhoI | LYM213_EF_BamHI (SEQ ID NO: 3976)<br>AAAGGATCCCAGCTCATCAGAACACAGAAGG<br>LYM213_ER_XhoI (SEQ ID NO: 3977)<br>AAACTCGAGTTCGACAATTTGCAATAGAAAG |

TABLE 26-continued

The PCR primers used for cloning the genes of some embodiments of the invention into high copy vectors

| Gene Name | Restriction Enzymes used for cloning | Primers used for amplification |
|---|---|---|
| LYM215 | BamHI, XhoI | LYM215_F2_BamHI (SEQ ID NO: 3978) AATGGATCCTTCCCTCCCACCGAAATG LYM215_F2_BamHI (SEQ ID NO: 3978) AATGGATCCTTCCCTCCCACCGAAATG LYM215_R2_XhoI (SEQ ID NO: 3979) AAACTCGAGGAGCATGCAAAATGGACTAGACT LYM215_R2_XhoI (SEQ ID NO: 3979) AAACTCGAGGAGCATGCAAAATGGACTAGACT |
| LYM217 | SalI, XbaI | LYM217_F2_SalI (SEQ ID NO: 4201) AAAGTCGACCGACCGATCCAAGTAGTGAGC LYM217_R2_XbaI (SEQ ID NO: 4202) AAATCTAGAAGCTGATAGGCCAGTCAATCC |
| LYM219 | BamHI, KpnI | LYM219_F_BamHI (SEQ ID NO: 3980) AAAGGATCCTAGCAGTCTCGATGGCCG LYM219_F_BamHI (SEQ ID NO: 3980) AAAGGATCCTAGCAGTCTCGATGGCCG LYM219_R_KpnI (SEQ ID NO: 3981) TTTGGTACCCGAGTCAGCTTTTGTAATGATAG LYM219_R_KpnI (SEQ ID NO: 3981) TTTGGTACCCGAGTCAGCTTTTGTAATGATAG |
| LYM22 | SalI, XbaI | LYM22_NF_SalI (SEQ ID NO: 3982) AAAGTCGACTTAGCACACATGGCGTCTTC LYM22_EF_SalI (SEQ ID NO: 3983) AAAGTCGACCATCGGCATCTTCCTAACTG LYM22_NR_XbaI (SEQ ID NO: 3984) AATTCTAGATAATCTGTAGATGGCTGCCG LYM22_ER_SmaI (SEQ ID NO: 3985) AATCCCGGGTAACAACGTACATGCAAGTCATC |
| LYM220 | BamHI, EcoRV | LYM220_NF_BamHI (SEQ ID NO: 3986) AAAGGATCCCGACTTCAAGCATCAGACTACC LYM220_EF_BamHI (SEQ ID NO: 3987) AAAGGATCCAGCACACACATCCTCTAAGTGC LYM220_NR_EcoRV (SEQ ID NO: 3988) AAAGATATCAACAGCAGTCACTTCACTCGTC LYM220_ER_EcoRV (SEQ ID NO: 3989) AAAGATATCAAGTGGTACGGCTGAGTGTAAC |
| LYM221 | BamHI, XhoI | LYM221_NF_BamHI (SEQ ID NO: 3990) AAAGGATCCACTGTCCACTGCGTCTGTCTC LYM221_EF_BamHI (SEQ ID NO: 3991) AAAGGATCCATCGTTAGAGGCTCAGAGTCAG LYM221_NR_XhoI (SEQ ID NO: 3992) AAACTCGAGACTACGTATTACACGGAGGTGG LYM221_ER_XhoI (SEQ ID NO: 3993) AAACTCGAGTCTGCAGCATTCCTTAACCTAC |
| LYM223 | XhoI, SacI | LYM223_NF_XhoI (SEQ ID NO: 3994) AAACTCGAGACCTGCCTGCCACTATACTATC LYM223_EF_XhoI (SEQ ID NO: 3995) AAACTCGAGAGACCCGTCTTAACTCTACCTG LYM223_NR_SacI (SEQ ID NO: 3996) AAAGAGCTCAGCACCGGTTGATCTAGAATAC LYM223_ER_SacI (SEQ ID NO: 3997) AAAGAGCTCATTTATCCACGAACCCATATTC |
| LYM224 | BamHI, XhoI | LYM224_EF_BamHI (SEQ ID NO: 3998) AAAGGATCCCAGGCCTCACGTGTCATTC LYM224_EF_BamHI (SEQ ID NO: 3998) AAAGGATCCCAGGCCTCACGTGTCATTC LYM224_R2_XhoI (SEQ ID NO: 3999) AAACTCGAGGTTTCCAGCCAACCAGAACAC LYM224_ER_XhoI (SEQ ID NO: 4000) AAACTCGAGGATCCAAATTGGTAATGCTTTG |

TABLE 26-continued

The PCR primers used for cloning the genes of some
embodiments of the invention into high copy vectors

| Gene Name | Restriction Enzymes used for cloning | Primers used for amplification |
| --- | --- | --- |
| LYM228 | | LYM228_NF_BamHI (SEQ ID NO: 4001)<br>AAAGGATCCGCAAGCACTCCACTTCAAGC<br>LYM228_F2_BamHI (SEQ ID NO: 4002)<br>AAAGGATCCCTCGAAGTGTCCAAGAAGAACACA<br>LYM228_R2_KpnI (SEQ ID NO: 4003)<br>TAAGGTACCGAGCTGCAAACATAACGTCGAG<br>LYM228_R2_KpnI (SEQ ID NO: 4003)<br>TAAGGTACCGAGCTGCAAACATAACGTCGAG |
| LYM23 | BamHI, KpnI | LYM23_NF_BamHI (SEQ ID NO: 4004)<br>AAAGGATCCTCATCTCTCTCCCTCTCATCG<br>LYM23_NR_KpnI (SEQ ID NO: 4005)<br>AAAGGTACCGTGCTGCTTCAACTATCCTCTC |
| LYM232 | | LYM232_EF_BamHI (SEQ ID NO: 4006)<br>AAAGGATCCAAATTCCCAATTTCTTCGGTC<br>LYM232_ER_XhoI (SEQ ID NO: 4007)<br>AAACTCGAGAGCACACACAGGTTCCTAAGAG |
| LYM236 | SalI, XbaI | LYM236_F_SalI (SEQ ID NO: 4008)<br>AAAGTCGACGACTACCAATCCAATCTCCTCC<br>LYM236_ER_XbaI (SEQ ID NO: 4009)<br>AAATCTAGAAGAAATGTATAATCGAAGTGCATC |
| LYM238 | | LYM238_EF_SmaI (SEQ ID NO: 4010)<br>AAACCCGGGTAGTGGTGGAGAGACGAAACAC<br>LYM238_ER_SacI (SEQ ID NO: 4011)<br>AAAGAGCTCCTACAAGTGCTGACTGCTGAAG |
| LYM239 | BamHI, XhoI | LYM239_EF_BamHI (SEQ ID NO: 4012)<br>AAAGGATCCCTTGGTCCGTCTCCACTCTC<br>LYM239_R_XhoI (SEQ ID NO: 4013)<br>AAACTCGAGCTAGGATTGGTACTCATTTCTTTGTG |
| LYM24 | SalI, XbaI | LYM24_NF_SalI (SEQ ID NO: 4014)<br>AACGTCGACTCTTCTCTTTCTCTTCTCCTCG<br>LYM24_NR_XbaI (SEQ ID NO: 4015)<br>ATATCTAGACATTCCAAACATTGTTATCAAAC |
| LYM240 | BamHI, KpnI | LYM240_NF_BamHI (SEQ ID NO: 4016)<br>AAAGGATCCTACTGTAAGCAGTTTCCCACC<br>LYM240_EF_BamHI (SEQ ID NO: 4017)<br>AAAGGATCCAACAACGCTCGTACTGTAAGC<br>LYM240_NR_KpnI (SEQ ID NO: 4018)<br>AAAGGTACCACAAGTCATTCTACCAAGCACC<br>LYM240_ER_KpnI (SEQ ID NO: 4019)<br>AAAGGTACCATACTTTCCTTGCTCTGCTGTC |
| LYM241 | , | LYM241_NF_BamHI (SEQ ID NO: 4020)<br>AAAGGATCCAAACGGTTGGGAGGTTAGC<br>LYM241_NR_XhoI (SEQ ID NO: 4021)<br>AAACTCGAGACTGGATCAGATTGTGAAGGTG |
| LYM242 | BamHI, XhoI | LYM242_NF_BamHI (SEQ ID NO: 4022)<br>AAAGGATCCACGACTCCGACGAGCGAC<br>LYM242_NR_XhoI (SEQ ID NO: 4023)<br>AAACTCGAGAACTCAAGTGGACAAATGTTGC |
| LYM243 | BamHI, XhoI | LYM243_EF_BamHI (SEQ ID NO: 4024)<br>AAAGGATCCAGAAGCGTAGAGCGGTCAAG<br>LYM243_ER_XhoI (SEQ ID NO: 4025)<br>AAACTCGAGCATTAAGCGAATTAACCATGTG |
| LYM245 | BamHI, KpnI | LYM245_F_BamHI (SEQ ID NO: 4026)<br>AAAGGATCCGCTAGCTACTAGCAAATTGAAGC<br>LYM245_F_BamHI (SEQ ID NO: 4026)<br>AAAGGATCCGCTAGCTACTAGCAAATTGAAGC<br>LYM245_NR_KpnI (SEQ ID NO: 4027)<br>AAAGGTACCGGTCACCCGTTAGACTTATGC<br>LYM245_ER_KpnI (SEQ ID NO: 4028)<br>AAAGGTACCTGGTAAATTATGGGTATTCAGC |

TABLE 26-continued

The PCR primers used for cloning the genes of some
embodiments of the invention into high copy vectors

| Gene Name | Restriction Enzymes used for cloning | Primers used for amplification |
|---|---|---|
| LYM248 | BamHI, EcoRV | LYM248_F_BamHI (SEQ ID NO: 4029)<br>AAAGGATCCACCACCGCTCGTCTCCAC<br>LYM248_NR_EcoRV (SEQ ID NO: 4030)<br>AAAGATATCACAAGAGAGATGGTGTGTCAGC |
| LYM249 | | LYM249_EF_BamHI (SEQ ID NO: 4031)<br>AAAGGATCCGGGTGTCATCAAACGGACTAC<br>LYM249_ER_KpnI (SEQ ID NO: 4032)<br>AAAGGTACCCTAAACGAGGTTACGGAATGTGTC |
| LYM250 | SalI, XbaI | LYM250_EF_SalI (SEQ ID NO: 4033)<br>AAAGTCGACGGAATTGGTGAGGTGATGC<br>LYM250_ER_XbaI (SEQ ID NO: 4034)<br>AAATCTAGACAGATAAACCTCAATCAAAGTCG |
| LYM251 | | LYM251_NF_SalI (SEQ ID NO: 4035)<br>AAAGTCGACCTGTCCTCTACTACGCATCTCTC<br>LYM251_NR_XbaI (SEQ ID NO: 4036)<br>AAATCTAGATAATCATCATTGTAGCAGGCAC |
| LYM252 | BamHI, KpnI | LYM252_NF_BamHI (SEQ ID NO: 4037)<br>AAAGGATCCTAGGAAGGATGGTACTGGCTG<br>LYM252_EF_BamHI (SEQ ID NO: 4038)<br>AAAGGATCCGCGATAGGAAGGATGGTACTG<br>LYM252_NR_KpnI (SEQ ID NO: 4039)<br>AAAGGTACCAGGCAAACACAATGATTTCAAC<br>LYM252_ER_KpnI (SEQ ID NO: 4040)<br>AAAGGTACCTGTAACATAAGTACCGGGCAG |
| LYM254 | | LYM254_EF_SalI (SEQ ID NO: 4041)<br>AAAGTCGACAATCTCCCACGCTCCAAAG<br>LYM254_ER_XbaI (SEQ ID NO: 4042)<br>AAATCTAGAAGTTACATTCTTGACCAGCAGC |
| LYM255 | BamHI, XhoI | LYM255_NF_BamHI (SEQ ID NO: 4043)<br>AAAGGATCCCTTCTAGTAGCACAGTAGTAGCAGC<br>LYM255_NR_XhoI (SEQ ID NO: 4044)<br>AAACTCGAGAACGAGGAAGAATCGGTATATG |
| LYM256 | BamHI, XhoI | LYM256_NF_BamHI (SEQ ID NO: 4045)<br>AAAGGATCCGGAACAACTCGTAGCCATGAC<br>LYM256_EF_BamHI (SEQ ID NO: 4046)<br>TATGGATCCCAATTTGAGAGCATTTGCTACG<br>LYM256_NR_XhoI (SEQ ID NO: 4047)<br>TAACTCGAGCTGAACTTAATAGCAATTCCGTAGC<br>LYM256_ER_XhoI (SEQ ID NO: 4048)<br>AAACTCGAGCGCACTACTGTGCTTCTGAAC |
| LYM26 | SalI, XbaI | LYM26_EF_SalI (SEQ ID NO: 4049)<br>AAAGTCGACTTGCTCCCTCTCTCTCTCTTG<br>LYM26_ER_XbaI (SEQ ID NO: 4050)<br>AAATCTAGATGTATTCACGAGGTAAACAACG |
| LYM260 | | LYM260_NF_BamHI (SEQ ID NO: 4051)<br>AAAGGATCCGAGAGATTAATTAAGTGGCAGG<br>LYM260_EF_BamHI (SEQ ID NO: 4052)<br>AAAGGATCCAGAAGAGAGATTAATTAAGTGGCAG<br>LYM260_NR_KpnI (SEQ ID NO: 4053)<br>AAAGGTACCCTAATATCGATCCAAACTCACACAAG<br>LYM260_ER_KpnI (SEQ ID NO: 3965)<br>AAAGGTACCTACGTGCGTATCATACATGGAG |
| LYM261 | | LYM261_EF_SmaI (SEQ ID NO: 4054)<br>AATCCCGGGTCGAGAGGTTTCATTCAGTGC<br>LYM261_ER_KpnI (SEQ ID NO: 4055)<br>TTTGGTACCTTATTACATTTGGATGGGCTGT |
| LYM267 | SalI, EcoRV | LYM267_F_SalI (SEQ ID NO: 4056)<br>AAAGTCGACGAGCACAGGTAGGGTTTCG<br>LYM267_ER_EcoRV (SEQ ID NO: 4057)<br>AAAGATATCCACTACCGAAGACTCACACGAC |

TABLE 26-continued

The PCR primers used for cloning the genes of some
embodiments of the invention into high copy vectors

| Gene Name | Restriction Enzymes used for cloning | Primers used for amplification |
|---|---|---|
| LYM268 | | LYM268_EF_XhoI (SEQ ID NO: 4058)<br>AAACTCGAGAACCCTCGCGAATCTGAG<br>LYM268_ER_EcoRV (SEQ ID NO: 4059)<br>AAAGATATCTAGTTCTCCATTCAGCATCTCC |
| LYM270 | BamHI, XhoI | LYM270_NF_BamHI (SEQ ID NO: 4060)<br>AAAGGATCCAAAGCAGTTCCAGCCTTCC<br>LYM270_EF_BamHI (SEQ ID NO: 4061)<br>AAAGGATCCACCAATGGCTGCCTGAGAC<br>LYM270_NF_BamHI (SEQ ID NO: 4060)<br>AAAGGATCCAAAGCAGTTCCAGCCTTCC<br>LYM270_ER_XhoI (SEQ ID NO: 4062)<br>AAACTCGAGGATTGGATATGCCACTTGATTG |
| LYM271 | BamHI, XhoI | LYM271_EF_BamHI (SEQ ID NO: 4063)<br>AAAGGATCCCACCTTCTTCCCAGATCAATAG<br>LYM271_ER_XhoI (SEQ ID NO: 4064)<br>AAACTCGAGGAAACAAAGCACAGTCAGTAGTAG |
| LYM273_S | BamHI, XhoI | LYM273_EF_BamHI (SEQ ID NO: 4065)<br>AAAGGATCCTACTAACAAACAGATAATCTCCACG<br>LYM273_R2_XhoI (SEQ ID NO: 4066)<br>ATACTCGAGAACATGTTGGAGATCTTTGATGC |
| LYM274 | BamHI, XhoI | LYM274_EF_BamHI (SEQ ID NO: 4067)<br>AAAGGATCCGAGAAGCTCCACTCTTCTCCAC<br>LYM274_ER_XhoI (SEQ ID NO: 4068)<br>AAACTCGAGTATAATGCACAGTTATGGGCAG |
| LYM277 | | LYM277_NF_SalI (SEQ ID NO: 4069)<br>AAAGTCGACTCAACGCCCAAGCTAGATTAC<br>LYM277_NR_SacI (SEQ ID NO: 4070)<br>AAAGAGCTCCTCAACATTGCAACAACTATGG |
| LYM278 | SalI, SacI | LYM278_EF_SalI (SEQ ID NO: 4071)<br>AAAGTCGACGCAGCCACACAACACTATCTC<br>LYM278_ER_SacI (SEQ ID NO: 4072)<br>AAAGAGCTCTTGACGATACATAGCACATAAGG |
| LYM283 | | LYM283_NF_SmaI (SEQ ID NO: 4073)<br>TTTCCCGGGTGCCACTTGTGCGAGGAG<br>LYM283_R_KpnI (SEQ ID NO: 4074)<br>AACGGTACCTCACCAATCAAATGTACAATCATGT |
| LYM284 | BamHI, KpnI | LYM284_EF_BamHI (SEQ ID NO: 4075)<br>AAAGGATCCGAGCAACCACCCGTAGTCAG<br>LYM284_ER_KpnI (SEQ ID NO: 4076)<br>AAAGGTACCACAGCTCAAGTGCTCATTTCTC |
| LYM285 | XhoI, EcoRV | LYM285_NF_XhoI (SEQ ID NO: 4077)<br>AAACTCGAGCCGCCATCTACTCGGAGC<br>LYM285_EF_XhoI (SEQ ID NO: 4078)<br>AAACTCGAGCCTCCTCCGCCATCTACTC<br>LYM285_NR_EcoRV (SEQ ID NO: 4079)<br>AAAGATATCAGAATTCACACTGTCCCAACAC<br>LYM285_ER_EcoRV (SEQ ID NO: 4080)<br>AAAGATATCCAGTTATTATAGGCCTCGTTCC |
| LYM287 | XhoI, EcoRV | LYM287_EF_XhoI (SEQ ID NO: 4081)<br>AAACTCGAGTGATTGCGTTTCCTTAAATATG<br>LYM287_ER_EcoRV (SEQ ID NO: 4082)<br>AAAGATATCCAATCAATCCTACAAACACAGC |
| LYM288 | XhoI, SacI | LYM288_EF_XhoI (SEQ ID NO: 4083)<br>AAACTCGAGTGTTAGGAAGTGAGGACTGAGC<br>LYM288_ER_SacI (SEQ ID NO: 4084)<br>AAAGAGCTCGCTCAATTATTCACCATTTCATC |
| LYM289 | SalI, XbaI | LYM289_EF_SalI (SEQ ID NO: 4085)<br>AAAGTCGACGCACAACCCTTGGAGACTTC<br>LYM289_ER_XbaI (SEQ ID NO: 4086)<br>AAATCTAGATCCTCTCATCGAGCTAAGACAC |

TABLE 26-continued

The PCR primers used for cloning the genes of some embodiments of the invention into high copy vectors

| Gene Name | Restriction Enzymes used for cloning | Primers used for amplification |
|---|---|---|
| LYM290 | BamHI, KpnI | LYM290_EF_BamHI (SEQ ID NO: 4087) AAAGGATCCATCCGGATCTCCACATTCC LYM290_ER_KpnI (SEQ ID NO: 4088) AAAGGTACCGAAACAATCTCATGGTCTCTGC |
| LYM291 | SalI, BamHI | LYM291_EF_SalI (SEQ ID NO: 4089) AAAGTCGACACTGAGCTCTCTGCTAAGTTGG LYM291_ER_BamHI (SEQ ID NO: 4090) AAAGGATCCTCCTAGCAACAGAAGATCCAAG |
| LYM293 | XhoI, SacI | LYM293_NF_XhoI (SEQ ID NO: 4091) AAACTCGAGAGCTTCCTCCCTAGCTGTCC LYM293_EF_XhoI (SEQ ID NO: 4092) AAACTCGAGGTGTAGCTTCCTCCCTAGCTG LYM293_NR_SacI (SEQ ID NO: 4093) AAAGAGCTCCTATTCCAGGAGAAGAACAATAAGAG LYM293_ER_SacI (SEQ ID NO: 4094) AAAGAGCTCCTATTCATGTTCCAGGAGAAGAAC |
| LYM3 | XhoI, KpnI | LYM3_EF_XhoI (SEQ ID NO: 4095) AATCTCGAGATTTATCTGCTTCAATGGCAAC LYM3_ER_KpnI (SEQ ID NO: 4096) ATAGGTACCCTAAGCATCATTCTGCCTACC |
| LYM30 | SalI, XhoI | LYM30_NF_SalI (SEQ ID NO: 4097) AAAGTCGACCCTCCATCCTTCAGTAATTGG LYM30_NR_XhoI (SEQ ID NO: 4098) TTTCTCGAGTCAGTCTCCTTGGATGTTTGAGTTG |
| LYM31 | SalI, XhoI | LYM31_NF_SalI (SEQ ID NO: 4099) AAGGTCGACACTCCCAACGTCTACTCTTCC LYM31_EF_SalI (SEQ ID NO: 4100) AATGTCGACCTCACCACTCCCAACGTCTAC LYM31_NR_XhoI (SEQ ID NO: 4101) AAACTCGAGATGTAAGAATGAAATCTTGTAGCTC LYM31_ER_XhoI (SEQ ID NO: 4102) AATCTCGAGTGCAAGGATGTAAGAATGAAATC |
| LYM34 | BamHI, KpnI | LYM34_NF_BamHI (SEQ ID NO: 4103) AAAGGATCCGAGATAATTAGCTCACTCCATGG LYM34_NR_KpnI (SEQ ID NO: 4104) TATGGTACCGAATTGGGCCTATGAGACG |
| LYM35 | SalI, XbaI | LYM35_NF_SalI (SEQ ID NO: 4105) AAAGTCGACAACACCTCTCTGGCTCTCTCC LYM35_NR_SacI (SEQ ID NO: 4106) AAAGAGCTCTCCTAAGACTTTCTCAGCCATC |
| LYM37 | SalI, XbaI | LYM37_NF_SalI (SEQ ID NO: 4203) AAAGTCGACAAAGTTAGCGACCAAGAAACC LYM37_NR_XbaI (SEQ ID NO: 4204) AAATCTAGACATTTCTTTTGGATGGATGAAC |
| LYM4 | EcoRV, KpnI | LYM4_NF_EcoRV (SEQ ID NO: 4107) AAAGATATCACCTCGAAACCCTAGATCG LYM4_EF_EcoRV (SEQ ID NO: 4108) AAAGATATCATTCCTCGACCAGCTCACG LYM4_NR_Kpn (SEQ ID NO: 4109) TTAGGTACCACTCAAAGGAGAGCTTCAGCC LYM4 ER KpnI (SEQ ID NO: 4110) TAAGGTACCGTTGGCATTCTTCAAACCAG |
| LYM40 | | LYM40_NF_SalI (SEQ ID NO: 4111) AAAGTCGACCCTCGAGAGCTCAATGATTCG LYM40_NR_XbaI (SEQ ID NO: 4112) AAATCTAGAACCAACCAATTAAAGGCTAATG |
| LYM41 | SalI, XbaI | LYM41_NF_SalI (SEQ ID NO: 4113) AAAGTCGACGATTGGTTGCTTGGGTTTG LYM41_NR_XbaI (SEQ ID NO: 4114) AAATCTAGATGCTTTCTTTCAGAACATCTCC |

TABLE 26-continued

The PCR primers used for cloning the genes of some embodiments of the invention into high copy vectors

| Gene Name | Restriction Enzymes used for cloning | Primers used for amplification |
|---|---|---|
| LYM42 | SalI, XbaI | LYM42_NF_SalI (SEQ ID NO: 4115)<br>AAAGTCGACAACCTCTCCTCCTCGTCACAC<br>LYM42_EF_SalI (SEQ ID NO: 4116)<br>AAAGTCGACATCAAACCTCTCCTCCTCGTC<br>LYM42_NR_XbaI (SEQ ID NO: 4117)<br>AATTCTAGATCACAGGAAGGAGGGGTAGTAACAG<br>LYM42_ER_XbaI (SEQ ID NO: 4118)<br>AAATCTAGAATTTCCTGCTGTTCATTCAAAG |
| LYM43 | SalI, XbaI | LYM43_NF_SalI (SEQ ID NO: 4119)<br>AAAGTCGACTCAGTGTTCTTCCATTCTTTCC<br>LYM43_NR_XbaI (SEQ ID NO: 4120)<br>AAATCTAGATTGAATTAGCAGCAGCAAGAG |
| LYM44 | SalI, XbaI | LYM44_NF_SalI (SEQ ID NO: 4121)<br>AAAGTCGACCGAACTAACTAACCATCTCATCC<br>LYM44_NR_XbaI (SEQ ID NO: 4122)<br>AAATCTAGAATCGTTCGATTATTATTGCTCC |
| LYM5 | EcoRV, PstI | LYM5_EF_EcoRV (SEQ ID NO: 4123)<br>AAAGATATCTCCTCTTCTCAAACTCCATCTC<br>LYM5_ER_PstI (SEQ ID NO: 4124)<br>AATCTGCAGGGTCCTGTCATGCTGTGTAGTC |
| LYM51 | SalI, XbaI | LYM51_EF_SalI (SEQ ID NO: 4125)<br>AAAGTCGACAATTCACCTCCCAAGCAGAG<br>LYM51_ER_XbaI (SEQ ID NO: 4126)<br>AAATCTAGAATACAAGGCCTGCACTACCTAC |
| LYM52 | EcoRV, XhoI | LYM52_F_XhoI (SEQ ID NO: 4127)<br>AAACTCGAGAAACCCGATAAGAAAATGGC<br>LYM52_ER_EcoRV (SEQ ID NO: 4128)<br>TTTGATATCCTAGTGCCATACGTGCCTAACCT |
| LYM53 | SalI, XbaI | LYM53_NF_SalI (SEQ ID NO: 4129)<br>AAAGTCGACATCCTCTCTTTCCACTCCTAGC<br>LYM53_NR_XbaI (SEQ ID NO: 4130)<br>AAATCTAGATAGCACTCAGCTTAATTGGATG |
| LYM56 | SalI, XbaI | LYM56_F_SalI (SEQ ID NO: 4131)<br>AAAGTCGACCTCGCTTGCCCACTCCTT<br>LYM56_F_SalI (SEQ ID NO: 4131)<br>AAAGTCGACCTCGCTTGCCCACTCCTT<br>LYM56_NR_XbaI (SEQ ID NO: 4132)<br>AAATCTAGACTAGCATGATCCTGGATGTTTACTC<br>LYM56_ER_XbaI (SEQ ID NO: 4133)<br>AAATCTAGAAGCAGAGATAGGCATAAGTCCA |
| LYM57 | EcoRV, XhoI | LYM57_NF_EcoRV (SEQ ID NO: 4134)<br>AAAGATATCACCACTAGGACTCAACGAGAAG<br>LYM57_NR_XhoI (SEQ ID NO: 4135)<br>AACCTCGAGAGTAACATCCGAACGTATACACC |
| LYM6 | SmaI, KpnI | LYM6_NF_X/SmaI (SEQ ID NO: 4136)<br>ATACCCGGGAACCACGCGAAGACATGG<br>LYM6_NR_KpnI (SEQ ID NO: 4137)<br>TATGGTACCGGATCAGGTTATACTTCTTATTGAC |
| LYM61 | BamHI, XhoI | LYM61_NF_BamHI (SEQ ID NO: 4138)<br>AAAGGATCCAAGCCTGTTCTCTGTCGATTG<br>LYM61_NR_XhoI (SEQ ID NO: 4139)<br>AAACTCGAGAATGCATGTCCTAGTCTTTACG |
| LYM62 | BamHI, KpnI | LYM62_NF_BamHI (SEQ ID NO: 4140)<br>TTAGGATCCAACATTTACGCGATCCATTG<br>LYM62_EF_BamHI (SEQ ID NO: 4141)<br>TTAGGATCCATCATCTGCTTTGTCTACCTCG<br>LYM62_NR_KpnI (SEQ ID NO: 4142)<br>ATCGGTACCTCAACTGAATTCGCTGAAACTTGTC<br>LYM62_ER_KpnI (SEQ ID NO: 4143)<br>AAAGGTACCGAAAACAAATGGAAGCAATCTG |

TABLE 26-continued

The PCR primers used for cloning the genes of some embodiments of the invention into high copy vectors

| Gene Name | Restriction Enzymes used for cloning | Primers used for amplification |
|---|---|---|
| LYM66 | EcoRV, XhoI | LYM66_NF_EcoRV (SEQ ID NO: 4144)<br>AAAGATATCGAGACGCAAGAAACATAGCTC<br>LYM66_NR_XhoI (SEQ ID NO: 4145)<br>AAACTCGAGCAATCACTGCTACAAATCCGT |
| LYM67 | SalI, XbaI | LYM67_NF_SalI (SEQ ID NO: 4146)<br>TATGTCGACTCTTCTTCACTGAGGCAAGTTC<br>LYM67_NR_XbaI (SEQ ID NO: 4147)<br>AAGTCTAGATCAAAGATCCATAACATTCCATGC |
| LYM68 | SalI, XhoI | LYM68_NF_SalI (SEQ ID NO: 4148)<br>ATTGTCGACTTGAGATAAAGGCAAAATTACG<br>LYM68_EF_SalI (SEQ ID NO: 4149)<br>TTTGTCGACGTCTCGTTTCAGATTCTTCTGC<br>LYM68_NR_XhoI (SEQ ID NO: 4150)<br>TTCCTCGAGTCTCTAGAGTTGCATTCCTTCC<br>LYM68_ER_XhoI (SEQ ID NO: 4151)<br>TGACTCGAGCATCGTTTACACTGAACCACTG |
| LYM69 | SalI, XbaI | LYM69_NF_SalI (SEQ ID NO: 4152)<br>AAAGTCGACACCCAGGAACACATCATCATC<br>LYM69_NR_XbaI (SEQ ID NO: 4153)<br>AAATCTAGAAGGACACGTCAAATGAGAAAAC |
| LYM7 | SalI, XbaI | LYM7_NF_SalI (SEQ ID NO: 4154)<br>AAAGTCGACAGTCAGATCCATTCCTCCTCC<br>LYM7_NR_XbaI (SEQ ID NO: 4155)<br>AATTCTAGAAAAAGTAGCAGCCGGTCATC |
| LYM73 | | LYM73_EF_SalI (SEQ ID NO: 4156)<br>AACGTCGACAATCTTGACACCATCTCGCTC<br>LYM73_ER_StuI (SEQ ID NO: 4157)<br>TTTAGGCCTCTCGCACATTATTTTGTACAGC |
| LYM79 | SalI, XbaI | LYM79_F_SalI (SEQ ID NO: 4158)<br>AAAGTCGACGCGACAGAGAATCCATGGC<br>LYM79_F_SalI (SEQ ID NO: 4158)<br>AAAGTCGACGCGACAGAGAATCCATGGC<br>LYM79_NR_XbaI (SEQ ID NO: 4159)<br>AATTCTAGATCAAACTCCTCTTATATGCACCTGC<br>LYM79_ER_XbaI (SEQ ID NO: 4160)<br>AAATCTAGATCAGAAACTAACTCCTCTTATATGCACC |
| LYM8 | XhoI, KpnI | LYM8 NF XhoI (SEQ ID NO: 4161)<br>ATACTCGAGCTTCCCCGATAGAAATCCATC<br>LYM8 NR KpnI (SEQ ID NO: 4162)<br>TAGGGTACCACCAAACAGCACATATGCGG |
| LYM82 | SalI, XbaI | LYM82_EF_SalI (SEQ ID NO: 4163)<br>AAAGTCGACCGCAACCGGAGAGAAATC<br>LYM82_ER_XbaI (SEQ ID NO: 4164)<br>AAATCTAGATCGACAATCTTCATACACAACG |
| LYM83 | | LYM83_NF_BamHI (SEQ ID NO: 4165)<br>AAAGGATCCCGACAGTCACCACTCACCAAC<br>LYM83_F2_BamHI (SEQ ID NO: 4166)<br>AAAGGATCCTCCGCACGCAACTCAGTG<br>LYM83_R2_XhoI (SEQ ID NO: 4167)<br>AAACTCGAGCAACGGTAACACACAAGCATTC<br>LYM83_R2_XhoI (SEQ ID NO: 4167)<br>AAACTCGAGCAACGGTAACACACAAGCATTC |
| LYM84 | BamHI, XhoI | LYM84_NF_BamHI (SEQ ID NO: 4168)<br>AAAGGATCCACCCAGAACCCGAAGAATG<br>LYM84_F2_BamHI (SEQ ID NO: 4169)<br>AATGGATCCTAAACCCAGAACCCGAAGAATG<br>LYM84_R2_XhoI (SEQ ID NO: 4170)<br>AAACTCGAGCAAACTGGAGCATAGCAACTAGG<br>LYM84_R2_XhoI (SEQ ID NO: 4170)<br>AAACTCGAGCAAACTGGAGCATAGCAACTAGG |

TABLE 26-continued

The PCR primers used for cloning the genes of some
embodiments of the invention into high copy vectors

| Gene Name | Restriction Enzymes used for cloning | Primers used for amplification |
|---|---|---|
| LYM86 | BamHI, XhoI | LYM86_EF_BamHI (SEQ ID NO: 4171)<br>AAAGGATCCCACACACCACAGTCGCAATC<br>LYM86_ER_XhoI (SEQ ID NO: 4172)<br>AAACTCGAGAGAATCGATGCAGGTAACTACG |
| LYM88 | BamHI, XhoI | LYM88_F_BamHI (SEQ ID NO: 4173)<br>AAAGGATCCACAATAAACAAGATAAATGGAGG<br>LYM88_F_BamHI (SEQ ID NO: 4173)<br>AAAGGATCCACAATAAACAAGATAAATGGAGG<br>LYM88_NR_XhoI (SEQ ID NO: 4174)<br>AAACTCGAGTCACACGCAACTTCAGGTTC<br>LYM88_ER_XhoI (SEQ ID NO: 4175)<br>AAACTCGAGCAAACCGAATTATTACATCAGG |
| LYM89 | SalI, SacI | LYM89_NF_SalI (SEQ ID NO: 4176)<br>AAAGTCGACGGCCGACACATCTGATCTAAC<br>LYM89_NR_SacI (SEQ ID NO: 4177)<br>AAAGAGCTCTCCCAGAAATATATAAGAACAAGC |
| LYM9 | SalI, XbaI | LYM9_NF_SalI (SEQ ID NO: 4178)<br>AAAGTCGACAACTCCCCAACCAAGCAG<br>LYM9_NR_XbaI (SEQ ID NO: 4179)<br>AAATCTAGATTAGTACTAAGAGTCGGCTTTGGC |
| LYM90 | SalI, XbaI | LYM90_NF_SalI (SEQ ID NO: 4180)<br>AAAGTCGACCTAAACCCTAACCCTAGATTGG<br>LYM90_NR_XbaI (SEQ ID NO: 4181)<br>AAATCTAGAAGACTTGGCTAATGCTAACCTG |
| LYM91 | SalI, XbaI | LYM91_F2_SalI (SEQ ID NO: 4182)<br>TAAGTCGACCGTCTCTCAAGCTCGCAGC<br>LYM91_F2_SalI (SEQ ID NO: 4182)<br>TAAGTCGACCGTCTCTCAAGCTCGCAGC<br>LYM91_R2_XbaI (SEQ ID NO: 4183)<br>ATTTCTAGACGAGAGCCTCTAATGGATCACAG<br>LYM91_R2_XbaI (SEQ ID NO: 4183)<br>ATTTCTAGACGAGAGCCTCTAATGGATCACAG |
| LYM93 |  | LYM93_EF_SalI (SEQ ID NO: 4184)<br>AAAGTCGACATTGCACTGCATAGGGCTG<br>LYM93_ER_XbaI (SEQ ID NO: 4185)<br>AAATCTAGACTAAGAGTTGAGCATGATAAATACGAC |
| LYM95 | SalI, XbaI | LYM95_NF_SalI (SEQ ID NO: 4186)<br>ATAGTCGACGAGAAAGTGGAAGAGAACATGG<br>LYM95_EF_SalI (SEQ ID NO: 4187)<br>AAAGTCGACCCGCTGGAGAAAGTGGAAG<br>LYM95_NR_XbaI (SEQ ID NO: 4188)<br>AAATCTAGAGTCCACAGATCCATGTCAAATC<br>LYM95_ER_XbaI (SEQ ID NO: 4189)<br>AAATCTAGAGTGAATTTGATTTATTGCCAAC |
| LYM99 | BamHI, KpnI | LYM99_NF_BamHI (SEQ ID NO: 4190)<br>AAAGGATCCCCGACCACGGATTGATTC<br>LYM99_EF_BamHI (SEQ ID NO: 4191)<br>AAAGGATCCTTGACTTGGGTGTCTGGTCC<br>LYM99_NR_KpnI (SEQ ID NO: 4192)<br>AAAGGTACCGTGCCTATGTCTTCCTAGCATC<br>LYM99_ER_KpnI (SEQ ID NO: 4193)<br>AAAGGTACCATATTTAGGCGCCAGTAAAGAC |

Table 26. Provided are the PCR primers used for cloning the genes of some embodiments of the invention.
Fwd = forward primer;
Rev = reverse primer;
Nested = nested primer for PCR (internal primer);
External = external primer for PCR.

To facilitate cloning of the cDNAs/genomic sequences, a 8-12 by extension was added to the 5' of each primer. The primer extension includes an endonuclease restriction site. The restriction sites were selected using two parameters: (a). The site did not exist in the cDNA sequence; and (b). The restriction sites in the forward and reverse primers were designed such that the digested cDNA is inserted in the sense formation into the binary vector utilized for transformation.

Each digested PCR product was inserted into a high copy vector pBlue-script KS plasmid vector [pBlue-script KS plasmid vector, Hypertext Transfer Protocol://World Wide Web (dot) stratagene (dot) com/manuals/212205 (dot) pdf] or into plasmids originating from this vector. In cases where the pGXN/pGXNa high copy vector (originated from pBluescript KS) was used, the PCR product was inserted upstream to the NOS terminator (SEQ ID NO: 4194) originated from pBI 101.3 binary vector (GenBank Accession No. U12640, nucleotides 4356 to 4693) and downstream to the 35S promoter. The digested products and the linearized plasmid vector were ligated using T4 DNA ligase enzyme (Roche, Switzerland). In some cases PCR products were cloned without digestion into pCR-Blunt II-TOPO vector (Invitrogen).

Sequencing of the amplified PCR products was performed, using ABI 377 sequencer (Amersham Biosciences Inc). In all cases, after confirmation of the sequence of the cloned genes, the cloned cDNA accompanied or not with the NOS terminator was introduced into the modified pGI binary vector containing the 6669 promoter [pQFN or pQYN_6669] according to Table 27, via digestion with appropriate restriction endonucleases. In any case the insert was followed by single copy of the NOS terminator (SEQ ID NO:4194).

High copy plasmids containing the cloned genes were digested with restriction endonucleases (New England BioLabs Inc) and cloned into binary vectors according to Table 27, below.

Binary Vectors Used for Cloning:

Evolution of binary vectors construction: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, was replaced by the GUS-Intron gene followed by the NOS terminator (SEQ ID NO:4194) (Vancanneyt. G, et al MGG 220, 245-50, 1990). The modified pGI vector (pQXYN) is a modified version of the pGI vector in which the cassette is inverted between the left and right borders so the gene and its corresponding promoter are close to the right border and the NPTII gene is close to the left border.

Figure 2:
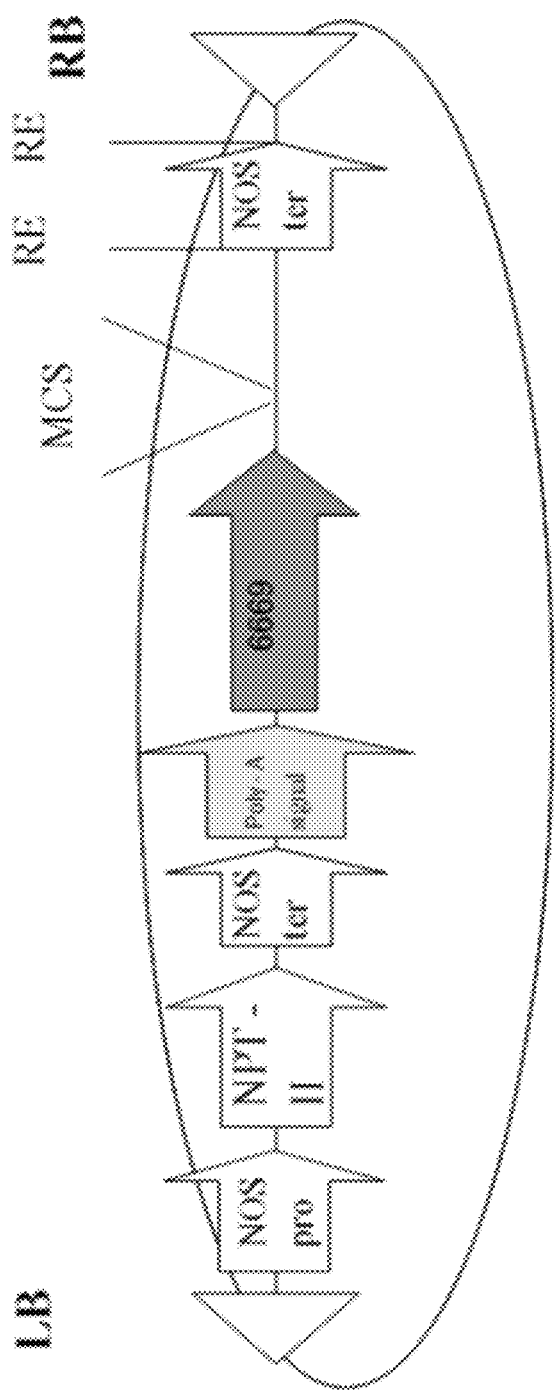
FIG. 2 is a schematic illustration of the modified pGI binary plasmid containing the new At6669 promoter (SEQ ID NO:4198) (pQFN) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.

Vectors used for cloning the polynucleotides of some embodiments of the invention: Cloned genes were digested from the high copy vectors and cloned into one of the following binary vectors: pQFN or pQYN_6669.

pQFN (see FIG. 2) and pQYN_6669 (see FIG. 1) are modified pGI vectors in which the 35S promoter was replaced by the new At6669 promoter (SEQ ID NO:4198). pQYN_6669 contains the GUSintron sequence, while pQFN lacks the GUSintron sequence

TABLE 27

Restriction enzyme sites used to clone identified genes according to some embodiments of the invention into binary vectors

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| LYM1 | pQFN | SalI | EcoRI | SalI, EcoRI |
| LYM10 | pQFN | XhoI | KpnI | XhoI, KpnI |
| LYM100 | pQYN_6669 | SalI | EcoRI | SalI, EcoRI |
| LYM102 | pQFN | BamHI | XhoI | BamHI, XhoI |
| LYM103 | pQFN | BamHI | XhoI | BamHI, XhoI |
| LYM105 | pQFN | BamHI | XhoI | BamHI, XhoI |
| LYM106 | pQYN_6669 | SalI | EcoRI | SalI, EcoRI |
| LYM107 | pQFN | BamHI | XhoI | BamHI, XhoI |
| LYM109 | pQFN | XhoI | StuI | XhoI, StuI |
| LYM110 | pQFN | BamHI | XhoI | BamHI, XhoI |
| LYM111 | pQFN | XhoI | EcoRI | XhoI, EcoRI |
| LYM112 | pQFN | BamHI | XhoI | BamHI, XhoI |
| LYM113 | pQYN_6669 | SalI | EcoRI | SalI, EcoRI |
| LYM115 | pQFN | BamHI | XhoI | BamHI, XhoI |
| LYM116 | pQYN_6669 | SalI | EcoRI | SalI, EcoRI |
| LYM117 | pQFN | BamHI | EcoRV | BamHI, StuI |
| LYM118 | pQFN | BamHI | XhoI | BamHI, XhoI |
| LYM119 | pQYN_6669 | SalI | EcoRI | SalI, EcoRI |
| LYM12 | pQFN | XhoI | KpnI | XhoI, KpnI |
| LYM120 | pQFN | BamHI | XhoI | BamHI, XhoI |
| LYM121 | pQFN | BamHI | XhoI | BamHI, XhoI |
| LYM122_G | pQFN | BamHI | XhoI | BamHI, XhoI |
| LYM122_S | pQFN | BamHI | XhoI | BamHI, XhoI |
| LYM123 | pQFN | BamHI | XhoI | BamHI, XhoI |
| LYM125 | pQFN | BamHI | KpnI | BamHI, KpnI |
| LYM126 | pQFN | BamHI | KpnI | BamHI, KpnI |
| LYM127 | pQFN | BamHI | XhoI | BamHI, XhoI |
| LYM128 | pQFN | BamHI | XhoI | BamHI, XhoI |
| LYM129 | pQFN | SalI | EcoRI | SalI, EcoRI |
| LYM13 | pQFN | SalI | BamHI | SalI, BamHI |
| LYM130 | pQYN_6669 | SalI | EcoRI | SalI, EcoRI |
| LYM131 | pQFN | SalI | XhoI | SalI, XhoI |
| LYM132 | pQFN | BamHI | XhoI | BamHI, XhoI |

TABLE 27-continued

Restriction enzyme sites used to clone identified genes according to some embodiments of the invention into binary vectors

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| LYM134 | pQFN | BamHI | XhoI | BamHI, XhoI |
| LYM135 | pQFN | SalI | KpnI | SalI, KpnI |
| LYM136 | pQFN | BamHI | KpnI | BamHI, KpnI |
| LYM137 | pQYN_6669 | SalI | EcoRI | SalI, EcoRI |
| LYM138 | pQFN | SalI | Ecl136II | SalI, StuI |
| LYM14 | pQFN | SalI | BamHI | SalI, BamHI |
| LYM140 | pQFN | XhoI | EcoRI | XhoI, EcoRI |
| LYM141 | pQFN | BamHI | KpnI | BamHI, KpnI |
| LYM142 | pQYN_6669 | SalI | EcoRI | SalI, EcoRI |
| LYM143 | pQYN_6669 | SalI | EcoRI | SalI, EcoRI |
| LYM144 | pQFN | SalI | EcoRV | SalI, StuI |
| LYM145 | pQFN | BamHI | XhoI | BamHI, XhoI |
| LYM146 | pQFN | KpnI | KpnI | KpnI, KpnI |
| LYM147 | pQFN | SalI | EcoRI | SalI, EcoRI |
| LYM148 | pQFN | BamHI | XbaI | BamHI, XhoI |
| LYM149 | pQYN_6669 | SalI | EcoRI | SalI, EcoRI |
| LYM15 | pQFN | SalI | EcoRI | SalI, EcoRI |
| LYM152 | pQYN_6669 | SalI | EcoRI | SalI, EcoRI |
| LYM153 | pQYN_6669 | SalI | EcoRI | SalI, EcoRI |
| LYM154 | pQFN | XhoI | StuI | XhoI, StuI |
| LYM155 | pQYN_6669 | SalI | EcoRI | SalI, EcoRI |
| LYM156 | pQFN | StuI | StuI | SmaI, SmaI |
| LYM157_G | pQYN_6669 | SalI | EcoRI | SalI, EcoRI |
| LYM157_S | pQFN | SalI | StuI | SalI, StuI |
| LYM159 | pQYN_6669 | SalI | EcoRI | SalI, EcoRI |
| LYM16 | pQFN | SalI | EcoRI | SalI, EcoRI |
| LYM160 | pQYN_6669 | SalI | EcoRI | SalI, EcoRI |
| LYM161 | pQFN | BamHI | XhoI | BamHI, XhoI |
| LYM162 | pQFN | BamHI | XhoI | BamHI, XhoI |
| LYM164 | pQYN_6669 | SalI | EcoRI | SalI, EcoRI |
| LYM165 | pQFN | XhoI | Ecl136II | XhoI, StuI |
| LYM17 | pQFN | SmaI | KpnI | SmaI, KpnI |
| LYM170 | pQYN_6669 | SalI | EcoRI | SalI, EcoRI |
| LYM172 | pQFN | BamHI | XhoI | BamHI, XhoI |
| LYM173 | pQFN | BamHI | XhoI | BamHI, XhoI |
| LYM174 | pQFN | BamHI | KpnI | BamHI, KpnI |
| LYM175 | pQYN_6669 | SalI | EcoRI | SalI, EcoRI |
| LYM176 | pQYN_6669 | SalI | EcoRI | SalI, EcoRI |
| LYM178 | pQYN_6669 | SalI | EcoRI | SalI, EcoRI |
| LYM179 | pQFN | SalI | StuI | SalI, StuI |
| LYM180 | pQFN | BamHI | XhoI | BamHI, XhoI |
| LYM181 | pQFN | BamHI | EcoRV | BamHI, StuI |
| LYM183 | pQFN | SalI | XbaI | SalI, StuI |
| LYM184 | pQFN | BamHI | XhoI | BamHI, XhoI |
| LYM185 | pQFN | BamHI | KpnI | BamHI, KpnI |
| LYM186 | pQFN | SalI | Ecl136II | SalI, StuI |
| LYM188 | pQFN | BamHI | XhoI | BamHI, XhoI |
| LYM189 | pQYN_6669 | SalI | EcoRI | SalI, EcoRI |
| LYM19 | pQYN_6669 | SalI | EcoRI | SalI, EcoRI |
| LYM192 | pQFN | XhoI | EcoRV | XhoI, StuI |
| LYM193 | pQFN | BamHI | XhoI | BamHI, XhoI |
| LYM194 | pQFN | SalI | XhoI | SalI, SalI |
| LYM196 | pQFN | BamHI | XhoI | BamHI, XhoI |
| LYM197 | pQFN | BamHI | XhoI | BamHI, XhoI |
| LYM198 | pQFN | BamHI | XhoI | BamHI, XhoI |
| LYM2 | pQFN | EcoRV | KpnI | SmaI, KpnI |
| LYM20 | pQFN | EcoRV | KpnI | SmaI, KpnI |
| LYM200 | pQFN | BamHI | XhoI | BamHI, XhoI |
| LYM201 | pQFN | BamHI | XhoI | BamHI, XhoI |
| LYM203 | pQFN | BamHI | XhoI | BamHI, XhoI |
| LYM204 | pQFN | BamHI | XhoI | BamHI, XhoI |
| LYM206 | pQFN | XhoI | EcoRV | XhoI, StuI |
| LYM207 | pQFN | BamHI | KpnI | BamHI, KpnI |
| LYM208 | pQFN | BamHI | KpnI | BamHI, KpnI |
| LYM21 | pQFN | EcoRV | KpnI | SmaI, KpnI |
| LYM212 | pQYN_6669 | SalI | EcoRI | SalI, EcoRI |
| LYM213 | pQFN | BamHI | XhoI | BamHI, XhoI |
| LYM215 | pQFN | BamHI | XhoI | BamHI, XhoI |
| LYM217 | pQYN_6669 | SalI | EcoRI | SalI, EcoRI |
| LYM219 | pQFN | BamHI | KpnI | BamHI, KpnI |
| LYM22 | pQYN_6669 | SalI | EcoRI | SalI, EcoRI |

TABLE 27-continued

Restriction enzyme sites used to clone identified genes according to some embodiments of the invention into binary vectors

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| LYM220 | pQFN | BamHI | EcoRV | BamHI, StuI |
| LYM221 | pQFN | BamHI | XhoI | BamHI, XhoI |
| LYM223 | pQFN | XhoI | EcoRI | XhoI, EcoRI |
| LYM224 | pQFN | BamHI | XhoI | BamHI, XhoI |
| LYM227 | pQFN | BamHI | KpnI | BamHI, KpnI |
| LYM228 | pQFN | StuI | KpnI | KpnI, EcoRV |
| LYM23 | pQFN | BamHI | KpnI | BamHI, KpnI |
| LYM232 | pQFN | BamHI | XhoI | BamHI, XhoI |
| LYM233 | pQFN | BamHI | XhoI | BamHI, XhoI |
| LYM234 | pQFN | BamHI | XhoI | BamHI, XhoI |
| LYM236 | pQFN | SalI | EcoRI | SalI, EcoRI |
| LYM238 | pQFN | SmaI | KpnI | SmaI, KpnI |
| LYM239 | pQFN | BamHI | XhoI | BamHI, XhoI |
| LYM24 | pQFN | SalI | EcoRI | SalI, EcoRI |
| LYM240 | pQFN | BamHI | KpnI | BamHI, KpnI |
| LYM241 | pQFN | BamHI | XhoI | BamHI, XhoI |
| LYM242 | pQFN | BamHI | XhoI | BamHI, XhoI |
| LYM243 | pQFN | BamHI | XhoI | BamHI, XhoI |
| LYM245 | pQFN | BamHI | KpnI | BamHI, KpnI |
| LYM248 | pQFN | BamHI | EcoRV | BamHI, StuI |
| LYM249 | pQFN | BamHI | KpnI | BamHI, KpnI |
| LYM250 | pQFN | SalI | XbaI | SalI, StuI |
| LYM251 | pQFN | SalI | Ecl136II | SalI, StuI |
| LYM252 | pQFN | BamHI | KpnI | BamHI, KpnI |
| LYM254 | pQFN | SalI | BamHI | SalI, BamHI |
| LYM255 | pQFN | BamHI | XhoI | BamHI, XhoI |
| LYM256 | pQFN | BamHI | XhoI | BamHI, XhoI |
| LYM26 | pQYN_6669 | SalI | EcoRI | SalI, EcoRI |
| LYM260 | pQFN | BamHI | KpnI | BamHI, KpnI |
| LYM261 | pQFN | SmaI | KpnI | SmaI, KpnI |
| LYM267 | pQFN | SalI | EcoRV | SalI, StuI |
| LYM268 | pQFN | XhoI | EcoRV | XhoI, StuI |
| LYM270 | pQFN | BamHI | XhoI | BamHI, XhoI |
| LYM271 | pQFN | BamHI | XhoI | BamHI, XhoI |
| LYM273_G | pQFN | BamHI | XhoI | BamHI, XhoI |
| LYM273_S | pQFN | BamHI | XhoI | BamHI, XhoI |
| LYM274 | pQFN | BamHI | XhoI | BamHI, XhoI |
| LYM277 | pQFN | SalI | Ecl136II | SalI, StuI |
| LYM278 | pQYN_6669 | SalI | EcoRI | SalI, EcoRI |
| LYM283 | pQFN | SmaI | KpnI | SmaI, KpnI |
| LYM284 | pQFN | BamHI | KpnI | BamHI, KpnI |
| LYM285 | pQFN | XhoI | EcoRV | XhoI, StuI |
| LYM287 | pQFN | XhoI | EcoRV | XhoI, StuI |
| LYM288 | pQFN | XhoI | EcoRI | XhoI, EcoRI |
| LYM289 | pQYN_6669 | SalI | EcoRI | SalI, EcoRI |
| LYM290 | pQFN | BamHI | KpnI | BamHI, KpnI |
| LYM291 | pQFN | SalI | BamHI | SalI, BamHI |
| LYM293 | pQFN | XhoI | EcoRI | XhoI, EcoRI |
| LYM3 | pQFN | XhoI | KpnI | XhoI, KpnI |
| LYM30 | pQFN | SalI | XhoI | SalI, XhoI |
| LYM31 | pQFN | SalI | XhoI | SalI, XhoI |
| LYM32 | pQFN | BamHI | KpnI | BamHI, KpnI |
| LYM34 | pQFN | BamHI | KpnI | BamHI, KpnI |
| LYM35 | pQYN_6669 | SalI | EcoRI | SalI, EcoRI |
| LYM36 | pQFN | StuI | StuI | StuI, StuI |
| LYM37 | pQYN_6669 | SalI | EcoRI | SalI, EcoRI |
| LYM38 | pQFN | SalI | BamHI | SalI, BamHI |
| LYM4 | pQFN | EcoRV | KpnI | SmaI, KpnI |
| LYM40 | pQFN | SalI | EcoRV | SalI, StuI |
| LYM41 | pQYN_6669 | SalI | EcoRI | SalI, EcoRI |
| LYM42 | pQYN_6669 | SalI | EcoRI | SalI, EcoRI |
| LYM43 | pQYN_6669 | SalI | EcoRI | SalI, EcoRI |
| LYM44 | pQYN_6669 | SalI | EcoRI | SalI, EcoRI |
| LYM5 | pQFN | SalI | BamHI | SalI, BamHI |
| LYM51 | pQYN_6669 | SalI | EcoRI | SalI, EcoRI |
| LYM52 | pQFN | XhoI | EcoRV | XhoI, StuI |
| LYM53 | pQYN_6669 | SalI | EcoRI | SalI, EcoRI |
| LYM56 | pQYN_6669 | SalI | EcoRI | SalI, EcoRI |
| LYM57 | pQFN | EcoRV | XhoI | SmaI, XhoI |
| LYM6 | pQFN | SmaI | KpnI | SmaI, KpnI |
| LYM61 | pQFN | BamHI | XhoI | BamHI, XhoI |

TABLE 27-continued

Restriction enzyme sites used to clone identified genes according to some embodiments of the invention into binary vectors

| Gene name | Binary vector | Restriction enzymes used for cloning into binary vector- FORWARD | Restriction enzymes used for cloning into binary vector- REVERSE | Restriction enzymes used for digesting the binary vector |
|---|---|---|---|---|
| LYM62 | pQFN | BamHI | KpnI | BamHI, KpnI |
| LYM66 | pQFN | EcoRV | XhoI | SmaI, XhoI |
| LYM67 | pQYN_6669 | SalI | EcoRI | SalI, EcoRI |
| LYM68 | pQFN | SalI | XhoI | SalI, XhoI |
| LYM69 | pQYN_6669 | SalI | EcoRI | SalI, EcoRI |
| LYM7 | pQFN | SalI | EcoRI | SalI, EcoRI |
| LYM73 | pQFN | SalI | StuI | SalI, StuI |
| LYM74 | pQFN | SalI | Ecl136II | SalI, StuI |
| LYM79 | pQYN_6669 | SalI | EcoRI | SalI, EcoRI |
| LYM8 | pQFN | XhoI | KpnI | XhoI, KpnI |
| LYM82 | pQYN_6669 | SalI | EcoRI | SalI, EcoRI |
| LYM83 | pQFN | BamHI | XhoI | BamHI, XhoI |
| LYM84 | pQFN | BamHI | XhoI | BamHI, XhoI |
| LYM86 | pQFN | BamHI | XhoI | BamHI, XhoI |
| LYM88 | pQFN | BamHI | XhoI | BamHI, XhoI |
| LYM89 | pQYN_6669 | SalI | EcoRI | SalI, EcoRI |
| LYM9 | pQFN | SalI | EcoRI | SalI, EcoRI |
| LYM90 | pQYN_6669 | SalI | EcoRI | SalI, EcoRI |
| LYM91 | pQYN_6669 | SalI | EcoRI | SalI, EcoRI |
| LYM93 | pQFN | SalI | XhoI | SalI, XhoI |
| LYM95 | pQYN_6669 | SalI | EcoRI | SalI, EcoRI |
| LYM99 | pQFN | BamHI | KpnI | BamHI, KpnI |

Table 27.

TABLE 28

Genes cloned from cDNA libraries or genomic DNA in a High copy number plasmid

| Gene Name | High copy plasmid | Amplified from Organism | Amplified from Origin | Polynucleotide SEQ ID NO: | Polypeptide SEQ ID NO: |
|---|---|---|---|---|---|
| LYM1 | pGXN (pKG + Nos + 35S) | RICE Oryza sativa L. Japonica ND | cDNA | 3481 | 240 |
| LYM10 | pKS(Pks_J) | RICE Oryza sativa L. Japonica ND | cDNA | 3490 | 249 |
| LYM100 | pGXN (pKG + Nos + 35S) | BARLEY Hordeum vulgare L. Manit | cDNA | 3542 | 301 |
| LYM102 | pKS(Pks_J) | RICE Oryza sativa L. Japonica ND | cDNA | 3543 | 302 |
| LYM103 | pKS(Pks_J) | MAIZE Zea mays L. Pioneer 30G54 | cDNA | 3544 | 3689 |
| LYM105 | pKS(Pks_J) | BARLEY Hordeum vulgare L. Manit | cDNA | 3545 | 3690 |
| LYM106 | pGXN (pKG + Nos + 35S) | BARLEY Hordeum vulgare L. Manit | cDNA | 3546 | 305 |
| LYM107 | pKS(Pks_J) | MAIZE Zea mays L. ND | cDNA | 3589 | 349 |
| LYM109 | pGXNa | MAIZE Zea mays L. ND | cDNA | 3590 | 3702 |
| LYM110 | pKS(Pks_J) | MAIZE Zea mays L. ND | cDNA | 3547 | 3691 |
| LYM111 | pGXNa | MAIZE Zea mays L. Pioneer 30G54 | cDNA | 3548 | 307 |
| LYM112 | pKS(Pks_J) | MAIZE Zea mays L. Pioneer 30G54 | cDNA | 3591 | 3703 |
| LYM113 | pGXN (pKG + Nos + 35S) | MAIZE Zea mays L. Pioneer 30G54 | cDNA | 3592 | 352 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM115 | pKS(Pks_J) | MAIZE *Zea mays* L. ND | cDNA | 3593 | 3704 |
| LYM116 | pGXN (pKG + Nos + 35S) | MAIZE *Zea mays* L. ND | cDNA | 3594 | 354 |
| LYM117 | Topo B | MAIZE *Zea mays* L. ND | cDNA | 3595 | 3705 |
| LYM118 | | | GeneArt | 3596 | 356 |
| LYM119 | pGXN (pKG + Nos + 35S) | MAIZE *Zea mays* L. ND | cDNA | 3549 | 3692 |
| LYM12 | pKS(Pks_J) | RICE *Oryza sativa* L. *Japonica* ND | cDNA | 3491 | 250 |
| LYM120 | pKS(Pks_J) | RICE *Oryza sativa* L. *Japonica* ND | cDNA | 3550 | 309 |
| LYM121 | pKS(Pks_J) | RICE *Oryza sativa* L. *Japonica* ND | cDNA | 3597 | 357 |
| LYM122_G | Topo B | RICE *Oryza sativa* L. *Japonica* ND | Genomic | 3739 | 310 |
| LYM122_S | | | GeneArt | 3551 | 310 |
| LYM123 | | | GeneArt | 3598 | 358 |
| LYM125 | Topo B | RICE *Oryza sativa* L. *Japonica* ND | cDNA | 3552 | 311 |
| LYM126 | | | GeneArt | 3553 | 312 |
| LYM127 | Topo B | RICE *Oryza sativa* L. *Japonica* ND | cDNA | 3554 | 313 |
| LYM128 | pKS(Pks_J) | RICE *Oryza sativa* L. *Japonica* ND | cDNA | 3555 | 314 |
| LYM129 | pGXN (pKG + Nos + 35S) | RICE *Oryza sativa* L. *Indica* ND + RICE *Oryza sativa* L. *Japonica* ND | cDNA | 3556 | 315 |
| LYM13 | pKS(Pks_J) | RICE *Oryza sativa* L. *Japonica* ND | cDNA | 3492 | 251 |
| LYM130 | pGXN (pKG + Nos + 35S) | RICE *Oryza sativa* L. *Indica* ND | cDNA | 3557 | 316 |
| LYM131 | pGXNa | RICE *Oryza sativa* L. *Japonica* ND | cDNA | 3558 | 3693 |
| LYM132 | pKS(Pks_J) | RICE *Oryza sativa* L. *Japonica* ND | cDNA | 3559 | 318 |
| LYM134 | pKS(Pks_J) | RICE *Oryza sativa* L. *Japonica* ND | cDNA | 3560 | 319 |
| LYM135 | Topo B | RICE *Oryza sativa* L. *Japonica* ND | cDNA | 3599 | 359 |
| LYM136 | pKS(Pks_J) | RICE *Oryza sativa* L. *Japonica* ND | cDNA | 3561 | 3694 |
| LYM137 | pGXN (pKG + Nos + 35S) | BARLEY *Hordeum vulgare* L. Manit | cDNA | 3562 | 321 |
| LYM138 | pGXN (pKG + Nos + 35S) | RICE *Oryza sativa* L. *Japonica* ND | cDNA | 3600 | 360 |
| LYM14 | pKS(Pks_J) | RICE *Oryza sativa* L. *Japonica* ND | cDNA | 3493 | 252 |
| LYM140 | pGXNa | BARLEY *Hordeum vulgare* L. Manit | cDNA | 3563 | 322 |
| LYM141 | Topo B | RICE *Oryza sativa* L. *Japonica* ND | cDNA | 3564 | 323 |

TABLE 28-continued

Genes cloned from cDNA libraries or genomic DNA in a High copy number plasmid

| Gene Name | High copy plasmid | Organism | Origin | Polynucleotide SEQ ID NO: | Polypeptide SEQ ID NO: |
|---|---|---|---|---|---|
| LYM142 | pGXN (pKG + Nos + 35S) | BARLEY *Hordeum vulgare* L. Manit | cDNA | 3565 | 324 |
| LYM143 | pGXN (pKG + Nos + 35S) | RICE *Oryza sativa* L. Japonica ND | cDNA | 3566 | 325 |
| LYM144 | pKS(Pks_J) | RICE *Oryza sativa* L. Japonica ND | cDNA | 3567 | 3695 |
| LYM145 | pKS(Pks_J) | RICE *Oryza sativa* L. ND | cDNA | 3568 | 327 |
| LYM146 | Topo B | MAIZE *Zea mays* L. ND | Genomic | 3601 | 3706 |
| LYM147 | pGXN (pKG + Nos + 35S) | MAIZE *Zea mays* L. ND | cDNA | 3602 | 3707 |
| LYM148 | pKS(Pks_J) | BARLEY *Hordeum vulgare* L. Manit | cDNA | 3569 | 3696 |
| LYM149 | pGXN (pKG + Nos + 35S) | BARLEY *Hordeum vulgare* L. Manit | cDNA | 3570 | 329 |
| LYM15 | pGXN (pKG + Nos + 35S) | RICE *Oryza sativa* L. Japonica ND | cDNA | 3494 | 253 |
| LYM152 | pGXN (pKG + Nos + 35S) | ARABIDOPSIS *Arabidopsis thaliana* Transgenic Columbia | cDNA | 3571 | 330 |
| LYM153 | pGXN (pKG + Nos + 35S) | RICE *Oryza sativa* L. Japonica ND | cDNA | 3572 | 331 |
| LYM154 | | | GeneArt | 3603 | 363 |
| LYM155 | pGXN (pKG + Nos + 35S) | BARLEY *Hordeum vulgare* L. Manit | cDNA | 3604 | 3708 |
| LYM156 | pGXNa | BARLEY *Hordeum vulgare* L. Manit | cDNA | 3573 | 332 |
| LYM157_G | pGXN (pKG + Nos + 35S) | BARLEY *Hordeum vulgare* L. Manit | cDNA | 3574 | 333 |
| LYM157_S | | | GeneArt | 3574 | 333 |
| LYM159 | pGXN (pKG + Nos + 35S) | BARLEY *Hordeum vulgare* L. Manit | cDNA | 3575 | 3697 |
| LYM16 | pGXN (pKG + Nos + 35S) | RICE *Oryza sativa* L. ND | cDNA | 3495 | 254 |
| LYM160 | pGXN (pKG + Nos + 35S) | BARLEY *Hordeum vulgare* L. Manit | cDNA | 3576 | 3698 |
| LYM161 | pKS(Pks_J) | BARLEY *Hordeum vulgare* L. Manit | cDNA | 3577 | 3699 |
| LYM162 | pKS(Pks_J) | MAIZE *Zea mays* L. ND | cDNA | 3578 | 337 |
| LYM164 | pGXN (pKG + Nos + 35S) | RICE *Oryza sativa* L. ND | cDNA | 3579 | 3700 |
| LYM165 | Topo B | MAIZE *Zea mays* L. Pioneer 30G54 | cDNA | 3580 | 339 |
| LYM17 | pKS(Pks_J) | RICE *Oryza sativa* L. ND | cDNA | 3496 | 255 |
| LYM170 | pGXN (pKG + Nos + 35S) | RICE *Oryza sativa* L. ND | cDNA | 3581 | 341 |
| LYM172 | pKS(Pks_J) | RICE *Oryza sativa* L. Indica ND | cDNA | 3582 | 342 |
| LYM173 | pKS(Pks_J) | RICE *Oryza sativa* L. Japonica ND | cDNA | 3583 | 343 |
| LYM174 | pKS(Pks_J) | SORGHUM *Sorghum bicolor* Monsanto S5 | cDNA | 3584 | 344 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM175 | pGXN (pKG + Nos + 35S) | RICE *Oryza sativa* L. ND | cDNA | 3585 | 345 |
| LYM176 | pGXN (pKG + Nos + 35S) | RICE *Oryza sativa* L. Japonica ND | cDNA | 3586 | 346 |
| LYM178 | pGXN (pKG + Nos + 35S) | *ARABIDOPSIS Arabidopsis thaliana* ND | cDNA | 3587 | 347 |
| LYM179 | pGXNa | MAIZE *Zea mays* L. Pioneer 30G54 | cDNA | 3588 | 3701 |
| LYM180 | pKS(Pks_J) | BARLEY *Hordeum vulgare* L. Manit | cDNA | 3605 | 365 |
| LYM181 | Topo B | BARLEY *Hordeum vulgare* L. Manit | cDNA | 3606 | 366 |
| LYM183 | Topo B | BARLEY *Hordeum vulgare* L. Manit | cDNA | 3655 | 3733 |
| LYM184 | Topo B | BARLEY *Hordeum vulgare* L. Manit | cDNA | 3607 | 3709 |
| LYM185 | pKS(Pks_J) | BARLEY *Hordeum vulgare* L. Manit | cDNA | 3608 | 369 |
| LYM186 | pGXN (pKG + Nos + 35S) | BARLEY *Hordeum vulgare* L. Manit | cDNA | 3609 | 3710 |
| LYM188 | pKS(Pks_J) | BARLEY *Hordeum vulgare* L. Manit | cDNA | 3610 | 371 |
| LYM189 | pGXN (pKG + Nos + 35S) | BARLEY *Hordeum vulgare* L. Manit | cDNA | 3611 | 3711 |
| LYM19 | pGXN (pKG + Nos + 35S) | RICE *Oryza sativa* L. Japonica ND | cDNA | 3497 | 256 |
| LYM192 | pKS(Pks_J) | BARLEY *Hordeum vulgare* L. Manit | cDNA | 3612 | 3712 |
| LYM193 | pKS(Pks_J) | BARLEY *Hordeum vulgare* L. Manit | cDNA | 3613 | 374 |
| LYM194 | | | GeneArt | 3614 | 3713 |
| LYM196 | Topo B | MAIZE *Zea mays* L. ND | cDNA | 3615 | 376 |
| LYM197 | pKS(Pks_J) | MAIZE *Zea mays* L. ND | cDNA | 3616 | 3714 |
| LYM198 | pKS(Pks_J) | MAIZE *Zea mays* L. ND | cDNA | 3617 | 378 |
| LYM2 | pKS(Pks_J) | RICE *Oryza sativa* L. ND | cDNA | 3482 | 241 |
| LYM20 | pKS(Pks_J) | RICE *Oryza sativa* L. Japonica ND | cDNA | 3498 | 257 |
| LYM200 | pKS(Pks_J) | MAIZE *Zea mays* L. ND | cDNA | 3657 | 419 |
| LYM201 | pKS(Pks_J) | MAIZE *Zea mays* L. ND | cDNA | 3618 | 379 |
| LYM203 | pKS(Pks_J) | MAIZE *Zea mays* L. ND | cDNA | 3619 | 380 |
| LYM204 | Topo B | MAIZE *Zea mays* L. Pioneer 30G54 | cDNA | 3620 | 381 |
| LYM206 | pKS(Pks_J) | MAIZE *Zea mays* L. ND | cDNA | 3621 | 3715 |
| LYM207 | Topo B | MAIZE *Zea mays* L. Pioneer 30G54 | cDNA | 3622 | 3716 |
| LYM208 | pKS(Pks_J) | MAIZE *Zea mays* L. Pioneer 30G54 | cDNA | 3623 | 384 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM21 | pKS(Pks_J) | RICE *Oryza sativa L. Japonica* ND | cDNA | 3499 | 258 |
| LYM212 | pGXN (pKG + Nos + 35S) | MAIZE *Zea mays* L. ND | cDNA | 3624 | 3717 |
| LYM213 | pKS(Pks_J) | MAIZE *Zea mays* L. ND | cDNA | 3625 | 386 |
| LYM215 | pKS(Pks_J) | MAIZE *Zea mays* L. ND | cDNA | 3626 | 3718 |
| LYM217 | pGXN | MAIZE *Zea mays* L. ND | cDNA | 3627 | 3719 |
| LYM219 | pKS(Pks_J) | MAIZE *Zea mays* L. Pioneer 30G54 | cDNA | 3628 | 3720 |
| LYM22 | pGXN (pKG + Nos + 35S) | RICE *Oryza sativa L. Japonica* ND | cDNA | 3500 | 259 |
| LYM220 | pKS(Pks_J) | MAIZE *Zea mays* L. Pioneer 30G54 | cDNA | 3629 | 3721 |
| LYM221 | pKS(Pks_J) | MAIZE *Zea mays* L. Pioneer 30G54 | cDNA | 3630 | 3722 |
| LYM223 | pGXNa | MAIZE *Zea mays* L. Pioneer 30G54 | cDNA | 3631 | 392 |
| LYM224 | pKS(Pks_J) | MAIZE *Zea mays* L. Pioneer 30G54 | cDNA | 3632 | 3723 |
| LYM227 | | | GeneArt | 3633 | 394 |
| LYM228 | Topo B | MAIZE *Zea mays* L. Pioneer 30G54 | cDNA | 3634 | 3724 |
| LYM23 | pKS(Pks_J) | RICE *Oryza sativa L. Japonica* ND | cDNA | 3501 | 260 |
| LYM232 | Topo B | RICE *Oryza sativa L. Japonica* ND | cDNA | 3635 | 3725 |
| LYM233 | | | GeneArt | 3636 | 397 |
| LYM234 | | | GeneArt | 3637 | 398 |
| LYM236 | pGXN (pKG + Nos + 35S) | RICE *Oryza sativa L. Japonica* ND | cDNA | 3638 | 3726 |
| LYM238 | Topo B | RICE *Oryza sativa L. Japonica* ND | cDNA | 3639 | 400 |
| LYM239 | pKS(Pks_J) | RICE *Oryza sativa L. Japonica* ND | cDNA | 3640 | 3727 |
| LYM24 | pGXN (pKG + Nos + 35S) | RICE *Oryza sativa L. Japonica* ND | cDNA | 3502 | 261 |
| LYM240 | pKS(Pks_J) | RICE *Oryza sativa L. Japonica* ND | cDNA | 3641 | 402 |
| LYM241 | Topo B | RICE *Oryza sativa L. Japonica* ND | cDNA | 3642 | 3728 |
| LYM242 | pKS(Pks_J) | RICE *Oryza sativa L. Indica* ND | cDNA | 3643 | 404 |
| LYM243 | pKS(Pks_J) | RICE *Oryza sativa L. Japonica* ND | cDNA | 3644 | 405 |
| LYM245 | pKS(Pks_J) | RICE *Oryza sativa L. Japonica* ND | cDNA | 3645 | 406 |
| LYM248 | pKS(Pks_J) | RICE *Oryza sativa L. Indica* ND | cDNA | 3646 | 3729 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM249 | Topo B | RICE *Oryza sativa* L. *Japonica* ND + RICE *Oryza sativa* L. ND | cDNA | 3647 | 3730 |
| LYM250 | pGXN (pKG + Nos + 35S) | RICE *Oryza sativa* L. *Japonica* ND | cDNA | 3648 | 409 |
| LYM251 | Topo B | RICE *Oryza sativa* L. *Japonica* ND | cDNA | 3649 | 410 |
| LYM252 | pKS(Pks_J) | RICE *Oryza sativa* L. *Indica* ND + RICE *Oryza sativa* L. *Japonica* ND | cDNA | 3650 | 411 |
| LYM254 | Topo B | RICE *Oryza sativa* L. *Japonica* ND | cDNA | 3651 | 3731 |
| LYM255 | pKS(Pks_J) | RICE *Oryza sativa* L. *Japonica* ND | cDNA | 3652 | 3732 |
| LYM256 | pKS(Pks_J) | RICE *Oryza sativa* L. *Japonica* ND | cDNA | 3656 | 418 |
| LYM26 | pGXN (pKG + Nos + 35S) | BARLEY *Hordeum vulgare* L. Manit | cDNA | 3503 | 262 |
| LYM260 | Topo B | RICE *Oryza sativa* L. *Japonica* ND | cDNA | 3653 | 414 |
| LYM261 | Topo B | RICE *Oryza sativa* L. *Japonica* ND | cDNA | 3654 | 415 |
| LYM267 | pKS(Pks_J) | MAIZE *Zea mays* L. ND | cDNA | 3658 | 420 |
| LYM268 | Topo B | RICE *Oryza sativa* L. *Indica* ND + RICE *Oryza sativa* L. *Japonica* ND | cDNA | 3659 | 421 |
| LYM270 | pKS(Pks_J) | MAIZE *Zea mays* L. ND | cDNA | 3660 | 422 |
| LYM271 | pKS(Pks_J) | MAIZE *Zea mays* L. Pioneer 30G54 | cDNA | 3661 | 423 |
| LYM273_G | pKS(Pks_J) | RICE *Oryza sativa* L. *Japonica* ND | Genomic | 3738 | 425 |
| LYM273_S | | | GeneArt | 3662 | 425 |
| LYM274 | pKS(Pks_J) | RICE *Oryza sativa* L. *Japonica* ND | cDNA | 3663 | 3734 |
| LYM277 | Topo B | RICE *Oryza sativa* L. *Japonica* ND | cDNA | 3664 | 3735 |
| LYM278 | pGXN (pKG + Nos + 35S) | BARLEY *Hordeum vulgare* L. Manit | cDNA | 3665 | 3736 |
| LYM283 | Topo B | RICE *Oryza sativa* L. ND | cDNA | 3666 | 429 |
| LYM284 | pKS(Pks_J) | RICE *Oryza sativa* L. *Japonica* ND | cDNA | 3667 | 430 |
| LYM285 | pKS(Pks_J) | RICE *Oryza sativa* L. *Japonica* ND | cDNA | 3668 | 431 |
| LYM287 | pKS(Pks_J) | RICE *Oryza sativa* L. *Japonica* ND | cDNA | 3669 | 432 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM288 | pGXNa | RICE *Oryza sativa* L. *Indica* ND + RICE *Oryza sativa* L. *Japonica* ND | cDNA | 3670 | 3737 |
| LYM289 | pGXN (pKG + Nos + 35S) | BARLEY *Hordeum vulgare* L. Manit | cDNA | 3671 | 434 |
| LYM290 | pKS(Pks_J) | MAIZE *Zea mays* L. ND | cDNA | 3672 | 435 |
| LYM291 | pKS(Pks_J) | RICE *Oryza sativa* L. *Japonica* ND | cDNA | 3673 | 436 |
| LYM293 | pGXNa | RICE *Oryza sativa* L. *Indica* ND | cDNA | 3674 | 437 |
| LYM3 | pKS(Pks_J) | RICE *Oryza sativa* L. *Indica* ND | cDNA | 3483 | 3675 |
| LYM30 | pGXNa | RICE *Oryza sativa* L. ND | cDNA | 3504 | 3677 |
| LYM31 | pGXNa | RICE *Oryza sativa* L. ND | cDNA | 3505 | 264 |
| LYM32 | | | GeneArt | 3506 | 265 |
| LYM34 | pKS(Pks_J) | RICE *Oryza sativa* L. *Indica* ND | cDNA | 3507 | 3678 |
| LYM35 | pGXN (pKG + Nos + 35S) | RICE *Oryza sativa* L. ND | cDNA | 3508 | 267 |
| LYM36 | | | GeneArt | 3509 | 268 |
| LYM37 | pGXN (pKG + Nos + 35S) | RICE *Oryza sativa* L. *Japonica* ND | cDNA | 3510 | 269 |
| LYM38 | | | GeneArt | 3511 | 270 |
| LYM4 | pKS(Pks_J) | RICE *Oryza sativa* L. ND | cDNA | 3484 | 243 |
| LYM40 | Topo B | RICE *Oryza sativa* L. *Japonica* ND | cDNA | 3512 | 271 |
| LYM41 | pGXN (pKG + Nos + 35S) | RICE *Oryza sativa* L. *Japonica* ND | cDNA | 3513 | 272 |
| LYM42 | pGXN (pKG + Nos + 35S) | RICE *Oryza sativa* L. *Japonica* ND | cDNA | 3514 | 273 |
| LYM43 | pGXN (pKG + Nos + 35S) | RICE *Oryza sativa* L. ND | cDNA | 3515 | 274 |
| LYM44 | pGXN (pKG + Nos + 35S) | RICE *Oryza sativa* L. *Japonica* ND | cDNA | 3516 | 275 |
| LYM5 | pKS(Pks_J) | RICE *Oryza sativa* L. *Indica* ND | cDNA | 3485 | 244 |
| LYM51 | pGXN (pKG + Nos + 35S) | BARLEY *Hordeum vulgare* L. Manit | cDNA | 3517 | 3679 |
| LYM52 | pKS(Pks_J) | BARLEY *Hordeum vulgare* L. Manit | cDNA | 3518 | 277 |
| LYM53 | pGXN (pKG + Nos + 35S) | MAIZE *Zea mays* L. ND | cDNA | 3519 | 3680 |
| LYM56 | pGXN (pKG + Nos + 35S) | BARLEY *Hordeum vulgare* L. Manit | cDNA | 3520 | 3681 |
| LYM57 | pKS(Pks_J) | RICE *Oryza sativa* L. *Japonica* ND | cDNA | 3521 | 3682 |
| LYM6 | pKS(Pks_J) | RICE *Oryza sativa* L. ND | cDNA | 3486 | 3676 |
| LYM61 | pKS(Pks_J) | MAIZE *Zea mays* L. ND | cDNA | 3522 | 3683 |

TABLE 28-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| LYM62 | pKS(Pks_J) | MAIZE Zea mays L. ND | cDNA | 3523 | 3684 |
| LYM66 | pKS(Pks_J) | BARLEY Hordeum vulgare L. Manit | cDNA | 3524 | 3685 |
| LYM67 | pGXN (pKG + Nos + 35S) | RICE Oryza sativa L. ND | cDNA | 3525 | 284 |
| LYM68 | pGXNa | RICE Oryza sativa L. ND | cDNA | 3526 | 3686 |
| LYM69 | pGXN (pKG + Nos + 35S) | RICE Oryza sativa L. ND | cDNA | 3527 | 286 |
| LYM7 | pGXN (pKG + Nos + 35S) | RICE Oryza sativa L. ND | cDNA | 3487 | 246 |
| LYM73 | Topo B | RICE Oryza sativa L. ND | cDNA | 3528 | 287 |
| LYM74 | | | GeneArt | 3529 | 288 |
| LYM79 | pGXN (pKG + Nos + 35S) | MAIZE Zea mays L. ND | cDNA | 3530 | 3687 |
| LYM8 | pKS(Pks_J) | RICE Oryza sativa L. Japonica ND | cDNA | 3488 | 247 |
| LYM82 | pGXN (pKG + Nos + 35S) | BARLEY Hordeum vulgare L. Manit | cDNA | 3531 | 290 |
| LYM83 | Topo B | BARLEY Hordeum vulgare L. Manit | cDNA | 3532 | 3688 |
| LYM84 | pKS(Pks_J) | BARLEY Hordeum vulgare L. Manit | cDNA | 3533 | 292 |
| LYM86 | pKS(Pks_J) | RICE Oryza sativa L. Indica ND | cDNA | 3534 | 293 |
| LYM88 | pKS(Pks_J) | ARABIDOPSIS Arabidopsis thaliana Transgenic Columbia | cDNA | 3535 | 294 |
| LYM89 | pGXN (pKG + Nos + 35S) | ARABIDOPSIS Arabidopsis thaliana Transgenic Columbia | cDNA | 3536 | 295 |
| LYM9 | pGXN (pKG + Nos + 35S) | RICE Oryza sativa L. ND | cDNA | 3489 | 248 |
| LYM90 | pGXN (pKG + Nos + 35S) | BARLEY Hordeum vulgare L. Manit | cDNA | 3537 | 296 |
| LYM91 | pGXN (pKG + Nos + 35S) | BARLEY Hordeum vulgare L. Manit | cDNA | 3538 | 297 |
| LYM93 | Topo B | BARLEY Hordeum vulgare L. Manit | cDNA | 3539 | 298 |
| LYM95 | pGXN (pKG + Nos + 35S) | BARLEY Hordeum vulgare L. Manit | cDNA | 3541 | 300 |
| LYM99 | pKS(Pks_J) | BARLEY Hordeum vulgare L. Manit | cDNA | 3540 | 299 |

Table 28: Cloned and synthetic genes are provided along with the sequence identifiers of their polynucleotides and polypeptides. Also provided are the source organism, tissue and the cloning vectors.
ND = not a determined ecotype.

Selected DNA sequences were synthesized by a commercial supplier GeneArt, GmbH [Hypertext Transfer Protocol:// World Wide Web (dot) geneart (dot) com/)]. Synthetic DNA is designed in silico. Suitable restriction enzymes sites were added to the cloned sequences at the 5' end and at the 3' end to enabled later cloning into the pQFN/ pQYN_6669 binary vectors downstream of the 6669 promoter (SEQ ID NO:4198).

Example 8

Transforming *Agrobacterium Tumefaciens* Cells with Binary Vectors Harboring Putative Genes Each of the binary vectors described in Example 7 above are used to transform *Agrobacterium* cells. Two additional binary constructs, having a GUS/Luciferase reporter gene replacing the selected gene (positioned downstream of the At6669 promoter), are used as negative controls.

The binary vectors are introduced to *Agrobacterium tumefaciens* GV301, or LB4404 competent cells (about $10^9$ cells/mL) by electroporation. The electroporation is performed using a MicroPulser electroporator (Biorad), 0.2 cm cuvettes (Biorad) and EC-2 electroporation program (Biorad). The treated cells are cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Abrobacterium* colonies which developed on the selective media are analyzed by PCR using the primers which are designed to span the inserted sequence in the pPI plasmid. The resulting PCR products are isolated and sequenced as described in Example 3 above, to verify that the correct yield sequences are properly introduced to the *Agrobacterium* cells.

Example 9

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Co10) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 10

Improved Transgenic Plant Performance—Greenhouse Assays

To analyze the effect of expression of the isolated polynucleotides in plants, plants performance was tested under greenhouse conditions.

Greenhouse assays—The plants were analyzed for their overall size, growth rate, flowering, seed yield, weight of 1,000 seeds, dry matter and harvest index (HI-seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct. In cases where a certain event appears more than once, the event was tested in several independent experiments.

Tables 29 and 31 specify the parameters measured in plants in the greenhouse assays (till seed maturation and bolting assay, respectively).

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) is used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf growth analysis—Using the digital analysis leaves data was calculated, including leaf number, rosette area, rosette diameter, leaf blade area, plot coverage, leaf petiole length.

The Vegetative Growth Rate of the Plant was Defined by Formulas XIII, XIV, XV and XVI.

Relative growth rate of leaf blade area=Regression coefficient of leaf area along time course. Formula XIII:

Relative growth rate of rosette area=Regression coefficient of rosette area along time course. Formula XIV:

Relative growth rate of rosette diameter=Regression coefficient of rosette diameter along time course. Formula XV Relative growth rate of plot coverage=Regression coefficient of plot coverage along time course. Formula XVI Seeds average weight (Seed weight or 1000 seed weight)—At the end of the experiment all seeds were collected. The seeds were scattered on a glass tray and a picture was taken. Using the digital analysis, the number of seeds in each sample was calculated.

Plant dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber;

Seed yield per plant=total seed weight per plant (gr.).

1000 seed weight (the weight of 1000 seeds) (gr.).

The harvest index was calculated using Formula IV (Harvest Index=Average seed yield per plant/Average dry weight) as described above.

Oil percentage in seeds—At the end of the experiment all seeds from plots A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra— Oxford Instrument) and its MultiQuant sowftware package.

Oil yield—The oil yield was calculated using Formula IX (described above).

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results

Plants expressing the polynucleotides of the some embodiments of the invention were assayed for a number of commercially desired traits. In cases where a certain event appears more than once, the event was tested in several independent experiments.

TABLE 29

Measured parameters at the greenhouse till seed maturation assay (T2 experiment) for transformed agriculture improving trait genes

| Tested Parameters | Id |
|---|---|
| Dry Weight (gr) | A |
| Harvest Index | B |
| Leaf Blade Area TP4 (cm$^2$) | C |
| Leaf Number TP4 | D |
| Leaf Petiole Length TP4 (cm) | E |
| Petiole Relative Area TP4 | F |
| Plot Coverage TP4 (cm$^2$) | G |
| RGR Of Leaf Blade Area | H |
| RGR Of Plot Coverage | I |
| RGR Of Rosette Area | J |
| RGR Of Rosette Diameter | K |
| Rosette Area TP4 (cm$^2$) | L |
| Rosette Diameter TP4 (cm) | M |
| Seed Yield (gr) | N |
| Seeds Weight (gr) | O |
| Blade Relative Area TP4 | P |
| Oil Content | Q |
| RGR Of Leaf Number | R |

Table 29: Provided are the identification (ID) letters of each of the Tested Parameters. RGR—Relative Growth Rate; TP4—time point 4.

TABLE 30

Results obtained in a Greenhouse till seed maturation assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM16 | 11623.2 | A | 0.739 | 2.97E−02 | 10.4 | LYM9 | 11633.7 | P | 93.115 | 4.23E−03 | 3.2 |
| LYM57 | 12012.6 | A | 0.841 | 4.23E−02 | 25.7 | LYM15 | 11611.3 | P | 93.131 | 5.66E−03 | 3.2 |
| LYM17 | 11681.4 | A | 0.728 | 5.16E−02 | 8.8 | LYM4 | 11702.1 | P | 93.167 | 7.54E−03 | 3.2 |
| LYM10 | 11744.1 | A | 0.723 | 8.27E−02 | 8 | LYM17 | 11682.3 | P | 92.747 | 8.70E−03 | 2.8 |
| LYM95 | 12121.3 | A | 0.779 | 9.81E−02 | 16.5 | LYM17 | 11684.5 | P | 92.554 | 1.28E−02 | 2.6 |
| CONTROL | — | A | 0.669 | — | 0 | LYM2 | 11691.2 | P | 92.875 | 1.35E−02 | 2.9 |
| LYM16 | 11623.5 | B | 0.543 | 6.50E−05 | 45.1 | LYM7 | 11594.3 | P | 92.513 | 1.79E−02 | 2.5 |
| LYM24 | 12063.3 | B | 0.515 | 2.78E−04 | 37.6 | LYM67 | 11782.5 | P | 94.037 | 1.83E−02 | 4.2 |
| LYM10 | 11741.4 | B | 0.499 | 3.74E−04 | 33.4 | LYM44 | 11884.3 | P | 92.306 | 2.09E−02 | 2.3 |
| LYM7 | 11594.2 | B | 0.498 | 1.10E−03 | 33.1 | LYM62 | 12022.4 | P | 92.296 | 2.21E−02 | 2.3 |
| LYM44 | 11885.3 | B | 0.473 | 1.50E−03 | 26.6 | LYM19 | 11751.4 | P | 92.244 | 2.38E−02 | 2.2 |

TABLE 30-continued

Results obtained in a Greenhouse till seed maturation assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM15 | 11611.3 | B | 0.477 | 3.91E−03 | 27.7 | LYM17 | 11684.4 | P | 92.438 | 3.04E−02 | 2.4 |
| LYM2 | 11695.1 | B | 0.457 | 4.23E−03 | 22.2 | LYM31 | 11923.1 | P | 92.399 | 3.32E−02 | 2.4 |
| LYM30 | 11913.3 | B | 0.462 | 4.25E−03 | 23.6 | LYM34 | 11903.3 | P | 92.07 | 3.49E−02 | 2 |
| LYM8 | 11984.1 | B | 0.472 | 4.44E−03 | 26.3 | LYM12 | 11871.3 | P | 91.999 | 3.94E−02 | 2 |
| LYM31 | 11923.1 | B | 0.471 | 4.64E−03 | 26 | LYM15 | 11614.3 | P | 91.996 | 5.05E−02 | 1.9 |
| LYM14 | 12051.1 | B | 0.454 | 5.37E−03 | 21.5 | LYM15 | 11614.4 | P | 91.877 | 5.09E−02 | 1.8 |
| LYM2 | 11692.3 | B | 0.546 | 5.62E−03 | 46 | LYM10 | 11741.4 | P | 91.979 | 5.99E−02 | 1.9 |
| LYM16 | 11624.6 | B | 0.468 | 8.76E−03 | 25.1 | LYM57 | 12012.4 | P | 91.752 | 6.64E−02 | 1.7 |
| LYM66 | 11954.4 | B | 0.455 | 9.16E−03 | 21.7 | LYM24 | 12063.3 | P | 92.883 | 6.73E−02 | 2.9 |
| LYM34 | 11904.3 | B | 0.442 | 1.11E−02 | 18.3 | LYM16 | 11624.6 | P | 91.723 | 7.65E−02 | 1.6 |
| LYM53 | 11843.2 | B | 0.506 | 1.24E−02 | 35.4 | LYM26 | 11824.3 | P | 91.672 | 7.95E−02 | 1.6 |
| LYM35 | 11812.4 | B | 0.446 | 1.49E−02 | 19.2 | LYM66 | 11955.2 | P | 91.693 | 8.09E−02 | 1.6 |
| LYM4 | 11706.5 | B | 0.456 | 1.57E−02 | 21.9 | LYM62 | 12023.7 | P | 92.17 | 8.37E−02 | 2.1 |
| LYM15 | 11612.2 | B | 0.437 | 1.59E−02 | 16.9 | LYM30 | 11913.3 | P | 91.637 | 8.66E−02 | 1.5 |
| LYM19 | 11754.1 | B | 0.448 | 1.60E−02 | 19.8 | LYM12 | 11873.4 | P | 91.84 | 9.17E−02 | 1.8 |
| LYM9 | 11634.6 | B | 0.466 | 1.61E−02 | 24.6 | LYM51 | 11891.1 | P | 92.63 | 9.56E−02 | 2.6 |
| LYM1 | 11601.1 | B | 0.465 | 1.63E−02 | 24.3 | CONTROL | — | P | 90.239 | — | 0 |
| LYM57 | 12013.1 | B | 0.429 | 3.09E−02 | 14.8 | LYM17 | 11684.5 | Q | 31.925 | 1.22E−04 | 13.3 |
| LYM17 | 11684.5 | B | 0.501 | 3.38E−02 | 34.1 | LYM66 | 11952.1 | Q | 31.76 | 1.43E−04 | 12.7 |
| LYM30 | 11912.6 | B | 0.506 | 3.67E−02 | 35.3 | LYM34 | 11904.3 | Q | 31.585 | 2.06E−04 | 12.1 |
| LYM24 | 12061.2 | B | 0.481 | 4.69E−02 | 28.5 | LYM17 | 11682.3 | Q | 32.16 | 2.39E−04 | 14.1 |
| LYM82 | 12203.2 | B | 0.53 | 4.78E−02 | 41.7 | LYM82 | 12203.2 | Q | 31.185 | 4.56E−04 | 10.7 |
| LYM31 | 11924.4 | B | 0.437 | 4.78E−02 | 16.7 | LYM2 | 11692.3 | Q | 31.17 | 7.38E−04 | 10.6 |
| LYM6 | 11735.1 | B | 0.42 | 5.60E−02 | 12.3 | LYM14 | 12051.1 | Q | 30.425 | 2.85E−03 | 8 |
| LYM8 | 11983.1 | B | 0.47 | 6.47E−02 | 25.8 | LYM43 | 11791.2 | Q | 31.015 | 3.17E−03 | 10.1 |
| LYM6 | 11734.3 | B | 0.418 | 6.56E−02 | 11.9 | LYM43 | 11793.2 | Q | 31.92 | 4.77E−03 | 13.3 |
| LYM30 | 11912.7 | B | 0.512 | 6.75E−02 | 36.9 | LYM26 | 11824.3 | Q | 30.13 | 5.77E−03 | 6.9 |
| LYM26 | 11824.3 | B | 0.483 | 6.80E−02 | 29.2 | LYM51 | 11893.4 | Q | 30.12 | 7.02E−03 | 6.9 |
| LYM8 | 11982.4 | B | 0.475 | 7.82E−02 | 27.1 | LYM10 | 11741.4 | Q | 30.01 | 8.17E−03 | 6.5 |
| LYM12 | 11871.1 | B | 0.457 | 8.07E−02 | 22.2 | LYM22 | 11761.3 | Q | 30.895 | 8.20E−03 | 9.6 |
| LYM67 | 11782.6 | B | 0.49 | 8.15E−02 | 31.1 | LYM15 | 11611.3 | Q | 30.05 | 8.49E−03 | 6.6 |
| LYM22 | 11764.1 | B | 0.474 | 8.22E−02 | 26.8 | LYM24 | 12063.3 | Q | 30.215 | 1.03E−02 | 7.2 |
| LYM51 | 11893.4 | B | 0.476 | 8.62E−02 | 27.4 | LYM43 | 11792.2 | Q | 29.985 | 1.19E−02 | 6.4 |
| LYM21 | 11674.5 | B | 0.516 | 8.83E−02 | 38 | LYM62 | 12023.2 | Q | 29.855 | 1.23E−02 | 5.9 |
| LYM7 | 11594.3 | B | 0.464 | 8.85E−02 | 24 | LYM7 | 11591.5 | Q | 29.845 | 1.27E−02 | 5.9 |
| LYM24 | 12064.1 | B | 0.491 | 8.92E−02 | 31.2 | LYM66 | 11955.2 | Q | 30.365 | 1.58E−02 | 7.7 |
| LYM2 | 11691.2 | B | 0.454 | 9.14E−02 | 21.4 | LYM24 | 12061.2 | Q | 29.76 | 1.61E−02 | 5.6 |
| LYM13 | 11772.2 | B | 0.474 | 9.21E−02 | 26.9 | LYM69 | 11852.2 | Q | 29.82 | 1.91E−02 | 5.8 |
| LYM68 | 11942.3 | B | 0.426 | 9.22E−02 | 13.9 | LYM62 | 12023.7 | Q | 29.69 | 2.03E−02 | 5.3 |
| LYM44 | 11884.3 | B | 0.414 | 9.80E−02 | 10.6 | LYM17 | 11684.4 | Q | 29.68 | 2.16E−02 | 5.3 |
| CONTROL | — | B | 0.374 | — | 0 | LYM7 | 11592.1 | Q | 31.66 | 3.45E−02 | 12.3 |
| LYM95 | 12121.3 | C | 0.73 | 2.06E−04 | 46.2 | LYM31 | 11923.1 | Q | 29.53 | 3.69E−02 | 4.8 |
| LYM10 | 11741.2 | C | 0.655 | 3.02E−03 | 31.2 | LYM53 | 11841.2 | Q | 30.06 | 3.89E−02 | 6.7 |
| LYM21 | 11671.2 | C | 0.619 | 4.67E−03 | 23.9 | LYM57 | 12012.6 | Q | 29.38 | 4.78E−02 | 4.2 |
| LYM62 | 12024.2 | C | 0.626 | 7.02E−03 | 25.3 | LYM66 | 11954.4 | Q | 31.52 | 5.68E−02 | 11.8 |
| LYM66 | 11953.1 | C | 0.602 | 1.02E−02 | 20.5 | LYM14 | 12052.4 | Q | 29.42 | 5.94E−02 | 4.4 |
| LYM10 | 11744.1 | C | 0.602 | 1.02E−02 | 20.5 | LYM51 | 11894.2 | Q | 30.185 | 6.04E−02 | 7.1 |
| LYM4 | 11706.5 | C | 0.575 | 3.74E−02 | 15.2 | LYM68 | 11941.3 | Q | 30.515 | 6.20E−02 | 8.3 |
| LYM44 | 11882.1 | C | 0.569 | 5.06E−02 | 13.9 | LYM8 | 11984.1 | Q | 29.395 | 6.25E−02 | 4.3 |
| LYM66 | 11955.2 | C | 0.586 | 5.09E−02 | 17.4 | LYM30 | 11912.6 | Q | 31.815 | 6.57E−02 | 12.9 |
| LYM82 | 12201.1 | C | 0.567 | 6.28E−02 | 13.6 | LYM13 | 11772.1 | Q | 29.53 | 8.65E−02 | 4.8 |
| LYM68 | 11941.4 | C | 0.564 | 6.49E−02 | 13.1 | LYM24 | 12064.1 | Q | 30.505 | 9.05E−02 | 8.2 |
| LYM95 | 12121.2 | C | 0.557 | 9.41E−02 | 11.6 | LYM44 | 11885.4 | Q | 29.57 | 9.26E−02 | 4.9 |
| CONTROL | — | C | 0.499 | — | 0 | LYM1 | 11601.1 | Q | 29.685 | 9.43E−02 | 5.3 |
| LYM31 | 11923.1 | D | 9.125 | 4.78E−04 | 8.8 | CONTROL | — | Q | 28.183 | — | 0 |
| LYM26 | 11824.6 | D | 8.938 | 4.23E−03 | 6.5 | LYM175 | 12651.6 | A | 1.514 | 2.92E−03 | 50.2 |
| LYM4 | 11705.2 | D | 8.938 | 4.23E−03 | 6.5 | LYM256 | 13321.2 | A | 1.169 | 5.61E−02 | 16 |
| LYM9 | 11632.1 | D | 8.938 | 4.23E−03 | 6.5 | LYM147 | 12581.4 | A | 1.154 | 6.79E−02 | 14.5 |
| LYM44 | 11882.1 | D | 8.875 | 4.88E−03 | 5.8 | CONTROL | — | A | 1.008 | — | 0 |
| LYM8 | 11984.1 | D | 8.875 | 4.88E−03 | 5.8 | LYM207 | 13251.4 | B | 0.356 | 7.41E−02 | 8.2 |
| LYM4 | 11702.1 | D | 9.5 | 5.72E−03 | 13.3 | LYM73 | 12624.1 | B | 0.362 | 9.94E−02 | 9.9 |
| LYM10 | 11744.5 | D | 8.813 | 1.53E−02 | 5.1 | CONTROL | — | B | 0.329 | — | 0 |
| LYM24 | 12061.1 | D | 8.813 | 1.53E−02 | 5.1 | LYM206 | 12601.3 | C | 0.313 | 3.92E−03 | 31.8 |
| LYM66 | 11952.1 | D | 8.75 | 1.97E−02 | 4.3 | LYM207 | 13251.4 | C | 0.281 | 2.47E−02 | 18.2 |
| LYM69 | 11851.2 | D | 8.75 | 1.97E−02 | 4.3 | LYM241 | 13271.2 | C | 0.291 | 3.27E−02 | 22.5 |
| LYM95 | 12121.3 | D | 8.75 | 1.97E−02 | 4.3 | LYM159 | 13354.5 | C | 0.272 | 4.39E−02 | 14.8 |
| LYM53 | 11842.4 | D | 9 | 3.32E−02 | 7.3 | LYM91 | 13283.1 | C | 0.268 | 7.20E−02 | 13 |
| LYM16 | 11623.2 | D | 8.875 | 6.05E−02 | 5.8 | CONTROL | — | C | 0.237 | — | 0 |
| LYM37 | 11803.2 | D | 8.875 | 6.05E−02 | 5.8 | LYM175 | 12653.3 | D | 9 | 1.81E−02 | 3 |
| LYM57 | 12012.6 | D | 8.875 | 6.05E−02 | 5.8 | LYM206 | 12603.1 | D | 9 | 1.81E−02 | 3 |
| LYM15 | 11614.4 | D | 8.688 | 6.06E−02 | 3.6 | LYM147 | 12581.4 | D | 9.25 | 7.10E−02 | 5.9 |
| LYM43 | 11791.5 | D | 8.688 | 6.06E−02 | 3.6 | LYM147 | 12584.4 | D | 9.25 | 7.10E−02 | 5.9 |
| LYM44 | 11885.3 | D | 8.625 | 8.97E−02 | 2.8 | CONTROL | — | D | 8.734 | — | 0 |

TABLE 30-continued

Results obtained in a Greenhouse till seed maturation assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM53 | 11844.2 | D | 8.625 | 8.97E−02 | 2.8 | LYM207 | 13251.4 | E | 0.494 | 2.25E−03 | 29 |
| LYM7 | 11594.3 | D | 8.625 | 8.97E−02 | 2.8 | LYM206 | 12601.3 | E | 0.49 | 3.51E−03 | 27.9 |
| CONTROL | — | D | 8.388 | — | 0 | LYM91 | 13283.1 | E | 0.451 | 2.44E−02 | 17.8 |
| LYM95 | 12121.3 | E | 0.871 | 6.40E−05 | 20.5 | CONTROL | — | E | 0.383 | — | 0 |
| LYM10 | 11741.2 | E | 0.854 | 1.68E−04 | 18 | LYM175 | 12651.6 | F | 8.457 | 9.98E−03 | 14.9 |
| LYM51 | 11893.4 | E | 0.814 | 1.64E−03 | 12.5 | LYM241 | 13271.2 | F | 7.999 | 8.84E−02 | 8.7 |
| LYM26 | 11824.1 | E | 0.864 | 3.71E−03 | 19.4 | CONTROL | — | F | 7.36 | — | 0 |
| LYM16 | 11623.2 | E | 0.793 | 8.69E−03 | 9.6 | LYM241 | 13271.2 | G | 13.924 | 3.22E−02 | 20.3 |
| LYM12 | 11871.1 | E | 0.79 | 8.71E−03 | 9.2 | LYM256 | 13322.3 | G | 13.012 | 5.32E−02 | 12.5 |
| LYM41 | 11834.3 | E | 0.788 | 9.62E−03 | 9 | LYM91 | 13283.1 | G | 12.996 | 5.81E−02 | 12.3 |
| LYM44 | 11885.4 | E | 0.791 | 2.21E−02 | 9.3 | CONTROL | — | G | 11.57 | — | 0 |
| LYM17 | 11681.4 | E | 0.788 | 2.38E−02 | 8.9 | LYM206 | 12601.3 | H | 0.038 | 9.68E−03 | 39.1 |
| LYM21 | 11673.1 | E | 0.822 | 2.48E−02 | 13.7 | LYM206 | 12602.1 | H | 0.037 | 3.48E−02 | 35.7 |
| LYM20 | 11711.1 | E | 0.786 | 4.67E−02 | 8.7 | LYM147 | 12584.4 | H | 0.036 | 4.44E−02 | 30.6 |
| LYM4 | 11706.5 | E | 0.818 | 5.29E−02 | 13.1 | LYM147 | 12583.3 | H | 0.035 | 4.93E−02 | 29.1 |
| LYM68 | 11942.3 | E | 0.786 | 6.52E−02 | 8.7 | LYM203 | 12664.1 | H | 0.035 | 7.71E−02 | 27.4 |
| LYM53 | 11841.1 | E | 0.823 | 9.25E−02 | 13.8 | LYM159 | 13354.6 | H | 0.035 | 8.34E−02 | 28.1 |
| CONTROL | — | E | 0.723 | — | 0 | LYM241 | 13271.2 | H | 0.034 | 9.00E−02 | 24.6 |
| LYM34 | 11902.2 | F | 13.363 | 5.21E−03 | 33.8 | CONTROL | — | H | 0.027 | — | 0 |
| LYM17 | 11681.4 | F | 11.764 | 3.07E−02 | 17.8 | LYM206 | 12601.3 | I | 1.904 | 2.91E−02 | 34.1 |
| LYM37 | 11802.2 | F | 11.839 | 5.95E−02 | 18.5 | LYM147 | 12583.3 | I | 1.834 | 5.96E−02 | 29.1 |
| CONTROL | — | F | 9.989 | — | 0 | LYM147 | 12584.4 | I | 1.823 | 6.86E−02 | 28.3 |
| LYM21 | 11671.2 | G | 29.318 | 2.73E−03 | 29 | CONTROL | — | I | 1.421 | — | 0 |
| LYM95 | 12121.3 | G | 35.398 | 5.12E−03 | 55.7 | LYM206 | 12601.3 | J | 0.238 | 2.91E−02 | 34.1 |
| LYM44 | 11882.1 | G | 28.419 | 6.04E−03 | 25 | LYM147 | 12583.3 | J | 0.229 | 5.96E−02 | 29.1 |
| LYM10 | 11741.2 | G | 31.636 | 7.14E−03 | 39.1 | LYM147 | 12584.4 | J | 0.228 | 6.86E−02 | 28.3 |
| LYM66 | 11953.1 | G | 28.02 | 8.78E−03 | 23.2 | CONTROL | — | J | 0.178 | — | 0 |
| LYM4 | 11706.5 | G | 28.515 | 1.11E−02 | 25.4 | LYM206 | 12601.3 | K | 0.227 | 3.54E−02 | 26.3 |
| LYM62 | 12024.2 | G | 30.017 | 1.16E−02 | 32 | LYM203 | 12664.1 | K | 0.225 | 6.18E−02 | 25.1 |
| LYM66 | 11955.2 | G | 27.277 | 1.76E−02 | 20 | LYM159 | 13354.6 | K | 0.22 | 8.46E−02 | 22.6 |
| LYM68 | 11941.4 | G | 26.646 | 3.40E−02 | 17.2 | LYM206 | 12602.1 | K | 0.223 | 8.54E−02 | 24 |
| LYM82 | 12201.1 | G | 26.548 | 4.02E−02 | 16.8 | LYM241 | 13271.2 | K | 0.217 | 9.49E−02 | 21.1 |
| LYM9 | 11632.1 | G | 26.845 | 4.65E−02 | 18.1 | CONTROL | — | K | 0.179 | — | 0 |
| LYM53 | 11841.1 | G | 28.482 | 7.52E−02 | 25.3 | LYM241 | 13271.2 | L | 1.74 | 3.22E−02 | 20.3 |
| LYM95 | 12121.3 | G | 26.986 | 9.98E−02 | 18.7 | LYM256 | 13322.3 | L | 1.627 | 5.32E−02 | 12.5 |
| CONTROL | — | G | 22.735 | — | 0 | LYM91 | 13283.1 | L | 1.625 | 5.81E−02 | 12.3 |
| LYM95 | 12121.3 | H | 0.094 | 1.34E−02 | 47.3 | CONTROL | — | L | 1.446 | — | 0 |
| LYM10 | 11741.2 | H | 0.084 | 7.76E−02 | 31.9 | LYM206 | 12601.3 | M | 2.453 | 2.09E−03 | 18 |
| CONTROL | — | H | 0.064 | — | 0 | LYM241 | 13271.2 | M | 2.397 | 1.28E−02 | 15.3 |
| LYM95 | 12121.3 | I | 4.691 | 6.13E−03 | 54.8 | LYM207 | 13251.4 | M | 2.296 | 3.04E−02 | 10.4 |
| LYM10 | 11741.2 | I | 4.228 | 3.51E−02 | 39.5 | LYM147 | 12584.4 | M | 2.386 | 8.91E−02 | 14.8 |
| LYM62 | 12024.2 | I | 3.957 | 8.88E−02 | 30.6 | LYM256 | 13322.3 | M | 2.239 | 9.17E−02 | 7.7 |
| LYM10 | 11744.5 | I | 3.988 | 9.32E−02 | 31.6 | CONTROL | — | M | 2.079 | — | 0 |
| CONTROL | — | I | 3.03 | — | 0 | LYM236 | 12594.3 | O | 0.026 | 6.00E−02 | 15.3 |
| LYM95 | 12121.3 | J | 0.586 | 8.07E−03 | 52.2 | LYM147 | 12584.4 | O | 0.028 | 6.46E−02 | 22.5 |
| LYM10 | 11741.2 | J | 0.529 | 4.45E−02 | 37.2 | CONTROL | — | O | 0.023 | — | 0 |
| CONTROL | — | J | 0.385 | — | 0 | LYM157 | 13341.3 | P | 93.977 | 3.21E−02 | 2.1 |
| LYM95 | 12121.3 | K | 0.411 | 5.44E−03 | 28.5 | LYM256 | 13324.2 | P | 93.954 | 3.46E−02 | 2.1 |
| LYM10 | 11741.2 | K | 0.392 | 2.01E−02 | 22.4 | LYM159 | 13354.5 | P | 93.983 | 7.24E−02 | 2.1 |
| LYM10 | 11744.5 | K | 0.383 | 4.42E−02 | 19.7 | LYM223 | 12671.2 | P | 93.587 | 8.19E−02 | 1.7 |
| LYM10 | 11744.1 | K | 0.378 | 5.54E−02 | 18.2 | LYM157 | 13341.7 | P | 93.616 | 9.88E−02 | 1.7 |
| LYM26 | 11824.1 | K | 0.377 | 6.36E−02 | 17.6 | CONTROL | — | P | 92.018 | — | 0 |
| LYM21 | 11671.2 | K | 0.377 | 6.69E−02 | 17.8 | LYM250 | 12613.4 | Q | 30.535 | 3.32E−03 | 7.9 |
| LYM68 | 11941.4 | K | 0.373 | 7.72E−02 | 16.6 | LYM206 | 12601.2 | Q | 29.685 | 1.79E−02 | 4.9 |
| CONTROL | — | K | 0.32 | — | 0 | LYM147 | 12582.3 | Q | 29.84 | 3.32E−02 | 5.5 |
| LYM21 | 11671.2 | L | 3.665 | 3.75E−03 | 26.8 | LYM203 | 12662.3 | Q | 31.715 | 3.46E−02 | 12.1 |
| LYM95 | 12121.3 | L | 4.425 | 5.70E−03 | 53.1 | LYM157 | 13341.3 | Q | 29.42 | 4.35E−02 | 4 |
| LYM10 | 11741.2 | L | 3.954 | 8.47E−03 | 36.9 | LYM206 | 12603.2 | Q | 29.34 | 6.50E−02 | 3.7 |
| LYM44 | 11882.1 | L | 3.552 | 8.51E−03 | 22.9 | LYM91 | 13283.1 | Q | 29.245 | 7.37E−02 | 3.3 |
| LYM66 | 11953.1 | L | 3.502 | 1.25E−02 | 21.2 | CONTROL | — | Q | 28.298 | — | 0 |
| LYM10 | 11744.1 | L | 3.498 | 1.28E−02 | 21.1 | LYM206 | 12603.1 | R | 0.682 | 1.24E−02 | 27.2 |
| LYM62 | 12024.2 | L | 3.752 | 1.43E−02 | 29.9 | CONTROL | — | R | 0.536 | — | 0 |
| LYM4 | 11706.5 | L | 3.564 | 1.51E−02 | 23.4 | LYM113 | 12443.1 | B | 0.532 | 9.57E−03 | 25.9 |
| LYM66 | 11955.2 | L | 3.41 | 2.53E−02 | 18 | LYM267 | 13604.5 | B | 0.48 | 2.91E−02 | 13.6 |
| LYM68 | 11941.4 | L | 3.331 | 4.96E−02 | 15.3 | LYM285 | 12734.7 | B | 0.477 | 3.69E−02 | 12.8 |
| LYM82 | 12201.1 | L | 3.319 | 5.85E−02 | 14.8 | LYM113 | 12444.4 | B | 0.464 | 9.15E−02 | 9.7 |
| LYM9 | 11632.1 | L | 3.356 | 6.43E−02 | 16.1 | CONTROL | — | B | 0.423 | — | 0 |
| LYM53 | 11841.1 | L | 3.56 | 8.80E−02 | 23.2 | | | E | 0.515 | — | 0 |
| CONTROL | — | L | 2.889 | — | 0 | LYM255 | 13081.5 | F | 8.406 | 9.80E−05 | 18.5 |
| LYM95 | 12121.3 | M | 3.993 | 1.50E−05 | 26.6 | LYM116 | 13204.6 | F | 7.893 | 5.11E−04 | 11.2 |
| LYM10 | 11741.2 | M | 3.71 | 3.24E−04 | 17.6 | LYM287 | 12771.6 | F | 7.885 | 5.55E−04 | 11.1 |
| LYM62 | 12024.2 | M | 3.594 | 1.18E−03 | 14 | LYM284 | 12884.6 | F | 7.834 | 7.75E−04 | 10.4 |
| LYM10 | 11744.1 | M | 3.58 | 1.97E−03 | 13.5 | LYM239 | 13041.7 | F | 7.666 | 3.45E−03 | 8 |

TABLE 30-continued

Results obtained in a Greenhouse till seed maturation assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM82 | 12201.1 | M | 3.499 | 8.49E−03 | 10.9 | LYM113 | 12444.5 | F | 8.133 | 6.77E−03 | 14.6 |
| LYM44 | 11885.4 | M | 3.407 | 2.47E−02 | 8 | LYM287 | 12771.7 | F | 7.628 | 7.48E−03 | 7.5 |
| LYM9 | 11632.1 | M | 3.475 | 2.70E−02 | 10.2 | LYM110 | 12923.5 | F | 8.115 | 1.19E−02 | 14.4 |
| LYM20 | 11711.1 | M | 3.387 | 2.94E−02 | 7.4 | LYM52 | 12895.7 | F | 7.749 | 1.33E−02 | 9.2 |
| LYM66 | 11953.1 | M | 3.494 | 3.07E−02 | 10.8 | LYM238 | 12764.8 | F | 8.587 | 4.56E−02 | 21 |
| LYM21 | 11673.1 | M | 3.421 | 3.23E−02 | 8.5 | LYM112 | 13374.4 | F | 7.715 | 6.97E−02 | 8.7 |
| LYM51 | 11893.4 | M | 3.481 | 3.65E−02 | 10.4 | LYM56 | 13112.5 | F | 7.798 | 9.00E−02 | 9.9 |
| LYM43 | 11792.2 | M | 3.43 | 5.63E−02 | 8.7 | CONTROL | — | F | 7.096 | — | 0 |
| LYM26 | 11824.1 | M | 3.537 | 6.22E−02 | 12.1 | LYM56 | 13111.7 | N | 0.554 | 7.80E−02 | 10.8 |
| LYM17 | 11682.3 | M | 3.353 | 6.60E−02 | 6.3 | CONTROL | — | N | 0.5 | — | 0 |
| LYM16 | 11623.2 | M | 3.512 | 6.70E−02 | 11.3 | LYM255 | 13082.9 | O | 0.025 | 3.34E−02 | 7.8 |
| LYM66 | 11955.2 | M | 3.419 | 8.25E−02 | 8.4 | LYM141 | 12402.4 | O | 0.027 | 3.92E−02 | 19.5 |
| LYM17 | 11681.4 | M | 3.326 | 8.35E−02 | 5.5 | LYM113 | 12442.1 | O | 0.025 | 4.02E−02 | 7.8 |
| LYM41 | 11834.3 | M | 3.318 | 9.59E−02 | 5.2 | CONTROL | — | O | 0.023 | — | 0 |
| LYM21 | 11671.2 | M | 3.649 | 9.83E−02 | 15.7 | LYM181 | 13572.2 | P | 95.247 | 4.17E−02 | 1.9 |
| CONTROL | — | M | 3.154 | — | 0 | LYM239 | 13044.9 | P | 95.317 | 9.21E−02 | 2 |
| LYM66 | 11954.4 | N | 0.311 | 2.80E−03 | 25.1 | LYM232 | 13023.6 | P | 93.976 | 9.43E−02 | 0.6 |
| LYM31 | 11923.1 | N | 0.302 | 5.66E−03 | 21.3 | LYM156 | 12963.5 | P | 94.452 | 9.56E−02 | 1.1 |
| LYM8 | 11982.4 | N | 0.301 | 5.78E−03 | 21.2 | CONTROL | — | P | 93.441 | — | 0 |
| LYM17 | 11683.1 | N | 0.296 | 1.02E−02 | 18.9 | LYM255 | 13082.9 | Q | 34.415 | 9.06E−03 | 8.2 |
| LYM7 | 11594.3 | N | 0.284 | 4.39E−02 | 14 | LYM112 | 13372.3 | Q | 34.23 | 1.03E−02 | 7.6 |
| LYM57 | 12012.6 | N | 0.285 | 5.22E−02 | 14.6 | LYM196 | 13613.1 | Q | 33.735 | 3.50E−02 | 6.1 |
| LYM17 | 11684.5 | N | 0.277 | 8.28E−02 | 11.1 | LYM121 | 13211.8 | Q | 33.46 | 7.26E−02 | 5.2 |
| LYM13 | 11772.2 | N | 0.311 | 9.17E−02 | 25.1 | LYM287 | 12771.7 | Q | 33.23 | 7.99E−02 | 4.5 |
| CONTROL | — | N | 0.249 | — | 0 | LYM56 | 13111.7 | Q | 33.21 | 8.34E−02 | 4.4 |
| LYM12 | 11872.1 | O | 0.024 | 1.60E−05 | 19.6 | LYM156 | 12963.5 | Q | 33.4 | 9.09E−02 | 5 |
| LYM22 | 11762.1 | O | 0.022 | 4.50E−05 | 13.3 | LYM238 | 12761.6 | Q | 34.2 | 9.81E−02 | 7.5 |
| LYM43 | 11792.2 | O | 0.026 | 4.80E−05 | 33.1 | CONTROL | — | Q | 31.809 | — | 0 |
| LYM31 | 11923.4 | O | 0.022 | 1.05E−04 | 12.1 | | | | | | |
| LYM43 | 11791.2 | O | 0.022 | 1.77E−04 | 11.2 | | | | | | |
| LYM53 | 11841.1 | O | 0.022 | 3.43E−04 | 10 | | | | | | |
| LYM95 | 12121.3 | O | 0.026 | 3.71E−04 | 33.1 | | | | | | |
| LYM95 | 12121.2 | O | 0.023 | 3.96E−04 | 14.5 | | | | | | |
| LYM10 | 11744.1 | O | 0.023 | 2.55E−03 | 15.8 | | | | | | |
| LYM4 | 11702.1 | O | 0.021 | 3.43E−03 | 8.2 | | | | | | |
| LYM82 | 12204.6 | O | 0.021 | 4.85E−03 | 6.4 | | | | | | |
| LYM82 | 12204.2 | O | 0.021 | 6.10E−03 | 6.4 | | | | | | |
| LYM34 | 11904.3 | O | 0.021 | 6.18E−03 | 6.7 | | | | | | |
| LYM14 | 12054.2 | O | 0.021 | 1.02E−02 | 5.5 | | | | | | |
| LYM66 | 11954.4 | O | 0.023 | 3.15E−02 | 14.6 | | | | | | |
| LYM6 | 11734.3 | O | 0.024 | 6.98E−02 | 22.1 | | | | | | |
| LYM16 | 11623.2 | O | 0.023 | 7.55E−02 | 15.8 | | | | | | |
| LYM82 | 12201.1 | O | 0.024 | 9.20E−02 | 21.9 | | | | | | |
| CONTROL | — | O | 0.02 | — | 0 | | | | | | |

Table 30. Results of the greenhouse experiments. Provided are the measured values of each tested parameter [parameters (ID.) A-P according to the parameters described in Table 29 above] in plants expressing the indicated polynucleotides. "Ev" = event; "P" = P-value; "Mean" = the average of measured parameter across replicates. % incr. vs. cont. = percentage of increase versus control (as compared to control).

TABLE 31

Measured parameters at the greenhouse till bolting assay (T2 experiment) for transformed agriculture improving trait genes

| Tested Parameters | ID |
|---|---|
| Blade Relative Area TP4 | A |
| Dry Weight (gr) | B |
| Fresh Weight (gr) | C |
| Leaf Blade Area TP4 (cm$^2$) | D |
| Leaf Number TP4 | E |
| Leaf Petiole Length TP4 (cm) | F |
| Petiole Relative Area TP4 | G |
| Plot Coverage TP4 (cm$^2$) | H |
| RGR Of Leaf Blade Area | J |
| RGR Of Leaf Number | K |
| RGR Of Plot Coverage | L |
| RGR Of Rosette Area | M |
| RGR Of Rosette Diameter | N |
| Rosette Area TP4 (cm$^2$) | O |
| Rosette Diameter TP4 (cm) | P |

Table 31: Provided are the identification (ID) letters of each of the Tested Parameters. TP4—time Point 4; RGR—Relative Growth Rate.

TABLE 32

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM14 | 12052.5 | A | 92.405 | 3.09E−03 | 2.5 | LYM31 | 11923.4 | F | 0.489 | 1.69E−04 | 26.4 |
| LYM62 | 12022.4 | A | 92.349 | 4.28E−03 | 2.5 | LYM116 | 13202.12 | F | 0.479 | 5.48E−04 | 23.8 |
| LYM20 | 11712.2 | A | 92.893 | 5.39E−03 | 3.1 | LYM238 | 12764.8 | F | 0.459 | 1.64E−03 | 18.6 |
| LYM24 | 12064.1 | A | 92.339 | 6.75E−03 | 2.5 | LYM20 | 11711.2 | F | 0.458 | 1.80E−03 | 18.5 |
| LYM57 | 12012.2 | A | 92.251 | 6.81E−03 | 2.4 | LYM67 | 11782.6 | F | 0.455 | 2.14E−03 | 17.7 |
| LYM2 | 11695.1 | A | 92.121 | 7.11E−03 | 2.2 | LYM88 | 12193.1 | F | 0.494 | 2.43E−03 | 27.7 |
| LYM15 | 11612.2 | A | 94.348 | 1.01E−02 | 4.7 | LYM99 | 12244.2 | F | 0.45 | 3.75E−03 | 16.4 |
| LYM21 | 11672.4 | A | 92.404 | 1.14E−02 | 2.5 | LYM239 | 13044.8 | F | 0.441 | 9.74E−03 | 13.9 |
| LYM19 | 11751.4 | A | 91.836 | 1.32E−02 | 1.9 | LYM24 | 12061.4 | F | 0.435 | 1.27E−02 | 12.5 |
| LYM53 | 11844.2 | A | 91.822 | 1.53E−02 | 1.9 | LYM53 | 11841.1 | F | 0.434 | 1.43E−02 | 12.2 |
| LYM12 | 11871.1 | A | 92.949 | 1.90E−02 | 3.2 | LYM82 | 12201.1 | F | 0.454 | 1.47E−02 | 17.4 |
| LYM17 | 11683.1 | A | 92.267 | 2.24E−02 | 2.4 | LYM26 | 11824.1 | F | 0.46 | 3.65E−02 | 18.9 |
| LYM57 | 12012.4 | A | 91.637 | 2.27E−02 | 1.7 | LYM30 | 11912.6 | F | 0.433 | 4.15E−02 | 12 |
| LYM51 | 11891.1 | A | 91.813 | 2.38E−02 | 1.9 | LYM26 | 11824.3 | F | 0.436 | 4.37E−02 | 12.7 |
| LYM41 | 11832.2 | A | 91.578 | 2.83E−02 | 1.6 | LYM285 | 12733.9 | F | 0.518 | 4.87E−02 | 34 |
| LYM19 | 11753.1 | A | 91.958 | 3.26E−02 | 2.1 | LYM62 | 12023.2 | F | 0.445 | 6.80E−02 | 15.1 |
| LYM51 | 11893.4 | A | 91.504 | 3.29E−02 | 1.5 | LYM99 | 12243.2 | F | 0.418 | 7.28E−02 | 7.9 |
| LYM35 | 11812.3 | A | 91.489 | 3.40E−02 | 1.5 | LYM128 | 12641.5 | F | 0.546 | 8.57E−02 | 41 |
| LYM2 | 11695.3 | A | 91.533 | 5.57E−02 | 1.6 | LYM95 | 12121.2 | F | 0.512 | 1.12E−01 | 32.3 |
| LYM34 | 11903.2 | A | 91.766 | 6.00E−02 | 1.8 | LYM66 | 11953.6 | F | 0.427 | 1.18E−01 | 10.3 |
| LYM37 | 11802.2 | A | 92.49 | 7.93E−02 | 2.6 | LYM239 | 13042.9 | F | 0.431 | 1.30E−01 | 11.4 |
| LYM10 | 11742.2 | A | 91.536 | 7.98E−02 | 1.6 | LYM12 | 11872.1 | F | 0.548 | 1.47E−01 | 41.7 |
| LYM31 | 11923.4 | A | 91.474 | 8.92E−02 | 1.5 | LYM128 | 12641.3 | F | 0.409 | 1.66E−01 | 5.8 |
| LYM30 | 11912.7 | A | 91.122 | 9.52E−02 | 1.1 | LYM99 | 12243.1 | F | 0.554 | 1.68E−01 | 43.1 |
| LYM9 | 11632.1 | A | 91.352 | 1.07E−01 | 1.4 | LYM66 | 11954.4 | F | 0.483 | 1.83E−01 | 24.8 |
| LYM26 | 11824.6 | A | 91.076 | 1.19E−01 | 1.1 | LYM232 | 13024.6 | F | 0.42 | 1.96E−01 | 8.6 |
| LYM57 | 12012.6 | A | 91.044 | 1.24E−01 | 1 | LYM26 | 11824.6 | F | 0.429 | 2.22E−01 | 10.8 |
| LYM16 | 11623.2 | A | 92.118 | 1.47E−01 | 2.2 | LYM43 | 11791.4 | F | 0.41 | 2.43E−01 | 5.9 |
| LYM69 | 11854.2 | A | 92.115 | 1.61E−01 | 2.2 | LYM12 | 11873.4 | F | 0.462 | 2.56E−01 | 19.5 |
| LYM57 | 12013.1 | A | 91.886 | 1.66E−01 | 2 | LYM103 | 12713.5 | F | 0.444 | 3.55E−01 | 14.8 |
| LYM15 | 11613.3 | A | 91.904 | 1.68E−01 | 2 | LYM53 | 11842.4 | F | 0.411 | 3.55E−01 | 6.3 |
| LYM20 | 11711.3 | A | 91.669 | 1.89E−01 | 1.7 | LYM285 | 12734.9 | F | 0.456 | 4.57E−01 | 18 |
| LYM41 | 11833.1 | A | 91.384 | 1.92E−01 | 1.4 | LYM12 | 11871.1 | F | 0.448 | 4.60E−01 | 15.7 |
| LYM67 | 11783.5 | A | 91.023 | 1.94E−01 | 1 | LYM128 | 12641.1 | F | 0.407 | 5.45E−01 | 5.2 |
| LYM22 | 11764.1 | A | 90.853 | 2.00E−01 | 0.8 | LYM30 | 11913.4 | F | 0.397 | 5.70E−01 | 2.6 |
| LYM69 | 11851.2 | A | 91.74 | 2.05E−01 | 1.8 | LYM69 | 11852.2 | F | 0.411 | 5.90E−01 | 6.2 |
| LYM66 | 11953.1 | A | 92.257 | 2.06E−01 | 2.4 | LYM95 | 12124.4 | F | 0.425 | 6.13E−01 | 9.9 |
| LYM26 | 11822.5 | A | 91.028 | 2.12E−01 | 1 | LYM43 | 11793.2 | F | 0.421 | 6.52E−01 | 8.9 |
| LYM30 | 11912.6 | A | 90.841 | 2.14E−01 | 0.8 | LYM14 | 12051.4 | F | 0.408 | 6.57E−01 | 5.6 |
| LYM31 | 11924.4 | A | 91.921 | 2.30E−01 | 2 | LYM232 | 13024.7 | F | 0.435 | 6.69E−01 | 12.5 |
| LYM4 | 11701.1 | A | 91.754 | 2.39E−01 | 1.8 | LYM24 | 12064.1 | F | 0.416 | 7.26E−01 | 7.6 |
| LYM14 | 12051.4 | A | 90.83 | 2.43E−01 | 0.8 | LYM67 | 11782.4 | F | 0.416 | 7.28E−01 | 7.6 |
| LYM67 | 11782.6 | A | 91.469 | 2.52E−01 | 1.5 | LYM30 | 11913.5 | F | 0.403 | 7.37E−01 | 4.3 |
| LYM62 | 12023.2 | A | 91.752 | 2.52E−01 | 1.8 | LYM43 | 11791.5 | F | 0.397 | 7.38E−01 | 2.6 |
| LYM57 | 12013.5 | A | 91.699 | 2.60E−01 | 1.8 | LYM145 | 12951.9 | F | 0.394 | 7.61E−01 | 1.9 |
| LYM68 | 11942.2 | A | 90.959 | 2.62E−01 | 0.9 | LYM30 | 11912.7 | F | 0.4 | 7.69E−01 | 3.4 |
| LYM19 | 11752.2 | A | 91.08 | 2.63E−01 | 1.1 | LYM31 | 11924.4 | F | 0.407 | 7.75E−01 | 5.2 |
| LYM44 | 11884.1 | A | 91.109 | 2.88E−01 | 1.1 | LYM99 | 12244.1 | F | 0.402 | 7.94E−01 | 3.8 |
| LYM53 | 11841.1 | A | 92.28 | 2.88E−01 | 2.4 | LYM26 | 11824.5 | F | 0.406 | 8.37E−01 | 5 |
| LYM69 | 11852.2 | A | 91.959 | 2.91E−01 | 2.1 | LYM20 | 11716.5 | F | 0.395 | 8.66E−01 | 2.1 |
| LYM31 | 11923.1 | A | 90.876 | 2.91E−01 | 0.9 | LYM66 | 11955.2 | F | 0.392 | 8.71E−01 | 1.4 |
| LYM66 | 11955.2 | A | 92.703 | 2.94E−01 | 2.9 | LYM53 | 11843.2 | F | 0.394 | 8.94E−01 | 1.8 |
| LYM1 | 11603.2 | A | 92.051 | 3.02E−01 | 2.2 | LYM232 | 13024.4 | F | 0.397 | 9.29E−01 | 2.6 |
| LYM41 | 11831.5 | A | 91.826 | 3.07E−01 | 1.9 | LYM156 | 12963.1 | F | 0.389 | 9.65E−01 | 0.6 |
| LYM20 | 11711.2 | A | 90.881 | 3.47E−01 | 0.9 | LYM88 | 12194.2 | F | 0.387 | 9.95E−01 | 0.1 |
| LYM13 | 11771.6 | A | 90.65 | 3.62E−01 | 0.6 | CONTROL | — | F | 0.387 | — | 0 |
| LYM67 | 11781.5 | A | 90.995 | 3.69E−01 | 1 | LYM88 | 12193.1 | G | 8.066 | 2.50E−05 | 25.2 |
| LYM2 | 11691.2 | A | 91.385 | 3.77E−01 | 1.4 | LYM232 | 13024.4 | G | 7.589 | 2.58E−04 | 17.8 |
| LYM30 | 11913.4 | A | 90.853 | 3.81E−01 | 0.8 | LYM99 | 12244.2 | G | 7.549 | 3.29E−04 | 17.2 |
| LYM1 | 11601.4 | A | 90.859 | 3.94E−01 | 0.8 | LYM88 | 12191.2 | G | 7.736 | 2.37E−03 | 20.1 |
| LYM10 | 11741.2 | A | 91.019 | 3.97E−01 | 1 | LYM62 | 12023.2 | G | 7.932 | 2.88E−03 | 23.1 |
| LYM24 | 12061.1 | A | 91.643 | 3.97E−01 | 1.7 | LYM30 | 11912.6 | G | 7.215 | 4.09E−03 | 12 |
| LYM13 | 11772.1 | A | 91.742 | 4.02E−01 | 1.8 | LYM128 | 12641.5 | G | 7.228 | 5.32E−03 | 12.2 |
| LYM14 | 12051.4 | A | 90.781 | 4.03E−01 | 0.7 | LYM116 | 13204.4 | G | 7.075 | 8.47E−03 | 9.8 |
| LYM4 | 11705.2 | A | 92.132 | 4.20E−01 | 2.2 | LYM82 | 12201.1 | G | 7.084 | 8.81E−03 | 9.9 |
| LYM17 | 11682.1 | A | 92.467 | 4.22E−01 | 2.6 | LYM69 | 11852.2 | G | 7.055 | 9.96E−03 | 9.5 |
| LYM1 | 11604.4 | A | 91.803 | 4.50E−01 | 1.9 | LYM66 | 11953.1 | G | 7.118 | 1.07E−02 | 10.5 |
| LYM8 | 11982.4 | A | 91.723 | 4.54E−01 | 1.8 | LYM53 | 11844.2 | G | 7.005 | 1.48E−02 | 8.7 |
| LYM34 | 11902.2 | A | 91.334 | 4.56E−01 | 1.4 | LYM57 | 12012.6 | G | 7.014 | 1.54E−02 | 8.9 |
| LYM43 | 11793.2 | A | 91.534 | 4.59E−01 | 1.6 | LYM238 | 12764.8 | G | 7.251 | 2.21E−02 | 12.5 |
| LYM51 | 11894.2 | A | 91.583 | 4.61E−01 | 1.6 | LYM31 | 11921.3 | G | 6.955 | 2.21E−02 | 7.9 |
| LYM21 | 11674.5 | A | 90.703 | 4.62E−01 | 0.7 | LYM30 | 11913.5 | G | 7.742 | 2.81E−02 | 20.2 |
| LYM69 | 11853.4 | A | 91.048 | 5.05E−01 | 1 | LYM43 | 11791.5 | G | 7.093 | 2.87E−02 | 10.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM12 | 11874.1 | A | 90.863 | 5.30E−01 | 0.8 | LYM53 | 11842.4 | G | 7.517 | 3.17E−02 | 16.7 |
| LYM44 | 11885.3 | A | 91.411 | 5.42E−01 | 1.4 | LYM99 | 12244.1 | G | 6.952 | 3.21E−02 | 7.9 |
| LYM12 | 11872.1 | A | 91.494 | 5.47E−01 | 1.5 | LYM156 | 12963.1 | G | 6.886 | 3.95E−02 | 6.9 |
| LYM9 | 11633.7 | A | 90.819 | 5.50E−01 | 0.8 | LYM41 | 11831.1 | G | 7 | 4.82E−02 | 8.6 |
| LYM13 | 11772.2 | A | 91.548 | 5.65E−01 | 1.6 | LYM31 | 11923.4 | G | 7.551 | 4.93E−02 | 17.2 |
| LYM34 | 11903.3 | A | 91.319 | 5.74E−01 | 1.3 | LYM271 | 12724.9 | G | 6.864 | 5.02E−02 | 6.5 |
| LYM67 | 11782.5 | A | 90.978 | 5.82E−01 | 1 | LYM95 | 12124.4 | G | 6.873 | 5.19E−02 | 6.7 |
| LYM51 | 11893.2 | A | 90.82 | 5.94E−01 | 0.8 | LYM82 | 12204.2 | G | 7.052 | 1.10E−01 | 9.4 |
| LYM15 | 11611.3 | A | 90.387 | 6.12E−01 | 0.3 | LYM125 | 12932.6 | G | 6.752 | 1.22E−01 | 4.8 |
| LYM12 | 11874.3 | A | 90.471 | 6.22E−01 | 0.4 | LYM12 | 11872.1 | G | 7.499 | 1.25E−01 | 16.4 |
| LYM13 | 11771.9 | A | 90.421 | 6.27E−01 | 0.3 | LYM121 | 13214.5 | G | 6.737 | 1.37E−01 | 4.6 |
| LYM62 | 12022.2 | A | 90.902 | 6.52E−01 | 0.9 | LYM239 | 13042.9 | G | 6.75 | 1.43E−01 | 4.8 |
| LYM41 | 11834.2 | A | 90.979 | 6.83E−01 | 1 | LYM66 | 11954.4 | G | 6.902 | 1.52E−01 | 7.1 |
| LYM19 | 11751.5 | A | 91.121 | 6.90E−01 | 1.1 | LYM51 | 11894.2 | G | 7.54 | 1.56E−01 | 17 |
| LYM35 | 11813.5 | A | 90.606 | 7.22E−01 | 0.6 | LYM285 | 12734.9 | G | 8.179 | 1.81E−01 | 26.9 |
| LYM22 | 11762.2 | A | 90.475 | 7.23E−01 | 0.4 | LYM128 | 12641.4 | G | 6.702 | 1.87E−01 | 4 |
| LYM16 | 11622.4 | A | 90.591 | 7.35E−01 | 0.5 | LYM57 | 12012.4 | G | 6.725 | 1.88E−01 | 4.4 |
| LYM67 | 11783.4 | A | 90.578 | 7.36E−01 | 0.5 | LYM14 | 12052.5 | G | 7.472 | 1.90E−01 | 16 |
| LYM17 | 11684.4 | A | 90.539 | 7.37E−01 | 0.5 | LYM239 | 13044.8 | G | 7.087 | 1.96E−01 | 10 |
| LYM41 | 11831.1 | A | 90.519 | 7.60E−01 | 0.5 | LYM43 | 11791.4 | G | 8.567 | 2.01E−01 | 33 |
| LYM9 | 11633.2 | A | 90.343 | 7.61E−01 | 0.3 | LYM121 | 13212.6 | G | 7.746 | 2.15E−01 | 20.2 |
| LYM14 | 12052.6 | A | 90.586 | 7.64E−01 | 0.5 | LYM99 | 12243.1 | G | 7.935 | 2.19E−01 | 23.1 |
| LYM43 | 11792.2 | A | 90.67 | 7.75E−01 | 0.6 | LYM62 | 12022.4 | G | 7.209 | 2.28E−01 | 11.9 |
| LYM66 | 11953.6 | A | 90.649 | 7.76E−01 | 0.6 | LYM56 | 13112.6 | G | 7.567 | 2.56E−01 | 17.4 |
| LYM20 | 11716.5 | A | 90.596 | 7.79E−01 | 0.5 | LYM14 | 12054.2 | G | 7.747 | 2.74E−01 | 20.2 |
| LYM37 | 11803.1 | A | 90.346 | 8.10E−01 | 0.3 | LYM69 | 11853.4 | G | 7.201 | 3.46E−01 | 11.8 |
| LYM30 | 11913.5 | A | 90.539 | 8.10E−01 | 0.5 | LYM12 | 11873.4 | G | 8.016 | 3.55E−01 | 24.4 |
| LYM21 | 11673.1 | A | 90.585 | 8.23E−01 | 0.5 | LYM51 | 11891.1 | G | 7.386 | 3.60E−01 | 14.6 |
| LYM17 | 11684.5 | A | 90.747 | 8.33E−01 | 0.7 | LYM95 | 12121.2 | G | 6.912 | 3.61E−01 | 7.3 |
| LYM34 | 11904.3 | A | 90.407 | 8.52E−01 | 0.3 | LYM145 | 12952.9 | G | 7.17 | 3.74E−01 | 11.3 |
| LYM24 | 12063.3 | A | 90.682 | 8.56E−01 | 0.6 | LYM284 | 12884.7 | G | 6.91 | 3.81E−01 | 7.2 |
| LYM2 | 11692.3 | A | 90.203 | 8.71E−01 | 0.1 | LYM53 | 11841.2 | G | 7.39 | 3.85E−01 | 14.7 |
| LYM24 | 12062.3 | A | 90.6 | 8.81E−01 | 0.5 | LYM238 | 12762.8 | G | 7.075 | 3.94E−01 | 9.8 |
| LYM22 | 11762.1 | A | 90.201 | 8.83E−01 | 0.1 | LYM62 | 12022.1 | G | 7.525 | 3.95E−01 | 16.8 |
| LYM37 | 11803.2 | A | 90.244 | 9.04E−01 | 0.2 | LYM43 | 11791.2 | G | 7.703 | 4.20E−01 | 19.5 |
| LYM62 | 12022.1 | A | 90.233 | 9.15E−01 | 0.1 | LYM51 | 11893.4 | G | 7.272 | 4.52E−01 | 12.9 |
| LYM51 | 11892.1 | A | 90.154 | 9.39E−01 | 0.1 | LYM156 | 12961.9 | G | 6.677 | 4.65E−01 | 3.6 |
| LYM10 | 11744.1 | A | 90.187 | 9.50E−01 | 0.1 | LYM31 | 11922.3 | G | 6.661 | 4.71E−01 | 3.4 |
| LYM68 | 11941.4 | A | 90.163 | 9.56E−01 | 0.1 | LYM43 | 11793.2 | G | 7.393 | 4.87E−01 | 14.7 |
| LYM17 | 11683.3 | A | 90.195 | 9.65E−01 | 0.1 | LYM232 | 13024.6 | G | 6.596 | 4.89E−01 | 2.4 |
| LYM9 | 11632.2 | A | 90.128 | 9.71E−01 | 0 | LYM232 | 13024.5 | G | 6.732 | 4.92E−01 | 4.5 |
| LYM19 | 11754.1 | A | 90.118 | 9.95E−01 | 0 | LYM145 | 12954.7 | G | 6.58 | 4.97E−01 | 2.1 |
| CONTROL | — | A | 90.108 | — | 0 | LYM41 | 11833.1 | G | 6.865 | 5.04E−01 | 6.5 |
| LYM14 | 12051.4 | B | 0.211 | 5.89E−03 | 26.4 | LYM128 | 12641.1 | G | 6.796 | 5.07E−01 | 5.5 |
| LYM10 | 11744.1 | B | 0.2 | 1.92E−02 | 20 | LYM14 | 12051.1 | G | 6.808 | 5.14E−01 | 5.7 |
| LYM34 | 11902.2 | B | 0.192 | 6.57E−02 | 15.1 | LYM53 | 11841.1 | G | 6.947 | 5.15E−01 | 7.8 |
| LYM9 | 11632.1 | B | 0.191 | 7.00E−02 | 14.4 | LYM88 | 12194.2 | G | 6.864 | 5.26E−01 | 6.5 |
| LYM2 | 11695.1 | B | 0.188 | 1.04E−01 | 12.5 | LYM24 | 12061.4 | G | 6.842 | 5.31E−01 | 6.2 |
| LYM57 | 12013.1 | B | 0.188 | 1.04E−01 | 12.5 | LYM62 | 12023.4 | G | 7.308 | 5.31E−01 | 13.4 |
| LYM66 | 11954.4 | B | 0.191 | 1.36E−01 | 14.4 | LYM51 | 11893.2 | G | 6.689 | 5.34E−01 | 3.8 |
| LYM57 | 12012.4 | B | 0.191 | 1.42E−01 | 14.7 | LYM57 | 12012.1 | G | 6.686 | 5.42E−01 | 3.8 |
| LYM66 | 11953.6 | B | 0.186 | 1.65E−01 | 11.7 | LYM30 | 11912.7 | G | 6.949 | 5.55E−01 | 7.8 |
| LYM37 | 11803.1 | B | 0.183 | 1.75E−01 | 10.1 | LYM66 | 11953.6 | G | 6.632 | 5.60E−01 | 2.9 |
| LYM53 | 11844.2 | B | 0.184 | 1.80E−01 | 10.2 | LYM53 | 11843.2 | G | 6.959 | 5.75E−01 | 8 |
| LYM9 | 11632.2 | B | 0.186 | 1.90E−01 | 11.4 | LYM56 | 13111.7 | G | 7.268 | 5.80E−01 | 12.8 |
| LYM35 | 11812.3 | B | 0.189 | 2.46E−01 | 13.2 | LYM67 | 11783.5 | G | 6.724 | 5.88E−01 | 4.4 |
| LYM4 | 11701.1 | B | 0.184 | 2.47E−01 | 10.2 | LYM95 | 12124.5 | G | 6.849 | 6.12E−01 | 6.3 |
| LYM31 | 11924.4 | B | 0.181 | 2.72E−01 | 8.4 | LYM31 | 11924.4 | G | 6.597 | 6.17E−01 | 2.4 |
| LYM35 | 11813.5 | B | 0.219 | 2.93E−01 | 31.2 | LYM41 | 11832.2 | G | 6.533 | 6.27E−01 | 1.4 |
| LYM57 | 12012.6 | B | 0.187 | 2.98E−01 | 12.1 | LYM51 | 11892.1 | G | 6.978 | 6.31E−01 | 8.3 |
| LYM1 | 11604.4 | B | 0.184 | 3.17E−01 | 10.6 | LYM43 | 11792.2 | G | 6.782 | 6.47E−01 | 5.2 |
| LYM14 | 12051.1 | B | 0.18 | 3.27E−01 | 8 | LYM285 | 12734.7 | G | 7.284 | 6.55E−01 | 13 |
| LYM30 | 11912.6 | B | 0.191 | 3.85E−01 | 14.3 | LYM271 | 12721.8 | G | 6.637 | 6.59E−01 | 3 |
| LYM13 | 11771.6 | B | 0.208 | 4.16E−01 | 24.9 | LYM30 | 11913.4 | G | 7.07 | 6.73E−01 | 9.7 |
| LYM13 | 11771.9 | B | 0.192 | 4.37E−01 | 15.1 | LYM31 | 11923.1 | G | 6.854 | 6.88E−01 | 6.4 |
| LYM31 | 11923.1 | B | 0.176 | 4.57E−01 | 5.4 | LYM82 | 12203.2 | G | 6.635 | 7.11E−01 | 3 |
| LYM67 | 11783.5 | B | 0.178 | 4.69E−01 | 6.9 | LYM20 | 11716.3 | G | 6.74 | 7.14E−01 | 4.6 |
| LYM10 | 11741.2 | B | 0.177 | 5.16E−01 | 6.1 | LYM239 | 13041.7 | G | 6.709 | 7.58E−01 | 4.1 |
| LYM21 | 11673.1 | B | 0.176 | 5.27E−01 | 5.7 | LYM24 | 12064.1 | G | 6.573 | 7.64E−01 | 2 |
| LYM69 | 11851.2 | B | 0.178 | 5.36E−01 | 6.5 | LYM239 | 13044.7 | G | 6.629 | 7.70E−01 | 2.9 |
| LYM69 | 11852.2 | B | 0.179 | 5.45E−01 | 7.6 | LYM88 | 12193.5 | G | 6.595 | 7.72E−01 | 2.4 |
| LYM1 | 11603.2 | B | 0.173 | 6.15E−01 | 3.5 | LYM20 | 11712.2 | G | 6.616 | 7.87E−01 | 2.7 |
| LYM7 | 11594.2 | B | 0.184 | 6.18E−01 | 10.2 | LYM62 | 12022.2 | G | 6.612 | 7.91E−01 | 2.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM34 | 11903.2 | B | 0.188 | 6.33E−01 | 12.9 | LYM67 | 11782.6 | G | 6.509 | 7.99E−01 | 1 |
| LYM21 | 11674.5 | B | 0.172 | 6.73E−01 | 3.1 | LYM20 | 11716.5 | G | 6.541 | 8.15E−01 | 1.5 |
| LYM68 | 11942.3 | B | 0.176 | 6.91E−01 | 5.7 | LYM232 | 13024.7 | G | 6.663 | 8.27E−01 | 3.4 |
| LYM14 | 12054.2 | B | 0.176 | 7.18E−01 | 5.4 | LYM26 | 11824.1 | G | 6.558 | 8.57E−01 | 1.8 |
| LYM30 | 11913.4 | B | 0.176 | 7.18E−01 | 5.4 | LYM99 | 12243.2 | G | 6.512 | 8.64E−01 | 1.1 |
| LYM51 | 11893.2 | B | 0.171 | 7.40E−01 | 2.4 | LYM121 | 13211.8 | G | 6.511 | 8.82E−01 | 1 |
| LYM53 | 11842.4 | B | 0.182 | 7.45E−01 | 9.1 | LYM99 | 12241.1 | G | 6.503 | 8.85E−01 | 0.9 |
| LYM44 | 11884.3 | B | 0.171 | 8.45E−01 | 2.4 | LYM14 | 12051.4 | G | 6.468 | 8.96E−01 | 0.4 |
| LYM17 | 11683.3 | B | 0.169 | 8.75E−01 | 1.2 | LYM67 | 11782.4 | G | 6.536 | 9.09E−01 | 1.4 |
| LYM15 | 11611.3 | B | 0.168 | 9.01E−01 | 0.9 | LYM26 | 11824.5 | G | 6.469 | 9.55E−01 | 0.4 |
| LYM8 | 11982.7 | B | 0.169 | 9.10E−01 | 1.2 | LYM26 | 11824.3 | G | 6.475 | 9.58E−01 | 0.5 |
| LYM12 | 11872.1 | B | 0.169 | 9.21E−01 | 1.6 | LYM95 | 12121.4 | G | 6.458 | 9.88E−01 | 0.2 |
| LYM51 | 11893.4 | B | 0.169 | 9.25E−01 | 1.6 | LYM24 | 12062.3 | G | 6.457 | 9.90E−01 | 0.2 |
| LYM34 | 11903.3 | B | 0.168 | 9.59E−01 | 0.5 | LYM239 | 13041.1 | G | 6.448 | 9.93E−01 | 0.1 |
| LYM7 | 11592.1 | B | 0.168 | 9.67E−01 | 0.5 | LYM12 | 11871.1 | G | 6.445 | 9.94E−01 | 0 |
| CONTROL | — | B | 0.167 | — | 0 | CONTROL | — | G | 6.444 | — | 0 |
| LYM10 | 11744.1 | C | 2.881 | 4.60E−03 | 21 | LYM116 | 13202.12 | H | 18.312 | 4.00E−06 | 47.5 |
| LYM35 | 11813.5 | C | 2.85 | 6.51E−03 | 19.7 | LYM88 | 12193.1 | H | 15.681 | 1.86E−04 | 26.3 |
| LYM9 | 11632.1 | C | 2.85 | 6.67E−03 | 19.7 | LYM31 | 11923.4 | H | 14.837 | 1.11E−03 | 19.5 |
| LYM57 | 12013.1 | C | 2.738 | 2.45E−02 | 15 | LYM20 | 11711.2 | H | 17.126 | 1.79E−03 | 38 |
| LYM9 | 11633.7 | C | 2.713 | 3.07E−02 | 13.9 | LYM53 | 11841.1 | H | 15.641 | 2.39E−03 | 26 |
| LYM35 | 11812.3 | C | 2.681 | 6.94E−02 | 12.6 | LYM67 | 11782.6 | H | 16.773 | 4.00E−03 | 35.1 |
| LYM66 | 11953.6 | C | 2.606 | 1.11E−01 | 9.5 | LYM82 | 12201.1 | H | 14.907 | 1.38E−02 | 20.1 |
| LYM14 | 12051.4 | C | 2.788 | 2.12E−01 | 17.1 | LYM12 | 11871.3 | H | 14.033 | 1.64E−02 | 13.1 |
| LYM57 | 12012.4 | C | 2.55 | 2.56E−01 | 7.1 | LYM26 | 11824.3 | H | 15.354 | 2.22E−02 | 23.7 |
| LYM13 | 11771.7 | C | 2.694 | 2.59E−01 | 13.2 | LYM238 | 12764.8 | H | 15.539 | 2.58E−02 | 25.2 |
| LYM1 | 11603.2 | C | 2.55 | 2.80E−01 | 7.1 | LYM88 | 12194.2 | H | 13.639 | 3.29E−02 | 9.9 |
| LYM66 | 11954.4 | C | 2.525 | 3.28E−01 | 6.1 | LYM99 | 12244.2 | H | 14.055 | 4.42E−02 | 13.2 |
| LYM68 | 11942.2 | C | 2.494 | 4.00E−01 | 4.8 | LYM53 | 11843.2 | H | 13.752 | 6.09E−02 | 10.8 |
| LYM30 | 11912.6 | C | 2.662 | 4.05E−01 | 11.8 | LYM128 | 12641.5 | H | 19.01 | 6.58E−02 | 53.2 |
| LYM57 | 12012.6 | C | 2.813 | 4.19E−01 | 18.1 | LYM99 | 12243.1 | H | 18.3 | 8.16E−02 | 47.4 |
| LYM34 | 11902.2 | C | 2.681 | 4.48E−01 | 12.6 | LYM26 | 11824.1 | H | 16.706 | 8.96E−02 | 34.6 |
| LYM51 | 11893.4 | C | 2.556 | 4.54E−01 | 7.4 | LYM128 | 12641.3 | H | 16.77 | 9.41E−02 | 35.1 |
| LYM2 | 11695.1 | C | 2.538 | 5.35E−01 | 6.6 | LYM239 | 13042.9 | H | 15.316 | 1.28E−01 | 23.4 |
| LYM69 | 11851.2 | C | 2.65 | 5.41E−01 | 11.3 | LYM26 | 11824.6 | H | 15.643 | 1.64E−01 | 26 |
| LYM13 | 11771.6 | C | 2.525 | 5.65E−01 | 6.1 | LYM285 | 12733.9 | H | 18.928 | 1.66E−01 | 52.5 |
| LYM53 | 11844.2 | C | 2.619 | 5.75E−01 | 10 | LYM20 | 11716.5 | H | 13.667 | 1.68E−01 | 10.1 |
| LYM16 | 11623.2 | C | 2.456 | 6.08E−01 | 3.2 | LYM24 | 12061.4 | H | 15.875 | 1.72E−01 | 27.9 |
| LYM24 | 12061.2 | C | 2.45 | 6.15E−01 | 2.9 | LYM30 | 11912.7 | H | 13.113 | 1.73E−01 | 5.7 |
| LYM1 | 11604.4 | C | 2.506 | 6.22E−01 | 5.3 | LYM116 | 13202.7 | H | 14.52 | 1.78E−01 | 17 |
| LYM14 | 12051.1 | C | 2.475 | 6.44E−01 | 4 | LYM103 | 12713.5 | H | 16.234 | 1.81E−01 | 30.8 |
| LYM31 | 11924.4 | C | 2.456 | 6.45E−01 | 3.2 | LYM66 | 11954.4 | H | 16.504 | 1.98E−01 | 33 |
| LYM7 | 11594.2 | C | 2.519 | 6.45E−01 | 5.8 | LYM66 | 11953.6 | H | 13.082 | 2.10E−01 | 5.4 |
| LYM34 | 11903.2 | C | 2.525 | 6.69E−01 | 6.1 | LYM12 | 11872.1 | H | 19.153 | 2.18E−01 | 54.3 |
| LYM67 | 11783.5 | C | 2.563 | 7.21E−01 | 7.6 | LYM95 | 12124.4 | H | 14.508 | 2.21E−01 | 16.9 |
| LYM68 | 11942.3 | C | 2.569 | 7.32E−01 | 7.9 | LYM66 | 11955.2 | H | 14.124 | 2.35E−01 | 13.8 |
| LYM53 | 11842.4 | C | 2.581 | 7.49E−01 | 8.4 | LYM31 | 11924.4 | H | 14.278 | 2.42E−01 | 15 |
| LYM17 | 11683.3 | C | 2.406 | 8.49E−01 | 1.1 | LYM95 | 12121.2 | H | 17.135 | 3.06E−01 | 38.1 |
| LYM30 | 11913.4 | C | 2.456 | 8.69E−01 | 3.2 | LYM69 | 11852.2 | H | 14.517 | 3.11E−01 | 17 |
| LYM69 | 11852.2 | C | 2.425 | 8.75E−01 | 1.9 | LYM14 | 12051.4 | H | 14.254 | 3.15E−01 | 14.8 |
| LYM51 | 11891.1 | C | 2.438 | 8.88E−01 | 2.4 | LYM12 | 11871.1 | H | 16.236 | 3.18E−01 | 30.8 |
| LYM44 | 11884.3 | C | 2.413 | 9.00E−01 | 1.3 | LYM43 | 11791.4 | H | 13.352 | 3.60E−01 | 7.6 |
| LYM1 | 11602.6 | C | 2.388 | 9.61E−01 | 0.3 | LYM103 | 12712.8 | H | 14.075 | 4.03E−01 | 13.4 |
| LYM8 | 11982.7 | C | 2.394 | 9.68E−01 | 0.6 | LYM239 | 13044.8 | H | 13.881 | 4.35E−01 | 11.8 |
| LYM14 | 12054.2 | C | 2.388 | 9.72E−01 | 0.3 | LYM62 | 12023.2 | H | 13.479 | 4.46E−01 | 8.6 |
| LYM10 | 11741.2 | C | 2.388 | 9.76E−01 | 0.3 | LYM232 | 13024.6 | H | 13.49 | 4.54E−01 | 8.7 |
| LYM9 | 11632.2 | C | 2.381 | 9.97E−01 | 0 | LYM67 | 11782.4 | H | 14.203 | 4.80E−01 | 14.4 |
| CONTROL | — | C | 2.381 | — | 0 | LYM30 | 11912.6 | H | 13.885 | 4.95E−01 | 11.9 |
| LYM9 | 11632.1 | D | 0.63 | 7.73E−04 | 26.2 | LYM156 | 12963.1 | H | 13.692 | 5.55E−01 | 10.3 |
| LYM57 | 12013.1 | D | 0.604 | 2.91E−03 | 21.1 | LYM232 | 13024.7 | H | 15.409 | 5.68E−01 | 24.1 |
| LYM30 | 11912.6 | D | 0.59 | 6.70E−03 | 18.3 | LYM43 | 11791.5 | H | 12.738 | 5.74E−01 | 2.6 |
| LYM35 | 11812.3 | D | 0.574 | 1.51E−02 | 15.1 | LYM99 | 12243.2 | H | 13.041 | 5.75E−01 | 5.1 |
| LYM9 | 11633.7 | D | 0.564 | 7.87E−02 | 13 | LYM128 | 12641.1 | H | 13.474 | 6.12E−01 | 8.6 |
| LYM10 | 11744.1 | D | 0.58 | 9.91E−02 | 16.2 | LYM12 | 11873.6 | H | 12.838 | 6.27E−01 | 3.4 |
| LYM10 | 11741.2 | D | 0.544 | 9.99E−02 | 9.1 | LYM26 | 11824.5 | H | 14.928 | 6.29E−01 | 20.3 |
| LYM57 | 12012.4 | D | 0.541 | 1.20E−01 | 8.5 | LYM103 | 12711.8 | H | 12.75 | 6.58E−01 | 2.7 |
| LYM31 | 11924.4 | D | 0.567 | 1.79E−01 | 13.5 | LYM24 | 12064.1 | H | 13.685 | 6.61E−01 | 10.3 |
| LYM1 | 11602.6 | D | 0.541 | 1.97E−01 | 8.5 | LYM26 | 11821.2 | H | 13.651 | 6.78E−01 | 10 |
| LYM1 | 11603.2 | D | 0.581 | 2.09E−01 | 16.4 | LYM116 | 13204.4 | H | 14.229 | 7.49E−01 | 14.6 |
| LYM51 | 11891.1 | D | 0.543 | 2.39E−01 | 8.7 | LYM43 | 11793.2 | H | 13.044 | 8.21E−01 | 5.1 |
| LYM13 | 11771.9 | D | 0.538 | 2.66E−01 | 7.8 | LYM145 | 12951.9 | H | 12.489 | 8.72E−01 | 0.6 |
| LYM53 | 11842.4 | D | 0.586 | 3.05E−01 | 17.5 | LYM30 | 11913.5 | H | 12.846 | 8.73E−01 | 3.5 |
| LYM35 | 11813.5 | D | 0.558 | 3.13E−01 | 11.8 | LYM30 | 11913.4 | H | 12.658 | 8.85E−01 | 2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM13 | 11771.6 | D | 0.524 | 3.24E−01 | 5 | LYM62 | 12023.5 | H | 12.488 | 8.95E−01 | 0.6 |
| LYM14 | 12051.4 | D | 0.565 | 3.33E−01 | 13.3 | LYM285 | 12734.9 | H | 12.563 | 9.45E−01 | 1.2 |
| LYM69 | 11852.2 | D | 0.533 | 3.41E−01 | 6.8 | LYM103 | 12712.5 | H | 12.458 | 9.73E−01 | 0.4 |
| LYM66 | 11953.6 | D | 0.536 | 3.86E−01 | 7.4 | CONTROL | — | H | 12.412 | — | 0 |
| LYM57 | 12012.6 | D | 0.601 | 3.94E−01 | 20.5 | LYM12 | 11872.1 | J | 0.05 | 1.96E−04 | 59.7 |
| LYM1 | 11604.4 | D | 0.591 | 4.48E−01 | 18.5 | LYM116 | 13202.12 | J | 0.046 | 3.31E−04 | 47.1 |
| LYM14 | 12051.1 | D | 0.54 | 4.53E−01 | 8.3 | LYM20 | 11711.2 | J | 0.045 | 6.36E−04 | 44.3 |
| LYM34 | 11902.2 | D | 0.562 | 4.60E−01 | 12.6 | LYM128 | 12641.5 | J | 0.044 | 7.56E−04 | 40.5 |
| LYM2 | 11695.1 | D | 0.542 | 4.83E−01 | 8.6 | LYM285 | 12733.9 | J | 0.045 | 1.31E−03 | 43.5 |
| LYM31 | 11923.4 | D | 0.546 | 5.90E−01 | 9.3 | LYM238 | 12764.8 | J | 0.042 | 4.59E−03 | 34.9 |
| LYM69 | 11851.2 | D | 0.516 | 6.13E−01 | 3.3 | LYM26 | 11824.1 | J | 0.042 | 7.07E−03 | 33.7 |
| LYM12 | 11872.1 | D | 0.53 | 6.82E−01 | 6.2 | LYM239 | 13042.9 | J | 0.041 | 8.56E−03 | 31.8 |
| LYM7 | 11594.2 | D | 0.53 | 6.83E−01 | 6.2 | LYM103 | 12713.5 | J | 0.042 | 9.55E−03 | 34 |
| LYM21 | 11674.5 | D | 0.51 | 6.94E−01 | 2.3 | LYM99 | 12243.1 | J | 0.039 | 1.57E−02 | 26.4 |
| LYM68 | 11942.3 | D | 0.538 | 7.30E−01 | 7.7 | LYM12 | 11871.1 | J | 0.041 | 1.61E−02 | 31 |
| LYM53 | 11844.2 | D | 0.508 | 7.44E−01 | 1.7 | LYM67 | 11782.6 | J | 0.04 | 1.77E−02 | 28.2 |
| LYM35 | 11811.3 | D | 0.529 | 7.70E−01 | 6.1 | LYM116 | 13202.7 | J | 0.04 | 2.12E−02 | 28.6 |
| LYM24 | 12061.2 | D | 0.508 | 7.91E−01 | 1.9 | LYM24 | 12061.4 | J | 0.04 | 2.32E−02 | 28.1 |
| LYM51 | 11893.4 | D | 0.513 | 8.07E−01 | 2.9 | LYM26 | 11824.6 | J | 0.039 | 2.72E−02 | 25.9 |
| LYM34 | 11903.2 | D | 0.535 | 8.16E−01 | 7.1 | LYM128 | 12641.3 | J | 0.039 | 3.65E−02 | 25.4 |
| LYM1 | 11601.1 | D | 0.515 | 8.25E−01 | 3.2 | LYM26 | 11824.3 | J | 0.039 | 4.30E−02 | 23.4 |
| LYM30 | 11913.4 | D | 0.507 | 9.38E−01 | 1.6 | LYM66 | 11954.4 | J | 0.038 | 4.56E−02 | 22.5 |
| LYM43 | 11791.4 | D | 0.5 | 9.64E−01 | 0.2 | LYM103 | 12712.8 | J | 0.038 | 5.16E−02 | 22.9 |
| CONTROL | — | D | 0.499 | — | 0 | LYM95 | 12121.2 | J | 0.039 | 5.69E−02 | 23.8 |
| LYM35 | 11811.3 | E | 10 | 1.23E−02 | 7.1 | LYM24 | 12064.1 | J | 0.039 | 6.86E−02 | 23.9 |
| LYM10 | 11744.1 | E | 10.313 | 2.53E−02 | 10.4 | LYM232 | 13024.7 | J | 0.04 | 8.05E−02 | 28.4 |
| LYM30 | 11912.6 | E | 9.857 | 8.06E−02 | 5.6 | LYM232 | 13024.6 | J | 0.038 | 8.34E−02 | 20.4 |
| LYM34 | 11902.2 | E | 9.75 | 1.25E−01 | 4.4 | LYM14 | 12051.4 | J | 0.037 | 9.99E−02 | 19.7 |
| LYM69 | 11851.2 | E | 9.688 | 1.30E−01 | 3.8 | LYM12 | 11871.3 | J | 0.037 | 1.14E−01 | 18.1 |
| LYM69 | 11852.2 | E | 10.188 | 1.53E−01 | 9.1 | LYM30 | 11912.6 | J | 0.037 | 1.23E−01 | 18.6 |
| LYM9 | 11632.1 | E | 10.125 | 2.33E−01 | 8.4 | LYM239 | 13044.8 | J | 0.037 | 1.34E−01 | 17.6 |
| LYM1 | 11604.4 | E | 9.625 | 2.62E−01 | 3.1 | LYM31 | 11924.4 | J | 0.036 | 1.64E−01 | 15.9 |
| LYM13 | 11772.1 | E | 9.563 | 3.10E−01 | 2.4 | LYM156 | 12963.1 | J | 0.036 | 1.70E−01 | 15.9 |
| LYM12 | 11872.1 | E | 9.5 | 4.38E−01 | 1.7 | LYM238 | 12763.7 | J | 0.036 | 1.78E−01 | 14.5 |
| LYM26 | 11824.6 | E | 9.625 | 4.45E−01 | 3.1 | LYM53 | 11841.1 | J | 0.036 | 1.78E−01 | 14.9 |
| LYM13 | 11771.9 | E | 9.688 | 4.47E−01 | 3.8 | LYM116 | 13204.4 | J | 0.038 | 1.81E−01 | 22.8 |
| LYM14 | 12051.4 | E | 9.75 | 4.53E−01 | 4.4 | LYM20 | 11716.5 | J | 0.036 | 1.95E−01 | 14.5 |
| LYM37 | 11801.1 | E | 9.563 | 4.57E−01 | 2.4 | LYM26 | 11821.2 | J | 0.036 | 2.34E−01 | 14.6 |
| LYM9 | 11633.7 | E | 9.563 | 4.57E−01 | 2.4 | LYM26 | 11824.5 | J | 0.037 | 2.36E−01 | 17.1 |
| LYM35 | 11812.3 | E | 9.813 | 4.59E−01 | 5.1 | LYM128 | 12641.1 | J | 0.035 | 3.24E−01 | 11.7 |
| LYM14 | 12054.2 | E | 9.5 | 5.11E−01 | 1.7 | LYM31 | 11923.4 | J | 0.035 | 3.32E−01 | 10.6 |
| LYM53 | 11842.4 | E | 9.813 | 5.48E−01 | 5.1 | LYM53 | 11843.2 | J | 0.034 | 3.70E−01 | 9.8 |
| LYM21 | 11674.5 | E | 9.75 | 6.27E−01 | 4.4 | LYM69 | 11852.2 | J | 0.034 | 3.93E−01 | 9.1 |
| LYM1 | 11601.1 | E | 9.438 | 6.42E−01 | 1.1 | LYM67 | 11782.4 | J | 0.034 | 4.05E−01 | 9 |
| LYM14 | 12051.1 | E | 9.438 | 6.42E−01 | 1.1 | LYM103 | 12712.5 | J | 0.034 | 4.13E−01 | 9.1 |
| LYM15 | 11611.3 | E | 9.438 | 6.42E−01 | 1.1 | LYM30 | 11913.5 | J | 0.034 | 4.32E−01 | 9.6 |
| LYM53 | 11844.2 | E | 9.438 | 6.42E−01 | 1.1 | LYM88 | 12193.1 | J | 0.034 | 4.41E−01 | 8.1 |
| LYM35 | 11811.2 | E | 9.5 | 6.51E−01 | 1.7 | LYM103 | 12711.8 | J | 0.034 | 4.68E−01 | 7.8 |
| LYM37 | 11803.2 | E | 9.5 | 6.51E−01 | 1.7 | LYM99 | 12244.2 | J | 0.034 | 4.71E−01 | 7.7 |
| LYM30 | 11913.4 | E | 9.75 | 6.79E−01 | 4.4 | LYM95 | 12124.4 | J | 0.034 | 4.71E−01 | 7.6 |
| LYM34 | 11903.2 | E | 9.438 | 7.32E−01 | 1.1 | LYM31 | 11921.3 | J | 0.033 | 5.04E−01 | 7.3 |
| LYM19 | 11751.4 | E | 9.5 | 7.45E−01 | 1.7 | LYM66 | 11955.2 | J | 0.033 | 5.27E−01 | 6.6 |
| LYM1 | 11602.6 | E | 9.375 | 8.76E−01 | 0.4 | LYM30 | 11912.7 | J | 0.033 | 5.60E−01 | 6.4 |
| LYM57 | 12012.6 | E | 9.438 | 8.89E−01 | 1.1 | LYM62 | 12023.2 | J | 0.033 | 5.61E−01 | 6.2 |
| LYM51 | 11891.1 | E | 9.375 | 9.39E−01 | 0.4 | LYM20 | 11716.3 | J | 0.033 | 5.84E−01 | 6.4 |
| CONTROL | — | E | 9.337 | — | 0 | LYM30 | 11913.4 | J | 0.033 | 6.20E−01 | 5.8 |
| LYM57 | 12012.4 | F | 0.806 | 7.51E−02 | 8.8 | LYM238 | 12762.8 | J | 0.033 | 6.21E−01 | 5.6 |
| LYM35 | 11811.3 | F | 0.83 | 2.97E−01 | 12.1 | LYM238 | 12763.5 | J | 0.033 | 6.27E−01 | 5.3 |
| LYM53 | 11842.4 | F | 0.787 | 3.26E−01 | 6.2 | LYM156 | 12961.9 | J | 0.033 | 6.33E−01 | 5.1 |
| LYM14 | 12051.4 | F | 0.846 | 3.32E−01 | 14.3 | LYM57 | 12012.2 | J | 0.033 | 6.41E−01 | 5.1 |
| LYM35 | 11813.5 | F | 0.777 | 3.52E−01 | 4.9 | LYM145 | 12951.9 | J | 0.033 | 6.87E−01 | 4.4 |
| LYM68 | 11942.3 | F | 0.786 | 3.74E−01 | 6.2 | LYM12 | 11873.4 | J | 0.032 | 7.45E−01 | 3.6 |
| LYM30 | 11912.6 | F | 0.805 | 4.37E−01 | 8.6 | LYM20 | 11712.2 | J | 0.032 | 7.62E−01 | 3.5 |
| LYM51 | 11891.1 | F | 0.764 | 4.68E−01 | 3.1 | LYM41 | 11831.5 | J | 0.032 | 7.96E−01 | 2.8 |
| LYM9 | 11632.1 | F | 0.769 | 5.87E−01 | 3.8 | LYM103 | 12714.6 | J | 0.032 | 8.74E−01 | 1.9 |
| LYM9 | 11633.7 | F | 0.76 | 5.93E−01 | 2.6 | LYM285 | 12734.9 | J | 0.032 | 8.76E−01 | 1.8 |
| LYM13 | 11771.6 | F | 0.761 | 6.04E−01 | 2.7 | LYM239 | 13044.7 | J | 0.032 | 9.02E−01 | 1.4 |
| LYM13 | 11771.9 | F | 0.76 | 6.32E−01 | 2.7 | LYM82 | 12201.1 | J | 0.032 | 9.28E−01 | 0.9 |
| LYM37 | 11801.1 | F | 0.758 | 6.33E−01 | 2.3 | LYM66 | 11953.6 | J | 0.031 | 9.36E−01 | 0.8 |
| LYM7 | 11594.2 | F | 0.759 | 6.93E−01 | 2.5 | LYM238 | 12761.6 | J | 0.031 | 9.94E−01 | 0.1 |
| LYM57 | 12012.6 | F | 0.761 | 7.81E−01 | 2.8 | LYM24 | 12062.3 | J | 0.031 | 9.97E−01 | 0 |
| LYM57 | 12013.1 | F | 0.759 | 8.06E−01 | 2.5 | CONTROL | — | J | 0.031 | — | 0 |
| LYM35 | 11811.2 | F | 0.75 | 8.65E−01 | 1.2 | LYM26 | 11824.3 | K | 0.686 | 7.37E−03 | 43.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM14 | 12051.1 | F | 0.748 | 8.75E−01 | 0.9 | LYM69 | 11852.2 | K | 0.659 | 2.22E−02 | 38.2 |
| LYM10 | 11744.1 | F | 0.747 | 8.99E−01 | 0.9 | LYM128 | 12641.1 | K | 0.641 | 3.49E−02 | 34.5 |
| LYM34 | 11903.2 | F | 0.757 | 9.24E−01 | 2.2 | LYM95 | 12121.2 | K | 0.641 | 3.71E−02 | 34.4 |
| LYM1 | 11604.4 | F | 0.745 | 9.30E−01 | 0.5 | LYM24 | 12061.4 | K | 0.633 | 4.62E−02 | 32.8 |
| CONTROL | — | F | 0.741 | — | 0 | LYM14 | 12051.4 | K | 0.627 | 5.47E−02 | 31.5 |
| LYM37 | 11801.1 | G | 11.978 | 9.54E−04 | 26.2 | LYM128 | 12642.1 | K | 0.635 | 5.90E−02 | 33.2 |
| LYM19 | 11754.1 | G | 10.53 | 1.26E−01 | 11 | LYM128 | 12641.5 | K | 0.623 | 7.60E−02 | 30.6 |
| LYM35 | 11813.5 | G | 10.283 | 1.29E−01 | 8.4 | LYM116 | 13202.12 | K | 0.603 | 8.80E−02 | 26.5 |
| LYM9 | 11633.2 | G | 10.294 | 1.30E−01 | 8.5 | LYM238 | 12764.8 | K | 0.608 | 8.89E−02 | 27.5 |
| LYM68 | 11942.3 | G | 10.196 | 1.75E−01 | 7.4 | LYM30 | 11912.6 | K | 0.605 | 9.08E−02 | 26.8 |
| LYM4 | 11706.5 | G | 10.33 | 2.38E−01 | 8.8 | LYM277 | 13103.1 | K | 0.602 | 9.87E−02 | 26.1 |
| LYM35 | 11811.3 | G | 10.931 | 2.53E−01 | 15.2 | LYM26 | 11824.1 | K | 0.595 | 1.15E−01 | 24.7 |
| LYM19 | 11752.2 | G | 10.007 | 3.09E−01 | 5.5 | LYM285 | 12733.9 | K | 0.597 | 1.19E−01 | 25.2 |
| LYM22 | 11761.3 | G | 10.119 | 3.11E−01 | 6.6 | LYM43 | 11791.4 | K | 0.596 | 1.21E−01 | 25 |
| LYM37 | 11801.2 | G | 10.859 | 3.30E−01 | 14.4 | LYM62 | 12023.5 | K | 0.593 | 1.29E−01 | 24.3 |
| LYM43 | 11791.4 | G | 10.473 | 3.51E−01 | 10.4 | LYM12 | 11873.4 | K | 0.592 | 1.35E−01 | 24.2 |
| LYM43 | 11791.5 | G | 10.532 | 3.81E−01 | 11 | LYM116 | 13204.4 | K | 0.607 | 1.36E−01 | 27.4 |
| LYM7 | 11594.2 | G | 10.052 | 4.96E−01 | 5.9 | LYM30 | 11913.4 | K | 0.593 | 1.53E−01 | 24.3 |
| LYM20 | 11716.5 | G | 10.104 | 5.90E−01 | 6.5 | LYM121 | 13212.6 | K | 0.584 | 1.56E−01 | 22.4 |
| LYM8 | 11983.1 | G | 9.748 | 5.93E−01 | 2.7 | LYM285 | 12734.7 | K | 0.6 | 1.70E−01 | 25.9 |
| LYM7 | 11591.2 | G | 9.771 | 6.16E−01 | 3 | LYM53 | 11842.4 | K | 0.581 | 1.70E−01 | 21.9 |
| LYM67 | 11781.5 | G | 9.718 | 6.39E−01 | 2.4 | LYM95 | 12124.4 | K | 0.574 | 1.84E−01 | 20.4 |
| LYM62 | 12023.4 | G | 9.723 | 6.48E−01 | 2.5 | LYM20 | 11711.2 | K | 0.581 | 1.90E−01 | 21.7 |
| LYM16 | 11624.4 | G | 9.761 | 6.89E−01 | 2.9 | LYM128 | 12641.3 | K | 0.569 | 2.06E−01 | 19.3 |
| LYM9 | 11634.5 | G | 9.753 | 7.05E−01 | 2.8 | LYM62 | 12023.2 | K | 0.577 | 2.14E−01 | 21 |
| LYM53 | 11842.4 | G | 9.673 | 7.13E−01 | 1.9 | LYM145 | 12953.5 | K | 0.571 | 2.18E−01 | 19.7 |
| LYM12 | 11874.1 | G | 9.655 | 7.33E−01 | 1.7 | LYM53 | 11841.2 | K | 0.568 | 2.21E−01 | 19 |
| LYM37 | 11803.2 | G | 9.663 | 7.61E−01 | 1.8 | LYM285 | 12734.9 | K | 0.576 | 2.21E−01 | 20.8 |
| LYM43 | 11791.2 | G | 9.676 | 8.13E−01 | 2 | LYM232 | 13024.4 | K | 0.578 | 2.36E−01 | 21.2 |
| LYM35 | 11811.2 | G | 9.598 | 8.21E−01 | 1.1 | LYM103 | 12712.5 | K | 0.571 | 2.39E−01 | 19.7 |
| LYM62 | 12023.7 | G | 9.592 | 8.31E−01 | 1.1 | LYM232 | 13024.6 | K | 0.566 | 2.45E−01 | 18.6 |
| LYM68 | 11943.2 | G | 9.652 | 8.34E−01 | 1.7 | LYM53 | 11841.1 | K | 0.568 | 2.50E−01 | 19.2 |
| LYM15 | 11612.3 | G | 9.59 | 8.47E−01 | 1.1 | LYM99 | 12243.1 | K | 0.576 | 2.57E−01 | 20.8 |
| LYM19 | 11753.4 | G | 9.661 | 8.70E−01 | 1.8 | LYM24 | 12064.1 | K | 0.568 | 2.60E−01 | 19 |
| LYM67 | 11782.5 | G | 9.594 | 9.27E−01 | 1.1 | LYM110 | 12923.8 | K | 0.559 | 2.60E−01 | 17.2 |
| LYM2 | 11693.3 | G | 9.593 | 9.33E−01 | 1.1 | LYM66 | 11954.4 | K | 0.565 | 2.60E−01 | 18.4 |
| LYM43 | 11793.2 | G | 9.569 | 9.71E−01 | 0.8 | LYM103 | 12713.5 | K | 0.565 | 2.61E−01 | 18.6 |
| LYM44 | 11882.1 | G | 9.529 | 9.82E−01 | 0.4 | LYM12 | 11871.1 | K | 0.57 | 2.69E−01 | 19.5 |
| LYM14 | 12051.4 | G | 9.501 | 9.83E−01 | 0.1 | LYM99 | 12241.1 | K | 0.558 | 2.70E−01 | 17.1 |
| LYM13 | 11773.2 | G | 9.501 | 9.83E−01 | 0.1 | LYM82 | 12201.1 | K | 0.56 | 2.74E−01 | 17.5 |
| LYM15 | 11614.4 | G | 9.493 | 9.97E−01 | 0 | LYM31 | 11923.4 | K | 0.564 | 2.76E−01 | 18.2 |
| CONTROL | — | G | 9.49 | — | 0 | LYM99 | 12243.2 | K | 0.559 | 2.99E−01 | 17.2 |
| LYM9 | 11632.1 | H | 33.914 | 2.21E−04 | 36.9 | LYM145 | 12954.8 | K | 0.554 | 3.06E−01 | 16.1 |
| LYM57 | 12013.1 | H | 29.579 | 9.76E−03 | 19.4 | LYM66 | 11955.2 | K | 0.557 | 3.10E−01 | 16.7 |
| LYM35 | 11812.3 | H | 29.204 | 1.31E−02 | 17.9 | LYM284 | 12884.6 | K | 0.554 | 3.10E−01 | 16.1 |
| LYM57 | 12012.4 | H | 27.626 | 1.08E−01 | 11.5 | LYM232 | 13024.7 | K | 0.554 | 3.11E−01 | 16.1 |
| LYM10 | 11744.1 | H | 31.643 | 1.14E−01 | 27.7 | LYM239 | 13044.8 | K | 0.555 | 3.13E−01 | 16.4 |
| LYM35 | 11813.5 | H | 27.993 | 1.18E−01 | 13 | LYM43 | 11793.2 | K | 0.563 | 3.17E−01 | 18.1 |
| LYM10 | 11741.2 | H | 26.964 | 1.50E−01 | 8.8 | LYM14 | 12051.1 | K | 0.553 | 3.22E−01 | 15.9 |
| LYM69 | 11852.2 | H | 27.516 | 1.79E−01 | 11 | LYM116 | 13202.7 | K | 0.552 | 3.34E−01 | 15.7 |
| LYM9 | 11633.7 | H | 27.959 | 1.85E−01 | 12.8 | LYM95 | 12124.5 | K | 0.548 | 3.45E−01 | 14.9 |
| LYM1 | 11602.6 | H | 27.965 | 1.95E−01 | 12.9 | LYM121 | 13211.8 | K | 0.546 | 3.49E−01 | 14.4 |
| LYM1 | 11603.2 | H | 28.246 | 2.79E−01 | 14 | LYM24 | 12062.3 | K | 0.547 | 3.50E−01 | 14.8 |
| LYM30 | 11912.6 | H | 28.163 | 2.82E−01 | 13.6 | LYM67 | 11782.5 | K | 0.546 | 3.51E−01 | 14.5 |
| LYM14 | 12051.4 | H | 29.876 | 3.41E−01 | 20.6 | LYM53 | 11843.2 | K | 0.545 | 3.52E−01 | 14.3 |
| LYM51 | 11891.1 | H | 27.805 | 3.42E−01 | 12.2 | LYM110 | 12924.5 | K | 0.548 | 3.55E−01 | 15 |
| LYM1 | 11604.4 | H | 30.541 | 3.49E−01 | 23.2 | LYM99 | 12244.2 | K | 0.549 | 3.59E−01 | 15.1 |
| LYM53 | 11842.4 | H | 30.36 | 3.95E−01 | 22.5 | LYM12 | 11871.3 | K | 0.547 | 3.66E−01 | 14.6 |
| LYM31 | 11924.4 | H | 28.244 | 4.58E−01 | 14 | LYM99 | 12244.1 | K | 0.549 | 3.66E−01 | 15.1 |
| LYM57 | 12012.6 | H | 29.977 | 4.61E−01 | 21 | LYM271 | 12724.7 | K | 0.549 | 3.69E−01 | 15.1 |
| LYM13 | 11771.9 | H | 26.732 | 4.87E−01 | 7.9 | LYM26 | 11824.5 | K | 0.557 | 3.69E−01 | 16.8 |
| LYM34 | 11902.2 | H | 27.88 | 5.04E−01 | 12.5 | LYM30 | 11913.5 | K | 0.544 | 3.88E−01 | 14.1 |
| LYM14 | 12051.1 | H | 26.648 | 5.19E−01 | 7.5 | LYM67 | 11781.5 | K | 0.54 | 3.88E−01 | 13.3 |
| LYM21 | 11674.5 | H | 25.858 | 5.35E−01 | 4.3 | LYM238 | 12762.8 | K | 0.544 | 3.90E−01 | 14.1 |
| LYM35 | 11811.3 | H | 28.152 | 5.73E−01 | 13.6 | LYM62 | 12023.4 | K | 0.544 | 3.93E−01 | 14.1 |
| LYM2 | 11695.1 | H | 25.97 | 6.93E−01 | 4.8 | LYM14 | 12052.5 | K | 0.547 | 3.97E−01 | 14.8 |
| LYM69 | 11851.2 | H | 25.499 | 6.95E−01 | 2.9 | LYM31 | 11921.3 | K | 0.544 | 4.06E−01 | 14 |
| LYM7 | 11594.2 | H | 26.064 | 7.54E−01 | 5.2 | LYM26 | 11821.4 | K | 0.54 | 4.06E−01 | 13.3 |
| LYM13 | 11771.6 | H | 25.204 | 7.64E−01 | 1.7 | LYM43 | 11792.2 | K | 0.54 | 4.06E−01 | 13.3 |
| LYM12 | 11872.1 | H | 26.31 | 7.68E−01 | 6.2 | LYM62 | 12022.4 | K | 0.54 | 4.18E−01 | 13.3 |
| LYM31 | 11923.4 | H | 26.115 | 7.78E−01 | 5.4 | LYM271 | 12721.8 | K | 0.536 | 4.26E−01 | 12.3 |
| LYM34 | 11903.2 | H | 27.351 | 7.84E−01 | 10.4 | LYM56 | 13112.6 | K | 0.536 | 4.32E−01 | 12.4 |
| LYM51 | 11893.4 | H | 25.767 | 7.97E−01 | 4 | LYM145 | 12951.9 | K | 0.535 | 4.47E−01 | 12.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM66 | 11953.6 | H | 25.492 | 8.09E−01 | 2.9 | LYM110 | 12923.5 | K | 0.534 | 4.49E−01 | 12.1 |
| LYM68 | 11942.3 | H | 26.014 | 8.37E−01 | 5 | LYM110 | 12921.7 | K | 0.537 | 4.51E−01 | 12.6 |
| LYM30 | 11913.4 | H | 26.041 | 8.38E−01 | 5.1 | LYM12 | 11872.1 | K | 0.536 | 4.52E−01 | 12.3 |
| LYM1 | 11601.1 | H | 25.377 | 8.67E−01 | 2.4 | LYM20 | 11711.3 | K | 0.533 | 4.57E−01 | 11.8 |
| LYM24 | 12061.2 | H | 25.011 | 9.20E−01 | 0.9 | LYM57 | 12012.2 | K | 0.534 | 4.71E−01 | 11.9 |
| LYM1 | 11602.1 | H | 24.992 | 9.73E−01 | 0.9 | LYM88 | 12193.1 | K | 0.529 | 4.85E−01 | 11 |
| LYM53 | 11844.2 | H | 24.831 | 9.74E−01 | 0.2 | LYM66 | 11953.6 | K | 0.53 | 4.94E−01 | 11.1 |
| CONTROL | — | H | 24.78 | — | 0 | LYM31 | 11924.4 | K | 0.53 | 5.07E−01 | 11.1 |
| LYM9 | 11632.1 | J | 0.079 | 1.51E−01 | 24.8 | LYM67 | 11782.4 | K | 0.532 | 5.13E−01 | 11.5 |
| LYM57 | 12013.1 | J | 0.078 | 1.83E−01 | 23 | LYM285 | 12731.4 | K | 0.525 | 5.18E−01 | 10 |
| LYM57 | 12012.6 | J | 0.077 | 2.25E−01 | 21.2 | LYM239 | 13041.1 | K | 0.523 | 5.35E−01 | 9.7 |
| LYM30 | 11912.6 | J | 0.076 | 2.26E−01 | 20.6 | LYM24 | 12063.3 | K | 0.521 | 5.41E−01 | 9.2 |
| LYM53 | 11842.4 | J | 0.076 | 2.65E−01 | 19.4 | LYM156 | 12963.1 | K | 0.522 | 5.54E−01 | 9.4 |
| LYM1 | 11604.4 | J | 0.075 | 2.97E−01 | 18.6 | LYM12 | 11874.1 | K | 0.521 | 5.55E−01 | 9.2 |
| LYM1 | 11603.2 | J | 0.074 | 3.28E−01 | 16.8 | LYM271 | 12724.9 | K | 0.522 | 5.59E−01 | 9.5 |
| LYM10 | 11744.1 | J | 0.073 | 3.53E−01 | 15.7 | LYM103 | 12713.7 | K | 0.52 | 5.64E−01 | 9.1 |
| LYM31 | 11924.4 | J | 0.072 | 3.90E−01 | 14.6 | LYM14 | 12054.2 | K | 0.518 | 5.72E−01 | 8.6 |
| LYM14 | 12051.4 | J | 0.072 | 4.24E−01 | 13.6 | LYM57 | 12013.3 | K | 0.519 | 5.89E−01 | 8.9 |
| LYM35 | 11812.3 | J | 0.072 | 4.25E−01 | 13.3 | LYM31 | 11923.1 | K | 0.515 | 6.17E−01 | 7.9 |
| LYM9 | 11633.7 | J | 0.071 | 4.52E−01 | 12.5 | LYM238 | 12761.6 | K | 0.518 | 6.24E−01 | 8.5 |
| LYM34 | 11902.2 | J | 0.071 | 4.57E−01 | 12.9 | LYM232 | 13024.5 | K | 0.515 | 6.30E−01 | 7.9 |
| LYM35 | 11813.5 | J | 0.071 | 4.85E−01 | 11.8 | LYM56 | 13112.7 | K | 0.512 | 6.37E−01 | 7.3 |
| LYM57 | 12012.4 | J | 0.07 | 5.22E−01 | 10.3 | LYM26 | 11824.6 | K | 0.51 | 6.47E−01 | 6.9 |
| LYM51 | 11891.1 | J | 0.069 | 5.53E−01 | 9.8 | LYM103 | 12712.8 | K | 0.511 | 6.48E−01 | 7.2 |
| LYM2 | 11695.1 | J | 0.069 | 5.59E−01 | 9.8 | LYM41 | 11831.1 | K | 0.509 | 6.63E−01 | 6.8 |
| LYM31 | 11923.4 | J | 0.069 | 5.64E−01 | 9.9 | LYM277 | 13101.1 | K | 0.508 | 6.88E−01 | 6.6 |
| LYM13 | 11771.9 | J | 0.069 | 5.93E−01 | 9 | LYM56 | 13111.7 | K | 0.509 | 6.88E−01 | 6.7 |
| LYM68 | 11942.3 | J | 0.069 | 5.94E−01 | 9.5 | LYM284 | 12884.7 | K | 0.506 | 6.90E−01 | 6.2 |
| LYM7 | 11594.2 | J | 0.069 | 5.99E−01 | 8.8 | LYM62 | 12022.1 | K | 0.504 | 7.05E−01 | 5.7 |
| LYM66 | 11953.6 | J | 0.069 | 6.12E−01 | 8.5 | LYM30 | 11912.7 | K | 0.507 | 7.06E−01 | 6.3 |
| LYM14 | 12051.1 | J | 0.069 | 6.16E−01 | 8.5 | LYM41 | 11833.1 | K | 0.501 | 7.36E−01 | 5.1 |
| LYM10 | 11741.2 | J | 0.068 | 6.23E−01 | 8.2 | LYM103 | 12714.6 | K | 0.502 | 7.61E−01 | 5.3 |
| LYM1 | 11602.6 | J | 0.068 | 6.34E−01 | 7.8 | LYM51 | 11891.1 | K | 0.5 | 7.77E−01 | 4.8 |
| LYM12 | 11872.1 | J | 0.068 | 6.36E−01 | 8 | LYM239 | 13042.9 | K | 0.498 | 7.78E−01 | 4.5 |
| LYM69 | 11852.2 | J | 0.068 | 6.55E−01 | 7.3 | LYM24 | 12061.2 | K | 0.498 | 7.80E−01 | 4.5 |
| LYM35 | 11811.3 | J | 0.068 | 6.90E−01 | 6.8 | LYM116 | 13201.8 | K | 0.495 | 8.03E−01 | 3.9 |
| LYM34 | 11903.2 | J | 0.068 | 7.08E−01 | 6.9 | LYM66 | 11953.1 | K | 0.496 | 8.07E−01 | 3.9 |
| LYM13 | 11771.6 | J | 0.067 | 7.11E−01 | 6.2 | LYM271 | 12723.2 | K | 0.497 | 8.18E−01 | 4.3 |
| LYM69 | 11851.2 | J | 0.066 | 7.59E−01 | 5.1 | LYM277 | 13101.8 | K | 0.495 | 8.23E−01 | 3.9 |
| LYM1 | 11601.1 | J | 0.065 | 8.32E−01 | 3.5 | LYM125 | 12934.7 | K | 0.494 | 8.28E−01 | 3.6 |
| LYM51 | 11893.4 | J | 0.065 | 8.37E−01 | 3.4 | LYM121 | 13214.3 | K | 0.493 | 8.30E−01 | 3.4 |
| LYM43 | 11791.4 | J | 0.065 | 8.52E−01 | 3.1 | LYM88 | 12194.2 | K | 0.492 | 8.37E−01 | 3.2 |
| LYM24 | 12061.2 | J | 0.065 | 8.93E−01 | 2.2 | LYM20 | 11716.5 | K | 0.49 | 8.59E−01 | 2.8 |
| LYM53 | 11844.2 | J | 0.064 | 9.21E−01 | 1.6 | LYM57 | 12013.5 | K | 0.488 | 8.85E−01 | 2.3 |
| LYM30 | 11913.4 | J | 0.064 | 9.24E−01 | 1.6 | LYM66 | 11952.2 | K | 0.488 | 8.89E−01 | 2.4 |
| LYM15 | 11612.2 | J | 0.064 | 9.40E−01 | 1.3 | LYM156 | 12961.9 | K | 0.487 | 8.92E−01 | 2.1 |
| LYM21 | 11674.5 | J | 0.064 | 9.43E−01 | 1.2 | LYM67 | 11783.5 | K | 0.485 | 9.13E−01 | 1.7 |
| CONTROL | — | J | 0.063 | — | 0 | LYM232 | 13022.1 | K | 0.485 | 9.18E−01 | 1.8 |
| LYM57 | 12012.4 | K | 0.724 | 2.06E−01 | 19.4 | LYM67 | 11782.6 | K | 0.483 | 9.35E−01 | 1.3 |
| LYM37 | 11803.2 | K | 0.711 | 2.92E−01 | 17.3 | LYM145 | 12954.7 | K | 0.482 | 9.41E−01 | 1.2 |
| LYM26 | 11824.6 | K | 0.699 | 3.16E−01 | 15.3 | LYM125 | 12932.6 | K | 0.483 | 9.42E−01 | 1.4 |
| LYM31 | 11921.3 | K | 0.696 | 3.36E−01 | 14.9 | LYM125 | 12933.8 | K | 0.481 | 9.60E−01 | 0.8 |
| LYM41 | 11831.1 | K | 0.695 | 3.63E−01 | 14.6 | LYM285 | 12732.5 | K | 0.48 | 9.74E−01 | 0.6 |
| LYM62 | 12023.7 | K | 0.684 | 4.19E−01 | 12.8 | LYM156 | 12961.7 | K | 0.478 | 9.91E−01 | 0.2 |
| LYM62 | 12023.2 | K | 0.699 | 4.20E−01 | 15.4 | CONTROL | — | K | 0.477 | — | 0 |
| LYM37 | 11801.1 | K | 0.681 | 4.37E−01 | 12.4 | LYM128 | 12641.5 | L | 2.449 | 2.11E−04 | 59.2 |
| LYM35 | 11811.3 | K | 0.68 | 4.38E−01 | 12.2 | LYM116 | 13202.12 | L | 2.375 | 4.83E−04 | 54.4 |
| LYM69 | 11852.2 | K | 0.676 | 4.46E−01 | 11.6 | LYM12 | 11872.1 | L | 2.465 | 7.52E−04 | 60.2 |
| LYM16 | 11622.4 | K | 0.683 | 4.47E−01 | 12.6 | LYM285 | 12733.9 | L | 2.38 | 9.95E−04 | 54.7 |
| LYM21 | 11671.2 | K | 0.674 | 4.59E−01 | 11.1 | LYM99 | 12243.1 | L | 2.246 | 1.78E−03 | 46 |
| LYM53 | 11841.2 | K | 0.674 | 4.66E−01 | 11.1 | LYM20 | 11711.2 | L | 2.203 | 4.00E−03 | 43.2 |
| LYM24 | 12062.3 | K | 0.668 | 5.01E−01 | 10.2 | LYM26 | 11824.1 | L | 2.171 | 5.72E−03 | 41.1 |
| LYM51 | 11892.1 | K | 0.669 | 5.09E−01 | 10.3 | LYM128 | 12641.3 | L | 2.156 | 5.90E−03 | 40.1 |
| LYM10 | 11744.1 | K | 0.668 | 5.14E−01 | 10.1 | LYM95 | 12121.2 | L | 2.155 | 1.11E−02 | 40.1 |
| LYM34 | 11902.2 | K | 0.666 | 5.18E−01 | 9.9 | LYM67 | 11782.6 | L | 2.107 | 1.18E−02 | 36.9 |
| LYM14 | 12054.2 | K | 0.665 | 5.20E−01 | 9.7 | LYM66 | 11954.4 | L | 2.091 | 1.19E−02 | 35.9 |
| LYM67 | 11782.6 | K | 0.66 | 5.62E−01 | 8.9 | LYM12 | 11871.1 | L | 2.088 | 2.29E−02 | 35.7 |
| LYM9 | 11632.1 | K | 0.66 | 5.63E−01 | 8.9 | LYM24 | 12061.4 | L | 2.044 | 2.38E−02 | 32.9 |
| LYM15 | 11611.3 | K | 0.659 | 6.00E−01 | 8.7 | LYM238 | 12764.8 | L | 2.035 | 2.46E−02 | 32.3 |
| LYM4 | 11706.5 | K | 0.655 | 6.01E−01 | 8 | LYM103 | 12713.5 | L | 2.065 | 2.84E−02 | 34.2 |
| LYM12 | 11872.1 | K | 0.656 | 6.03E−01 | 8.3 | LYM26 | 11824.3 | L | 2.01 | 2.91E−02 | 30.7 |
| LYM35 | 11812.3 | K | 0.655 | 6.07E−01 | 8 | LYM26 | 11824.6 | L | 1.98 | 3.86E−02 | 28.7 |
| LYM62 | 12022.4 | K | 0.651 | 6.30E−01 | 7.4 | LYM239 | 13042.9 | L | 1.977 | 4.34E−02 | 28.5 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM30 | 11912.6 | K | 0.649 | 6.64E−01 | 7 | LYM53 | 11841.1 | L | 1.971 | 4.77E−02 | 28.1 |
| LYM20 | 11716.5 | K | 0.646 | 6.74E−01 | 6.6 | LYM88 | 12193.1 | L | 1.936 | 5.80E−02 | 25.8 |
| LYM67 | 11781.5 | K | 0.643 | 6.97E−01 | 6 | LYM116 | 13202.7 | L | 1.907 | 8.77E−02 | 24 |
| LYM4 | 11702.3 | K | 0.64 | 7.22E−01 | 5.6 | LYM232 | 13024.7 | L | 1.971 | 1.00E−01 | 28.1 |
| LYM69 | 11851.2 | K | 0.639 | 7.23E−01 | 5.4 | LYM69 | 11852.2 | L | 1.875 | 1.06E−01 | 21.9 |
| LYM68 | 11942.2 | K | 0.64 | 7.29E−01 | 5.6 | LYM31 | 11923.4 | L | 1.872 | 1.15E−01 | 21.7 |
| LYM35 | 11812.4 | K | 0.643 | 7.31E−01 | 6 | LYM82 | 12201.1 | L | 1.843 | 1.30E−01 | 19.8 |
| LYM7 | 11592.1 | K | 0.64 | 7.32E−01 | 5.6 | LYM95 | 12124.4 | L | 1.829 | 1.51E−01 | 18.9 |
| LYM30 | 11913.4 | K | 0.641 | 7.33E−01 | 5.8 | LYM103 | 12712.8 | L | 1.841 | 1.53E−01 | 19.6 |
| LYM30 | 11913.3 | K | 0.638 | 7.35E−01 | 5.2 | LYM30 | 11912.6 | L | 1.842 | 1.64E−01 | 19.7 |
| LYM8 | 11982.6 | K | 0.638 | 7.37E−01 | 5.2 | LYM14 | 12051.4 | L | 1.83 | 1.66E−01 | 18.9 |
| LYM2 | 11692.3 | K | 0.641 | 7.40E−01 | 5.8 | LYM26 | 11824.5 | L | 1.909 | 1.69E−01 | 24.1 |
| LYM4 | 11702.1 | K | 0.634 | 7.62E−01 | 4.5 | LYM31 | 11924.4 | L | 1.818 | 1.86E−01 | 18.2 |
| LYM41 | 11832.2 | K | 0.631 | 7.80E−01 | 4.1 | LYM12 | 11871.3 | L | 1.814 | 1.86E−01 | 17.9 |
| LYM9 | 11633.2 | K | 0.634 | 7.80E−01 | 4.5 | LYM24 | 12064.1 | L | 1.814 | 2.15E−01 | 17.9 |
| LYM9 | 11634.5 | K | 0.63 | 8.00E−01 | 3.9 | LYM156 | 12963.1 | L | 1.792 | 2.30E−01 | 16.4 |
| LYM9 | 11632.2 | K | 0.63 | 8.04E−01 | 3.9 | LYM232 | 13024.6 | L | 1.789 | 2.39E−01 | 16.2 |
| LYM53 | 11842.4 | K | 0.631 | 8.07E−01 | 4.1 | LYM67 | 11782.4 | L | 1.786 | 2.40E−01 | 16.1 |
| LYM68 | 11941.3 | K | 0.629 | 8.08E−01 | 3.7 | LYM116 | 13204.4 | L | 1.859 | 2.45E−01 | 20.8 |
| LYM13 | 11771.9 | K | 0.629 | 8.13E−01 | 3.7 | LYM99 | 12244.2 | L | 1.772 | 2.57E−01 | 15.2 |
| LYM57 | 12012.2 | K | 0.626 | 8.34E−01 | 3.3 | LYM239 | 13044.8 | L | 1.776 | 2.66E−01 | 15.4 |
| LYM21 | 11674.1 | K | 0.624 | 8.48E−01 | 2.9 | LYM26 | 11821.2 | L | 1.773 | 2.99E−01 | 15.3 |
| LYM34 | 11902.4 | K | 0.624 | 8.48E−01 | 2.9 | LYM20 | 11716.5 | L | 1.749 | 3.04E−01 | 13.7 |
| LYM41 | 11833.1 | K | 0.624 | 8.52E−01 | 2.9 | LYM128 | 12641.1 | L | 1.763 | 3.04E−01 | 14.6 |
| LYM1 | 11604.4 | K | 0.62 | 8.86E−01 | 2.3 | LYM53 | 11843.2 | L | 1.746 | 3.06E−01 | 13.5 |
| LYM9 | 11633.7 | K | 0.62 | 8.87E−01 | 2.3 | LYM66 | 11955.2 | L | 1.74 | 3.08E−01 | 13.1 |
| LYM17 | 11683.1 | K | 0.619 | 8.89E−01 | 2.1 | LYM62 | 12023.2 | L | 1.735 | 3.31E−01 | 12.7 |
| LYM15 | 11614.4 | K | 0.618 | 9.03E−01 | 1.9 | LYM88 | 12194.2 | L | 1.681 | 4.65E−01 | 9.3 |
| LYM20 | 11716.3 | K | 0.618 | 9.05E−01 | 1.9 | LYM43 | 11791.4 | L | 1.687 | 4.68E−01 | 9.6 |
| LYM62 | 12022.2 | K | 0.616 | 9.13E−01 | 1.7 | LYM12 | 11873.4 | L | 1.658 | 5.55E−01 | 7.8 |
| LYM4 | 11705.2 | K | 0.616 | 9.15E−01 | 1.7 | LYM30 | 11913.5 | L | 1.667 | 5.55E−01 | 8.3 |
| LYM21 | 11674.5 | K | 0.615 | 9.26E−01 | 1.5 | LYM30 | 11912.7 | L | 1.652 | 5.73E−01 | 7.4 |
| LYM26 | 11824.3 | K | 0.615 | 9.27E−01 | 1.5 | LYM30 | 11913.4 | L | 1.644 | 6.15E−01 | 6.8 |
| LYM69 | 11854.2 | K | 0.615 | 9.30E−01 | 1.5 | LYM103 | 12711.8 | L | 1.637 | 6.20E−01 | 6.4 |
| LYM67 | 11783.4 | K | 0.611 | 9.57E−01 | 0.8 | LYM43 | 11793.2 | L | 1.645 | 6.21E−01 | 6.9 |
| LYM37 | 11801.2 | K | 0.611 | 9.57E−01 | 0.8 | LYM99 | 12243.2 | L | 1.628 | 6.46E−01 | 5.8 |
| LYM67 | 11782.5 | K | 0.61 | 9.67E−01 | 0.6 | LYM66 | 11953.6 | L | 1.627 | 6.52E−01 | 5.7 |
| LYM62 | 12023.4 | K | 0.61 | 9.70E−01 | 0.6 | LYM103 | 12712.5 | L | 1.629 | 6.58E−01 | 5.9 |
| LYM7 | 11594.2 | K | 0.61 | 9.70E−01 | 0.6 | LYM285 | 12734.9 | L | 1.608 | 7.44E−01 | 4.5 |
| LYM16 | 11624.4 | K | 0.609 | 9.77E−01 | 0.4 | LYM145 | 12951.9 | L | 1.593 | 7.83E−01 | 3.5 |
| LYM7 | 11591.5 | K | 0.609 | 9.79E−01 | 0.4 | LYM103 | 12714.6 | L | 1.595 | 8.01E−01 | 3.7 |
| LYM31 | 11922.3 | K | 0.608 | 9.89E−01 | 0.2 | LYM62 | 12023.5 | L | 1.586 | 8.08E−01 | 3.1 |
| LYM8 | 11984.1 | K | 0.606 | 1.00E+00 | 0 | LYM238 | 12762.8 | L | 1.587 | 8.13E−01 | 3.1 |
| CONTROL | — | K | 0.606 | — | 0 | LYM43 | 11791.5 | L | 1.576 | 8.47E−01 | 2.4 |
| LYM9 | 11632.1 | L | 4.464 | 4.79E−02 | 36.6 | LYM156 | 12961.9 | L | 1.57 | 8.76E−01 | 2 |
| LYM10 | 11744.1 | L | 4.166 | 1.32E−01 | 27.5 | LYM57 | 12012.2 | L | 1.551 | 9.48E−01 | 0.8 |
| LYM53 | 11842.4 | L | 4.036 | 2.03E−01 | 23.5 | LYM20 | 11716.5 | L | 1.551 | 9.50E−01 | 0.8 |
| LYM1 | 11604.4 | L | 4.026 | 2.08E−01 | 23.2 | LYM24 | 12062.3 | L | 1.546 | 9.69E−01 | 0.5 |
| LYM57 | 12012.6 | L | 3.962 | 2.47E−01 | 21.3 | CONTROL | — | L | 1.539 | — | 0 |
| LYM14 | 12051.4 | L | 3.941 | 2.56E−01 | 20.6 | LYM128 | 12641.5 | M | 0.306 | 5.45E−04 | 53.9 |
| LYM57 | 12013.1 | L | 3.929 | 2.56E−01 | 20.2 | LYM116 | 13202.12 | M | 0.297 | 1.21E−03 | 49.2 |
| LYM35 | 11812.3 | L | 3.814 | 3.35E−01 | 16.7 | LYM12 | 11872.1 | M | 0.308 | 1.61E−03 | 54.8 |
| LYM30 | 11912.6 | L | 3.736 | 4.19E−01 | 14.3 | LYM285 | 12733.9 | M | 0.298 | 2.23E−03 | 49.5 |
| LYM31 | 11924.4 | L | 3.738 | 4.20E−01 | 14.4 | LYM99 | 12243.1 | M | 0.281 | 4.33E−03 | 41.1 |
| LYM57 | 12012.4 | L | 3.713 | 4.26E−01 | 13.6 | LYM20 | 11711.2 | M | 0.275 | 8.94E−03 | 38.4 |
| LYM35 | 11811.3 | L | 3.73 | 4.30E−01 | 14.2 | LYM26 | 11824.1 | M | 0.271 | 1.25E−02 | 36.4 |
| LYM1 | 11603.2 | L | 3.705 | 4.48E−01 | 13.4 | LYM128 | 12641.3 | M | 0.269 | 1.31E−02 | 35.4 |
| LYM9 | 11633.7 | L | 3.674 | 4.69E−01 | 12.4 | LYM95 | 12121.2 | M | 0.269 | 2.19E−02 | 35.4 |
| LYM51 | 11891.1 | L | 3.68 | 4.70E−01 | 12.6 | LYM67 | 11782.6 | M | 0.263 | 2.45E−02 | 32.3 |
| LYM35 | 11813.6 | L | 3.677 | 4.70E−01 | 12.5 | LYM66 | 11954.4 | M | 0.261 | 2.53E−02 | 31.3 |
| LYM34 | 11902.2 | L | 3.687 | 4.71E−01 | 12.8 | LYM12 | 11871.1 | M | 0.261 | 4.25E−02 | 31.2 |
| LYM1 | 11602.6 | L | 3.671 | 4.75E−01 | 12.3 | LYM24 | 12061.4 | M | 0.256 | 4.64E−02 | 28.4 |
| LYM69 | 11852.2 | L | 3.634 | 5.13E−01 | 11.2 | LYM238 | 12764.8 | M | 0.254 | 4.83E−02 | 27.8 |
| LYM34 | 11903.2 | L | 3.605 | 5.97E−01 | 10.3 | LYM103 | 12713.5 | M | 0.258 | 5.18E−02 | 29.7 |
| LYM13 | 11771.9 | L | 3.541 | 6.32E−01 | 8.4 | LYM26 | 11824.3 | M | 0.251 | 5.70E−02 | 26.3 |
| LYM10 | 11741.2 | L | 3.518 | 6.56E−01 | 7.7 | LYM26 | 11824.6 | M | 0.248 | 7.39E−02 | 24.4 |
| LYM12 | 11872.1 | L | 3.507 | 6.78E−01 | 7.3 | LYM239 | 13042.9 | M | 0.247 | 8.11E−02 | 24.2 |
| LYM14 | 12051.4 | L | 3.504 | 6.80E−01 | 7.2 | LYM53 | 11841.1 | M | 0.246 | 8.78E−02 | 23.8 |
| LYM7 | 11594.2 | L | 3.493 | 6.89E−01 | 6.9 | LYM88 | 12193.1 | M | 0.242 | 1.07E−01 | 21.6 |
| LYM31 | 11923.4 | L | 3.441 | 7.61E−01 | 5.3 | LYM116 | 13202.7 | M | 0.238 | 1.51E−01 | 19.8 |
| LYM2 | 11695.1 | L | 3.433 | 7.69E−01 | 5.1 | LYM232 | 13024.7 | M | 0.246 | 1.54E−01 | 23.8 |
| LYM68 | 11942.3 | L | 3.44 | 7.72E−01 | 5.3 | LYM69 | 11852.2 | M | 0.234 | 1.83E−01 | 17.8 |
| LYM30 | 11913.4 | L | 3.435 | 7.78E−01 | 5.1 | LYM31 | 11923.4 | M | 0.234 | 1.95E−01 | 17.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM51 | 11893.4 | L | 3.402 | 8.13E-01 | 4.1 | LYM82 | 12201.1 | M | 0.23 | 2.22E-01 | 15.8 |
| LYM69 | 11851.2 | L | 3.391 | 8.26E-01 | 3.8 | LYM26 | 11824.5 | M | 0.239 | 2.44E-01 | 19.9 |
| LYM21 | 11674.5 | L | 3.385 | 8.32E-01 | 3.6 | LYM103 | 12712.8 | M | 0.23 | 2.49E-01 | 15.6 |
| LYM66 | 11953.6 | L | 3.366 | 8.62E-01 | 3 | LYM95 | 12124.4 | M | 0.229 | 2.51E-01 | 14.9 |
| LYM1 | 11601.1 | L | 3.336 | 9.04E-01 | 2.1 | LYM30 | 11912.6 | M | 0.23 | 2.60E-01 | 15.7 |
| LYM13 | 11771.6 | L | 3.324 | 9.20E-01 | 1.7 | LYM14 | 12051.4 | M | 0.229 | 2.67E-01 | 14.9 |
| LYM24 | 12061.2 | L | 3.304 | 9.49E-01 | 1.1 | LYM31 | 11924.4 | M | 0.227 | 2.94E-01 | 14.2 |
| LYM1 | 11602.1 | L | 3.288 | 9.72E-01 | 0.6 | LYM12 | 11871.3 | M | 0.227 | 2.96E-01 | 14 |
| LYM7 | 11592.1 | L | 3.269 | 9.97E-01 | 0.1 | LYM24 | 12064.1 | M | 0.227 | 3.27E-01 | 14 |
| CONTROL | — | L | 3.268 | — | 0 | LYM116 | 13204.4 | M | 0.232 | 3.38E-01 | 16.8 |
| LYM9 | 11632.1 | M | 0.558 | 5.61E-02 | 34.5 | LYM156 | 12963.1 | M | 0.224 | 3.54E-01 | 12.6 |
| LYM10 | 11744.1 | M | 0.521 | 1.52E-01 | 25.5 | LYM232 | 13024.6 | M | 0.224 | 3.65E-01 | 12.4 |
| LYM53 | 11842.4 | M | 0.505 | 2.31E-01 | 21.6 | LYM67 | 11782.4 | M | 0.223 | 3.66E-01 | 12.2 |
| LYM1 | 11604.4 | M | 0.503 | 2.37E-01 | 21.3 | LYM99 | 12244.2 | M | 0.222 | 3.92E-01 | 11.3 |
| LYM30 | 11912.6 | M | 0.498 | 2.52E-01 | 20.1 | LYM239 | 13044.8 | M | 0.222 | 3.98E-01 | 11.6 |
| LYM57 | 12012.6 | M | 0.495 | 2.79E-01 | 19.4 | LYM26 | 11821.2 | M | 0.222 | 4.31E-01 | 11.4 |
| LYM14 | 12051.4 | M | 0.493 | 2.90E-01 | 18.8 | LYM128 | 12641.1 | M | 0.22 | 4.42E-01 | 10.8 |
| LYM57 | 12013.1 | M | 0.491 | 2.91E-01 | 18.4 | LYM20 | 11716.5 | M | 0.219 | 4.53E-01 | 9.9 |
| LYM35 | 11812.3 | M | 0.477 | 3.79E-01 | 14.9 | LYM53 | 11843.2 | M | 0.218 | 4.57E-01 | 9.7 |
| LYM31 | 11924.4 | M | 0.467 | 4.69E-01 | 12.6 | LYM66 | 11955.2 | M | 0.218 | 4.64E-01 | 9.3 |
| LYM57 | 12012.4 | M | 0.464 | 4.78E-01 | 11.9 | LYM62 | 12023.2 | M | 0.217 | 4.90E-01 | 9 |
| LYM35 | 11811.3 | M | 0.466 | 4.79E-01 | 12.4 | LYM43 | 11791.4 | M | 0.211 | 6.50E-01 | 6 |
| LYM1 | 11603.2 | M | 0.463 | 5.00E-01 | 11.7 | LYM88 | 12194.2 | M | 0.21 | 6.56E-01 | 5.6 |
| LYM51 | 11891.1 | M | 0.46 | 5.23E-01 | 10.9 | LYM30 | 11913.5 | M | 0.208 | 7.36E-01 | 4.7 |
| LYM9 | 11633.7 | M | 0.459 | 5.24E-01 | 10.7 | LYM12 | 11873.4 | M | 0.207 | 7.49E-01 | 4.2 |
| LYM34 | 11902.2 | M | 0.461 | 5.24E-01 | 11.1 | LYM30 | 11912.7 | M | 0.207 | 7.70E-01 | 3.8 |
| LYM35 | 11813.5 | M | 0.46 | 5.24E-01 | 10.8 | LYM43 | 11793.2 | M | 0.206 | 8.08E-01 | 3.4 |
| LYM1 | 11602.6 | M | 0.459 | 5.29E-01 | 10.6 | LYM30 | 11913.4 | M | 0.205 | 8.09E-01 | 3.3 |
| LYM69 | 11852.2 | M | 0.454 | 5.70E-01 | 9.5 | LYM103 | 12711.8 | M | 0.205 | 8.25E-01 | 2.8 |
| LYM34 | 11903.2 | M | 0.451 | 6.52E-01 | 8.6 | LYM238 | 12763.7 | M | 0.204 | 8.41E-01 | 2.5 |
| LYM13 | 11771.9 | M | 0.443 | 6.95E-01 | 6.7 | LYM99 | 12243.2 | M | 0.204 | 8.56E-01 | 2.3 |
| LYM10 | 11741.2 | M | 0.44 | 7.21E-01 | 6 | LYM103 | 12712.5 | M | 0.204 | 8.60E-01 | 2.3 |
| LYM12 | 11872.1 | M | 0.438 | 7.42E-01 | 5.7 | LYM66 | 11953.6 | M | 0.203 | 8.63E-01 | 2.2 |
| LYM14 | 12051.1 | M | 0.438 | 7.44E-01 | 5.6 | LYM285 | 12734.9 | M | 0.201 | 9.42E-01 | 1 |
| LYM7 | 11594.2 | M | 0.437 | 7.55E-01 | 5.3 | LYM31 | 11921.3 | M | 0.2 | 9.69E-01 | 0.5 |
| LYM31 | 11923.4 | M | 0.43 | 8.29E-01 | 3.7 | LYM103 | 12714.6 | M | 0.199 | 9.90E-01 | 0.2 |
| LYM68 | 11942.3 | M | 0.43 | 8.37E-01 | 3.7 | LYM145 | 12951.9 | M | 0.199 | 9.95E-01 | 0.1 |
| LYM2 | 11695.1 | M | 0.429 | 8.38E-01 | 3.5 | CONTROL | — | M | 0.199 | — | 0 |
| LYM30 | 11913.4 | M | 0.429 | 8.44E-01 | 3.5 | LYM116 | 13202.12 | N | 0.255 | 2.10E-05 | 39.1 |
| LYM51 | 11893.4 | M | 0.425 | 8.82E-01 | 2.5 | LYM12 | 11872.1 | N | 0.263 | 2.76E-04 | 43.6 |
| LYM69 | 11851.2 | M | 0.424 | 8.97E-01 | 2.2 | LYM128 | 12641.5 | N | 0.241 | 3.00E-04 | 31.6 |
| LYM21 | 11674.5 | M | 0.423 | 9.04E-01 | 2 | LYM20 | 11711.2 | N | 0.234 | 6.41E-04 | 28 |
| LYM66 | 11953.6 | M | 0.421 | 9.33E-01 | 1.4 | LYM238 | 12764.9 | N | 0.236 | 7.16E-04 | 29.2 |
| LYM1 | 11601.1 | M | 0.417 | 9.76E-01 | 0.5 | LYM26 | 11824.1 | N | 0.234 | 1.33E-03 | 28 |
| LYM13 | 11771.6 | M | 0.415 | 9.93E-01 | 0.2 | LYM128 | 12641.3 | N | 0.232 | 1.75E-03 | 26.7 |
| CONTROL | — | M | 0.415 | — | 0 | LYM103 | 12713.5 | N | 0.231 | 2.00E-03 | 26.5 |
| LYM9 | 11632.1 | N | 0.364 | 3.31E-01 | 10.1 | LYM24 | 12061.4 | N | 0.227 | 3.42E-03 | 24.1 |
| LYM30 | 11912.6 | N | 0.363 | 3.56E-01 | 9.8 | LYM232 | 13024.6 | N | 0.228 | 3.85E-03 | 24.4 |
| LYM53 | 11842.4 | N | 0.363 | 3.57E-01 | 10.1 | LYM285 | 12733.9 | N | 0.229 | 4.57E-03 | 25 |
| LYM57 | 12012.4 | N | 0.357 | 4.27E-01 | 8.1 | LYM26 | 11824.3 | N | 0.226 | 4.79E-03 | 23.5 |
| LYM35 | 11813.5 | N | 0.356 | 4.55E-01 | 7.8 | LYM66 | 11954.4 | N | 0.224 | 5.52E-03 | 22.5 |
| LYM35 | 11811.3 | N | 0.357 | 4.59E-01 | 8.1 | LYM239 | 13042.9 | N | 0.226 | 5.90E-03 | 23.3 |
| LYM57 | 12013.1 | N | 0.355 | 4.83E-01 | 7.5 | LYM30 | 11912.6 | N | 0.227 | 6.07E-03 | 24 |
| LYM14 | 12051.4 | N | 0.352 | 5.51E-01 | 6.5 | LYM128 | 12641.1 | N | 0.225 | 9.15E-03 | 23.1 |
| LYM9 | 11633.7 | N | 0.349 | 5.80E-01 | 5.6 | LYM116 | 13202.7 | N | 0.221 | 1.09E-02 | 20.9 |
| LYM57 | 12012.6 | N | 0.349 | 5.90E-01 | 5.8 | LYM31 | 11924.4 | N | 0.221 | 1.24E-02 | 21 |
| LYM43 | 11791.4 | N | 0.347 | 6.19E-01 | 5.2 | LYM12 | 11871.1 | N | 0.226 | 1.29E-02 | 23.3 |
| LYM68 | 11942.3 | N | 0.348 | 6.27E-01 | 5.5 | LYM14 | 12051.4 | N | 0.22 | 1.51E-02 | 20.4 |
| LYM31 | 11924.4 | N | 0.346 | 6.55E-01 | 4.8 | LYM24 | 12064.1 | N | 0.226 | 1.54E-02 | 23.5 |
| LYM34 | 11902.2 | N | 0.345 | 6.78E-01 | 4.4 | LYM103 | 12712.8 | N | 0.219 | 1.66E-02 | 19.4 |
| LYM51 | 11891.1 | N | 0.344 | 6.78E-01 | 4.2 | LYM53 | 11841.1 | N | 0.219 | 1.67E-02 | 19.7 |
| LYM10 | 11744.1 | N | 0.344 | 6.92E-01 | 4.2 | LYM95 | 12121.2 | N | 0.22 | 1.74E-02 | 20.4 |
| LYM66 | 11953.6 | N | 0.341 | 7.64E-01 | 3.2 | LYM30 | 11913.5 | N | 0.224 | 1.83E-02 | 22.5 |
| LYM1 | 11604.4 | N | 0.34 | 7.75E-01 | 3.1 | LYM31 | 11923.4 | N | 0.217 | 2.07E-02 | 18.9 |
| LYM37 | 11801.1 | N | 0.339 | 8.01E-01 | 2.5 | LYM232 | 13024.7 | N | 0.235 | 2.12E-02 | 28.2 |
| LYM13 | 11771.9 | N | 0.338 | 8.16E-01 | 2.5 | LYM99 | 12243.1 | N | 0.22 | 2.16E-02 | 20.1 |
| LYM7 | 11594.2 | N | 0.337 | 8.44E-01 | 2.1 | LYM239 | 13044.8 | N | 0.217 | 2.68E-02 | 18.4 |
| LYM1 | 11603.2 | N | 0.337 | 8.51E-01 | 2 | LYM26 | 11824.6 | N | 0.217 | 2.69E-02 | 18.4 |
| LYM13 | 11771.6 | N | 0.336 | 8.71E-01 | 1.7 | LYM116 | 13204.4 | N | 0.233 | 2.78E-02 | 27.6 |
| LYM35 | 11812.3 | N | 0.336 | 8.72E-01 | 1.7 | LYM12 | 11871.3 | N | 0.218 | 3.06E-02 | 18.9 |
| LYM9 | 11633.2 | N | 0.335 | 8.86E-01 | 1.5 | LYM67 | 11782.6 | N | 0.215 | 3.30E-02 | 17.4 |
| LYM69 | 11852.2 | N | 0.333 | 9.38E-01 | 0.8 | LYM53 | 11843.2 | N | 0.212 | 4.67E-02 | 15.7 |
| LYM12 | 11872.1 | N | 0.333 | 9.45E-01 | 0.8 | LYM103 | 12712.5 | N | 0.212 | 5.01E-02 | 16.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM35 | 11811.2 | N | 0.331 | 9.70E−01 | 0.4 | LYM30 | 11913.4 | N | 0.213 | 5.21E−02 | 16.1 |
| LYM34 | 11903.2 | N | 0.331 | 9.79E−01 | 0.3 | LYM88 | 12193.1 | N | 0.211 | 5.46E−02 | 15.1 |
| CONTROL | — | N | 0.33 | — | 0 | LYM238 | 12762.8 | N | 0.211 | 5.60E−02 | 15.4 |
| LYM9 | 11632.1 | O | 4.239 | 1.94E−04 | 34.8 | LYM12 | 11873.4 | N | 0.211 | 5.78E−02 | 15.1 |
| LYM30 | 11912.6 | O | 3.754 | 6.17E−03 | 19.4 | LYM26 | 11821.2 | N | 0.215 | 6.72E−02 | 17.8 |
| LYM57 | 12013.1 | O | 3.697 | 1.13E−02 | 17.5 | LYM69 | 11852.2 | N | 0.21 | 6.75E−02 | 14.7 |
| LYM35 | 11812.3 | O | 3.65 | 1.50E−02 | 16 | LYM285 | 12734.9 | N | 0.212 | 7.54E−02 | 16.1 |
| LYM10 | 11744.1 | O | 3.955 | 1.30E−01 | 25.7 | LYM26 | 11824.5 | N | 0.222 | 7.68E−02 | 21.1 |
| LYM57 | 12012.4 | O | 3.453 | 1.41E−01 | 9.8 | LYM156 | 12961.9 | N | 0.208 | 7.99E−02 | 13.9 |
| LYM35 | 11813.5 | O | 3.499 | 1.51E−01 | 11.2 | LYM43 | 11791.4 | N | 0.208 | 8.13E−02 | 13.6 |
| LYM10 | 11741.2 | O | 3.37 | 2.00E−01 | 7.1 | LYM99 | 12244.2 | N | 0.207 | 8.64E−02 | 13.3 |
| LYM9 | 11633.7 | O | 3.495 | 2.27E−01 | 11.1 | LYM238 | 12763.7 | N | 0.205 | 1.20E−01 | 12 |
| LYM69 | 11852.2 | O | 3.439 | 2.27E−01 | 9.3 | LYM156 | 12963.1 | N | 0.208 | 1.24E−01 | 13.5 |
| LYM1 | 11602.6 | O | 3.496 | 2.38E−01 | 11.1 | LYM82 | 12201.1 | N | 0.204 | 1.29E−01 | 11.7 |
| LYM1 | 11603.2 | O | 3.531 | 3.22E−01 | 12.2 | LYM95 | 12124.4 | N | 0.204 | 1.34E−01 | 11.7 |
| LYM14 | 12051.4 | O | 3.735 | 3.69E−01 | 18.7 | LYM20 | 11716.5 | N | 0.204 | 1.46E−01 | 11.3 |
| LYM1 | 11604.4 | O | 3.818 | 3.73E−01 | 21.4 | LYM31 | 11921.3 | N | 0.203 | 1.70E−01 | 10.9 |
| LYM51 | 11891.1 | O | 3.476 | 3.93E−01 | 10.5 | LYM145 | 12951.9 | N | 0.202 | 1.80E−01 | 10.4 |
| LYM53 | 11842.4 | O | 3.795 | 4.20E−01 | 20.6 | LYM30 | 11912.7 | N | 0.202 | 1.85E−01 | 10.1 |
| LYM57 | 12012.6 | O | 3.747 | 4.88E−01 | 19.1 | LYM67 | 11782.4 | N | 0.203 | 2.23E−01 | 11.2 |
| LYM31 | 11924.4 | O | 3.531 | 5.00E−01 | 12.2 | LYM20 | 11712.2 | N | 0.203 | 2.24E−01 | 10.7 |
| LYM34 | 11902.2 | O | 3.485 | 5.50E−01 | 10.8 | LYM285 | 12734.7 | N | 0.2 | 2.27E−01 | 9.4 |
| LYM13 | 11771.9 | O | 3.342 | 5.66E−01 | 6.2 | LYM103 | 12714.6 | N | 0.204 | 2.42E−01 | 11.7 |
| LYM14 | 12051.1 | O | 3.331 | 5.99E−01 | 5.9 | LYM20 | 11716.3 | N | 0.2 | 2.43E−01 | 9.3 |
| LYM35 | 11811.3 | O | 3.519 | 6.11E−01 | 11.9 | LYM62 | 12023.2 | N | 0.2 | 2.46E−01 | 9.3 |
| LYM21 | 11674.5 | O | 3.232 | 6.76E−01 | 2.8 | LYM66 | 11953.6 | N | 0.197 | 3.17E−01 | 7.7 |
| LYM2 | 11695.1 | O | 3.246 | 7.85E−01 | 3.2 | LYM238 | 12763.5 | N | 0.197 | 3.17E−01 | 7.7 |
| LYM34 | 11903.2 | O | 3.419 | 8.15E−01 | 8.7 | LYM232 | 13024.5 | N | 0.197 | 3.18E−01 | 7.7 |
| LYM12 | 11872.1 | O | 3.289 | 8.23E−01 | 4.5 | LYM24 | 12062.3 | N | 0.197 | 3.20E−01 | 7.7 |
| LYM7 | 11594.2 | O | 3.258 | 8.24E−01 | 3.6 | LYM239 | 13044.7 | N | 0.197 | 3.34E−01 | 7.9 |
| LYM31 | 11923.4 | O | 3.264 | 8.39E−01 | 3.8 | LYM57 | 12012.2 | N | 0.196 | 3.40E−01 | 7.3 |
| LYM69 | 11851.2 | O | 3.187 | 8.50E−01 | 1.3 | LYM103 | 12711.8 | N | 0.195 | 4.17E−01 | 6.4 |
| LYM51 | 11893.4 | O | 3.221 | 8.73E−01 | 2.4 | LYM53 | 11842.4 | N | 0.194 | 4.55E−01 | 5.8 |
| LYM30 | 11913.4 | O | 3.255 | 8.86E−01 | 3.5 | LYM88 | 12194.2 | N | 0.193 | 4.99E−01 | 5.2 |
| LYM68 | 11942.3 | O | 3.252 | 8.86E−01 | 3.4 | LYM145 | 12954.8 | N | 0.194 | 5.03E−01 | 6.2 |
| LYM66 | 11953.6 | O | 3.186 | 9.10E−01 | 1.3 | LYM121 | 13212.6 | N | 0.193 | 5.34E−01 | 5.4 |
| LYM1 | 11601.1 | O | 3.172 | 9.52E−01 | 0.8 | LYM232 | 13024.4 | N | 0.194 | 5.39E−01 | 6.1 |
| LYM13 | 11771.6 | O | 3.151 | 9.76E−01 | 0.2 | LYM67 | 11782.5 | N | 0.19 | 5.94E−01 | 4.1 |
| CONTROL | — | O | 3.146 | — | 0 | LYM43 | 11793.2 | N | 0.192 | 5.99E−01 | 4.7 |
| LYM9 | 11632.1 | P | 3.799 | 3.19E−03 | 12.7 | LYM145 | 12954.7 | N | 0.192 | 6.07E−01 | 4.8 |
| LYM10 | 11744.1 | P | 3.642 | 4.04E−02 | 8 | LYM277 | 13103.1 | N | 0.19 | 6.17E−01 | 3.9 |
| LYM57 | 12012.4 | P | 3.618 | 9.72E−02 | 7.3 | LYM121 | 13211.8 | N | 0.19 | 6.20E−01 | 3.8 |
| LYM30 | 11912.6 | P | 3.638 | 1.05E−01 | 7.9 | LYM53 | 11844.2 | N | 0.189 | 6.49E−01 | 3.5 |
| LYM9 | 11633.7 | P | 3.554 | 1.21E−01 | 5.4 | LYM128 | 12642.1 | N | 0.19 | 6.64E−01 | 3.8 |
| LYM35 | 11813.5 | P | 3.611 | 1.25E−01 | 7.1 | LYM20 | 11711.3 | N | 0.189 | 6.73E−01 | 3.3 |
| LYM35 | 11812.3 | P | 3.533 | 1.68E−01 | 4.8 | LYM238 | 12761.6 | N | 0.19 | 6.91E−01 | 3.7 |
| LYM57 | 12013.1 | P | 3.581 | 1.87E−01 | 6.2 | LYM66 | 11955.2 | N | 0.188 | 7.07E−01 | 2.9 |
| LYM53 | 11842.4 | P | 3.713 | 3.40E−01 | 10.1 | LYM41 | 11831.5 | N | 0.188 | 7.21E−01 | 2.7 |
| LYM14 | 12051.4 | P | 3.67 | 3.72E−01 | 8.9 | LYM239 | 13041.7 | N | 0.188 | 7.27E−01 | 2.8 |
| LYM1 | 11603.2 | P | 3.508 | 4.36E−01 | 4.1 | LYM145 | 12952.9 | N | 0.189 | 7.54E−01 | 3.5 |
| LYM35 | 11811.3 | P | 3.641 | 4.94E−01 | 8 | LYM41 | 11834.2 | N | 0.188 | 7.59E−01 | 2.7 |
| LYM51 | 11891.1 | P | 3.47 | 5.07E−01 | 2.9 | LYM277 | 13101.1 | N | 0.186 | 8.04E−01 | 1.9 |
| LYM13 | 11771.9 | P | 3.469 | 5.23E−01 | 2.9 | LYM24 | 12063.3 | N | 0.186 | 8.26E−01 | 1.8 |
| LYM57 | 12012.6 | P | 3.6 | 5.25E−01 | 6.8 | LYM99 | 12243.2 | N | 0.185 | 8.58E−01 | 1.4 |
| LYM1 | 11604.4 | P | 3.57 | 5.61E−01 | 5.9 | LYM239 | 13041.1 | N | 0.186 | 8.59E−01 | 1.6 |
| LYM31 | 11924.4 | P | 3.505 | 5.77E−01 | 4 | LYM43 | 11791.5 | N | 0.185 | 8.70E−01 | 1.2 |
| LYM34 | 11902.2 | P | 3.484 | 6.13E−01 | 3.3 | LYM156 | 12961.7 | N | 0.185 | 9.12E−01 | 0.9 |
| LYM37 | 11801.1 | P | 3.43 | 6.41E−01 | 1.7 | LYM31 | 11923.1 | N | 0.185 | 9.12E−01 | 0.9 |
| LYM1 | 11602.6 | P | 3.472 | 6.46E−01 | 3 | LYM62 | 12023.5 | N | 0.184 | 9.24E−01 | 0.7 |
| LYM13 | 11771.6 | P | 3.42 | 6.49E−01 | 1.4 | LYM156 | 12963.4 | N | 0.185 | 9.26E−01 | 1 |
| LYM7 | 11594.2 | P | 3.454 | 7.12E−01 | 2.4 | LYM116 | 13201.8 | N | 0.184 | 9.37E−01 | 0.6 |
| LYM68 | 11942.3 | P | 3.496 | 7.55E−01 | 3.7 | LYM41 | 11832.2 | N | 0.184 | 9.65E−01 | 0.4 |
| LYM14 | 12051.1 | P | 3.422 | 7.70E−01 | 1.5 | LYM110 | 12924.5 | N | 0.183 | 9.85E−01 | 0.2 |
| LYM12 | 11872.1 | P | 3.447 | 8.61E−01 | 2.2 | CONTROL | — | N | 0.183 | — | 0 |
| LYM43 | 11791.4 | P | 3.388 | 8.73E−01 | 0.5 | LYM116 | 13202.12 | O | 2.289 | 9.00E−06 | 42.6 |
| LYM34 | 11903.2 | P | 3.431 | 9.24E−01 | 1.8 | LYM88 | 12193.1 | O | 1.96 | 6.36E−04 | 22.1 |
| LYM35 | 11811.2 | P | 3.39 | 9.29E−01 | 0.5 | LYM20 | 11711.2 | O | 2.141 | 2.08E−03 | 33.4 |
| LYM69 | 11852.2 | P | 3.381 | 9.42E−01 | 0.3 | LYM53 | 11841.1 | O | 1.955 | 4.31E−03 | 21.8 |
| LYM30 | 11913.4 | P | 3.387 | 9.73E−01 | 0.4 | LYM67 | 11782.6 | O | 2.097 | 4.70E−03 | 30.6 |
| CONTROL | — | P | 3.372 | — | 0 | LYM31 | 11923.4 | O | 1.855 | 4.75E−03 | 15.6 |
| LYM128 | 12641.3 | A | 93.331 | 6.75E−03 | 3.8 | LYM82 | 12201.1 | O | 1.863 | 2.54E−02 | 16.1 |
| LYM90 | 12393.2 | A | 93.321 | 6.94E−03 | 3.8 | LYM26 | 11824.3 | O | 1.919 | 3.12E−02 | 19.6 |
| LYM86 | 12183.1 | A | 93.089 | 9.82E−03 | 3.5 | LYM238 | 12764.8 | O | 1.942 | 3.40E−02 | 21 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM89 | 12211.4 | A | 92.845 | 1.42E−02 | 3.2 | LYM12 | 11871.3 | O | 1.754 | 6.30E−02 | 9.3 |
| LYM149 | 12343.1 | A | 92.942 | 1.62E−02 | 3.4 | LYM128 | 12641.5 | O | 2.376 | 6.82E−02 | 48.1 |
| LYM157 | 13341.7 | A | 94.877 | 1.64E−02 | 5.5 | LYM99 | 12243.1 | O | 2.287 | 8.62E−02 | 42.5 |
| LYM178 | 12163.4 | A | 92.918 | 1.64E−02 | 3.3 | LYM26 | 11824.1 | O | 2.088 | 9.91E−02 | 30.1 |
| LYM90 | 12393.1 | A | 92.555 | 2.23E−02 | 2.9 | LYM128 | 12641.3 | O | 2.096 | 1.04E−01 | 30.6 |
| LYM128 | 12642.3 | A | 92.517 | 2.39E−02 | 2.9 | LYM99 | 12244.2 | O | 1.757 | 1.07E−01 | 9.5 |
| LYM99 | 12243.2 | A | 92.543 | 2.43E−02 | 2.9 | LYM88 | 12194.2 | O | 1.705 | 1.51E−01 | 6.2 |
| LYM206 | 12601.3 | A | 93.451 | 2.44E−02 | 3.9 | LYM239 | 13042.9 | O | 1.915 | 1.56E−01 | 19.3 |
| LYM129 | 12573.5 | A | 92.522 | 2.60E−02 | 2.9 | LYM53 | 11843.2 | O | 1.719 | 1.75E−01 | 7.1 |
| LYM107 | 12631.4 | A | 92.899 | 2.65E−02 | 3.3 | LYM285 | 12733.9 | O | 2.366 | 1.77E−01 | 47.4 |
| LYM86 | 12182.3 | A | 93.033 | 2.93E−02 | 3.5 | LYM26 | 11824.6 | O | 1.955 | 1.91E−01 | 21.8 |
| LYM128 | 12641.1 | A | 92.897 | 2.99E−02 | 3.3 | LYM24 | 12061.4 | O | 1.984 | 1.96E−01 | 23.6 |
| LYM178 | 12163.3 | A | 92.504 | 3.08E−02 | 2.9 | LYM103 | 12713.5 | O | 2.029 | 2.03E−01 | 26.4 |
| LYM149 | 12344.2 | A | 92.323 | 3.24E−02 | 2.7 | LYM66 | 11954.4 | O | 2.063 | 2.20E−01 | 28.5 |
| LYM73 | 12623.2 | A | 92.762 | 3.28E−02 | 3.2 | LYM12 | 11872.1 | O | 2.394 | 2.31E−01 | 49.2 |
| LYM6 | 11735.1 | A | 92.326 | 3.43E−02 | 2.7 | LYM116 | 13202.7 | O | 1.815 | 2.36E−01 | 13.1 |
| LYM86 | 12181.3 | A | 93.242 | 4.14E−02 | 3.7 | LYM95 | 12124.4 | O | 1.814 | 2.85E−01 | 13 |
| LYM250 | 12613.2 | A | 92.215 | 4.16E−02 | 2.5 | LYM31 | 11924.4 | O | 1.785 | 3.22E−01 | 11.2 |
| LYM250 | 12613.4 | A | 92.165 | 4.20E−02 | 2.5 | LYM20 | 11716.5 | O | 1.708 | 3.22E−01 | 6.4 |
| LYM89 | 12214.2 | A | 92.355 | 4.43E−02 | 2.7 | LYM66 | 11955.2 | O | 1.765 | 3.26E−01 | 10 |
| LYM90 | 12395.3 | A | 92.938 | 4.47E−02 | 3.4 | LYM95 | 12121.2 | O | 2.142 | 3.32E−01 | 33.5 |
| LYM86 | 12183.3 | A | 92.937 | 4.54E−02 | 3.4 | LYM12 | 11871.1 | O | 2.03 | 3.52E−01 | 26.5 |
| LYM157 | 13341.4 | A | 92.35 | 4.58E−02 | 2.7 | LYM69 | 11852.2 | O | 1.815 | 3.82E−01 | 13.1 |
| LYM129 | 12573.3 | A | 92.84 | 4.79E−02 | 3.2 | LYM14 | 12051.4 | O | 1.782 | 4.01E−01 | 11 |
| LYM6 | 11734.3 | A | 92.288 | 5.09E−02 | 2.6 | LYM103 | 12712.8 | O | 1.759 | 5.04E−01 | 9.6 |
| LYM256 | 13322.3 | A | 92.641 | 6.65E−02 | 3 | LYM239 | 13044.8 | O | 1.735 | 5.52E−01 | 8.1 |
| LYM157 | 13342.4 | A | 94.106 | 7.45E−02 | 4.7 | LYM67 | 11782.4 | O | 1.775 | 5.69E−01 | 10.6 |
| LYM88 | 12191.2 | A | 91.953 | 7.61E−02 | 2.3 | LYM43 | 11791.4 | O | 1.669 | 5.91E−01 | 4 |
| LYM99 | 12244.1 | A | 93.509 | 7.70E−02 | 4 | LYM30 | 11912.7 | O | 1.639 | 5.96E−01 | 2.1 |
| LYM178 | 12164.3 | A | 91.816 | 8.24E−02 | 2.1 | LYM30 | 11912.6 | O | 1.736 | 6.07E−01 | 8.1 |
| LYM250 | 12614.1 | A | 91.729 | 8.76E−02 | 2 | LYM232 | 13024.7 | O | 1.926 | 6.15E−01 | 20 |
| LYM90 | 12395.1 | A | 93.165 | 8.97E−02 | 3.6 | LYM62 | 12023.2 | O | 1.685 | 6.23E−01 | 5 |
| LYM91 | 13283.4 | A | 91.631 | 1.00E−01 | 1.9 | LYM232 | 13024.6 | O | 1.686 | 6.28E−01 | 5.1 |
| LYM178 | 12161.2 | A | 92.239 | 1.02E−01 | 2.6 | LYM66 | 11953.6 | O | 1.635 | 6.53E−01 | 1.9 |
| LYM129 | 12571.3 | A | 91.667 | 1.10E−01 | 1.9 | LYM156 | 12963.1 | O | 1.711 | 6.79E−01 | 6.6 |
| LYM256 | 13323.3 | A | 93.178 | 1.29E−01 | 3.6 | LYM26 | 11824.5 | O | 1.866 | 6.82E−01 | 16.3 |
| LYM107 | 12633.4 | A | 91.472 | 1.31E−01 | 1.7 | LYM128 | 12641.1 | O | 1.684 | 7.51E−01 | 4.9 |
| LYM91 | 13283.1 | A | 93.948 | 1.50E−01 | 4.5 | LYM24 | 12064.1 | O | 1.711 | 7.64E−01 | 6.6 |
| LYM88 | 12193.1 | A | 91.377 | 1.54E−01 | 1.6 | LYM26 | 11821.2 | O | 1.706 | 7.79E−01 | 6.3 |
| LYM157 | 13341.1 | A | 93.647 | 1.57E−01 | 4.1 | LYM116 | 13204.4 | O | 1.779 | 8.04E−01 | 10.8 |
| LYM90 | 12392.1 | A | 92.786 | 1.71E−01 | 3.2 | LYM99 | 12243.2 | O | 1.63 | 8.51E−01 | 1.6 |
| LYM147 | 12583.3 | A | 91.846 | 1.98E−01 | 2.1 | LYM43 | 11793.2 | O | 1.63 | 9.41E−01 | 1.6 |
| LYM6 | 11735.2 | A | 92.319 | 2.06E−01 | 2.7 | LYM30 | 11913.5 | O | 1.606 | 9.98E−01 | 0.1 |
| LYM107 | 12631.2 | A | 92.349 | 2.08E−01 | 2.7 | CONTROL | — | O | 1.605 | — | 0 |
| LYM250 | 12614.2 | A | 91.184 | 2.30E−01 | 1.4 | LYM20 | 11711.2 | P | 2.438 | 2.52E−04 | 17.1 |
| LYM283 | 13304.4 | A | 91.862 | 2.32E−01 | 2.2 | LYM238 | 12764.8 | P | 2.357 | 1.15E−03 | 13.2 |
| LYM147 | 12584.4 | A | 91.139 | 2.56E−01 | 1.4 | LYM116 | 13202.12 | P | 2.552 | 3.04E−03 | 22.6 |
| LYM99 | 12243.1 | A | 91.086 | 2.57E−01 | 1.3 | LYM53 | 11841.1 | P | 2.338 | 3.08E−03 | 12.3 |
| LYM88 | 12192.1 | A | 91.579 | 2.62E−01 | 1.8 | LYM82 | 12201.1 | P | 2.294 | 5.04E−03 | 10.2 |
| LYM283 | 13304.5 | A | 91.337 | 2.62E−01 | 1.6 | LYM31 | 11923.4 | P | 2.284 | 6.11E−03 | 9.7 |
| LYM73 | 12623.1 | A | 92.42 | 2.83E−01 | 2.8 | LYM88 | 12193.1 | P | 2.393 | 7.93E−03 | 14.9 |
| LYM147 | 12581.4 | A | 91.997 | 2.92E−01 | 2.3 | LYM67 | 11782.6 | P | 2.393 | 1.64E−02 | 14.9 |
| LYM89 | 12214.3 | A | 91.734 | 2.94E−01 | 2 | LYM128 | 12641.5 | P | 2.579 | 3.82E−02 | 23.9 |
| LYM283 | 13302.2 | A | 90.934 | 2.99E−01 | 1.1 | LYM99 | 12244.2 | P | 2.243 | 4.31E−02 | 7.7 |
| LYM256 | 13321.2 | A | 92.248 | 3.12E−01 | 2.6 | LYM12 | 11871.3 | P | 2.21 | 4.39E−02 | 6.1 |
| LYM159 | 13354.6 | A | 91.458 | 3.15E−01 | 1.7 | LYM285 | 12733.9 | P | 2.538 | 4.87E−02 | 21.9 |
| LYM129 | 12572.2 | A | 91.727 | 3.32E−01 | 2 | LYM26 | 11824.3 | P | 2.31 | 5.40E−02 | 10.9 |
| LYM178 | 12164.2 | A | 92.077 | 3.32E−01 | 2.4 | LYM24 | 12061.4 | P | 2.344 | 5.96E−02 | 12.5 |
| LYM88 | 12191.1 | A | 93.357 | 3.33E−01 | 3.8 | LYM128 | 12641.3 | P | 2.412 | 6.15E−02 | 15.8 |
| LYM250 | 12611.3 | A | 91.245 | 3.42E−01 | 1.5 | LYM53 | 11843.2 | P | 2.23 | 6.53E−02 | 7.1 |
| LYM283 | 13302.1 | A | 90.834 | 3.50E−01 | 1 | LYM66 | 11954.4 | P | 2.443 | 6.54E−02 | 17.3 |
| LYM91 | 13284.3 | A | 90.961 | 3.56E−01 | 1.2 | LYM43 | 11791.4 | P | 2.211 | 6.54E−02 | 6.2 |
| LYM147 | 12584.5 | A | 93.996 | 4.12E−01 | 4.5 | LYM99 | 12243.1 | P | 2.582 | 9.80E−02 | 24 |
| LYM159 | 13352.4 | A | 91.01 | 4.60E−01 | 1.2 | LYM31 | 11924.4 | P | 2.269 | 1.13E−01 | 9 |
| LYM283 | 13303.2 | A | 91.406 | 4.71E−01 | 1.6 | LYM103 | 12713.5 | P | 2.421 | 1.17E−01 | 16.3 |
| LYM107 | 12632.1 | A | 91.645 | 4.88E−01 | 1.9 | LYM88 | 12194.2 | P | 2.185 | 1.24E−01 | 4.9 |
| LYM129 | 12572.4 | A | 90.878 | 5.03E−01 | 1.1 | LYM26 | 11824.6 | P | 2.334 | 1.30E−01 | 12.1 |
| LYM89 | 12214.4 | A | 93.157 | 5.04E−01 | 3.6 | LYM66 | 11955.2 | P | 2.2 | 1.41E−01 | 5.6 |
| LYM128 | 12642.2 | A | 91.558 | 5.33E−01 | 1.8 | LYM12 | 11872.1 | P | 2.739 | 1.65E−01 | 31.5 |
| LYM256 | 13321.3 | A | 91.538 | 5.33E−01 | 1.8 | LYM116 | 13202.7 | P | 2.163 | 1.71E−01 | 3.9 |
| LYM206 | 12603.3 | A | 91.15 | 5.58E−01 | 1.4 | LYM95 | 12121.2 | P | 2.456 | 1.79E−01 | 17.9 |
| LYM236 | 12592.3 | A | 91.439 | 5.75E−01 | 1.7 | LYM26 | 11824.1 | P | 2.389 | 2.02E−01 | 14.7 |
| LYM236 | 12594.3 | A | 91.377 | 6.02E−01 | 1.6 | LYM12 | 11873.4 | P | 2.153 | 2.17E−01 | 3.4 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM236 | 12592.4 | A | 90.999 | 6.25E−01 | 1.2 | LYM239 | 13044.8 | P | 2.223 | 2.38E−01 | 6.7 |
| LYM147 | 12583.1 | A | 90.912 | 6.62E−01 | 1.1 | LYM66 | 11953.6 | P | 2.169 | 2.58E−01 | 4.2 |
| LYM149 | 12341.1 | A | 91.327 | 6.71E−01 | 1.6 | LYM239 | 13042.9 | P | 2.33 | 2.67E−01 | 11.9 |
| LYM73 | 12622.2 | A | 91.911 | 6.73E−01 | 2.2 | LYM232 | 13024.6 | P | 2.221 | 2.68E−01 | 6.6 |
| LYM206 | 12601.2 | A | 90.459 | 7.06E−01 | 0.6 | LYM12 | 11871.1 | P | 2.378 | 3.29E−01 | 14.2 |
| LYM206 | 12603.1 | A | 90.27 | 7.13E−01 | 0.4 | LYM95 | 12124.4 | P | 2.245 | 3.30E−01 | 7.8 |
| LYM6 | 11733.2 | A | 90.249 | 7.32E−01 | 0.4 | LYM14 | 12051.4 | P | 2.234 | 3.46E−01 | 7.3 |
| LYM256 | 13324.2 | A | 90.178 | 7.88E−01 | 0.3 | LYM30 | 11912.7 | P | 2.134 | 3.65E−01 | 2.5 |
| LYM149 | 12341.3 | A | 90.221 | 7.91E−01 | 0.3 | LYM62 | 12023.2 | P | 2.202 | 3.71E−01 | 5.7 |
| LYM91 | 13284.4 | A | 90.429 | 8.53E−01 | 0.6 | LYM103 | 12712.8 | P | 2.201 | 3.96E−01 | 5.7 |
| LYM6 | 11736.1 | A | 90.297 | 9.04E−01 | 0.4 | LYM20 | 11716.5 | P | 2.155 | 4.05E−01 | 3.5 |
| LYM236 | 12593.4 | A | 90.02 | 9.77E−01 | 0.1 | LYM69 | 11852.2 | P | 2.188 | 4.52E−01 | 5.1 |
| LYM89 | 12211.2 | A | 89.955 | 9.84E−01 | 0 | LYM30 | 11912.6 | P | 2.202 | 5.00E−01 | 5.7 |
| CONTROL | — | A | 89.923 | — | 0 | LYM145 | 12951.9 | P | 2.117 | 5.23E−01 | 1.7 |
| LYM99 | 12243.1 | B | 0.444 | 1.98E−03 | 23 | LYM128 | 12641.1 | P | 2.19 | 5.43E−01 | 5.2 |
| LYM178 | 12163.3 | B | 0.408 | 2.91E−02 | 13.1 | LYM67 | 11782.4 | P | 2.221 | 5.46E−01 | 6.7 |
| LYM283 | 13302.1 | B | 0.491 | 3.45E−02 | 36 | LYM232 | 13024.7 | P | 2.366 | 5.92E−01 | 13.6 |
| LYM159 | 13354.6 | B | 0.406 | 1.13E−01 | 12.6 | LYM30 | 11913.5 | P | 2.21 | 6.02E−01 | 6.1 |
| LYM129 | 12573.5 | B | 0.409 | 1.16E−01 | 13.3 | LYM26 | 11824.5 | P | 2.268 | 6.14E−01 | 8.9 |
| LYM250 | 12613.4 | B | 0.403 | 1.57E−01 | 11.6 | LYM116 | 13204.4 | P | 2.292 | 6.62E−01 | 10.1 |
| LYM178 | 12164.2 | B | 0.399 | 2.93E−01 | 10.5 | LYM156 | 12961.9 | P | 2.106 | 6.63E−01 | 1.1 |
| LYM236 | 12594.3 | B | 0.391 | 2.93E−01 | 8.4 | LYM285 | 12734.9 | P | 2.189 | 6.81E−01 | 5.1 |
| LYM89 | 12214.4 | B | 0.379 | 3.31E−01 | 5 | LYM24 | 12064.1 | P | 2.182 | 6.92E−01 | 4.8 |
| LYM6 | 11736.1 | B | 0.395 | 3.53E−01 | 9.5 | LYM156 | 12963.1 | P | 2.138 | 7.88E−01 | 2.7 |
| LYM91 | 13284.3 | B | 0.486 | 3.66E−01 | 34.6 | LYM30 | 11913.4 | P | 2.119 | 8.02E−01 | 1.8 |
| LYM88 | 12193.1 | B | 0.378 | 3.74E−01 | 4.6 | LYM26 | 11821.2 | P | 2.139 | 8.11E−01 | 2.7 |
| LYM283 | 13302.2 | B | 0.382 | 3.95E−01 | 5.8 | LYM43 | 11793.2 | P | 2.119 | 8.47E−01 | 1.8 |
| LYM206 | 12601.2 | B | 0.447 | 4.11E−01 | 23.9 | LYM43 | 11791.5 | P | 2.096 | 8.52E−01 | 0.6 |
| LYM91 | 13284.5 | B | 0.389 | 4.14E−01 | 7.9 | LYM103 | 12712.5 | P | 2.085 | 9.78E−01 | 0.1 |
| LYM236 | 12592.3 | B | 0.403 | 4.39E−01 | 11.7 | CONTROL | — | P | 2.082 | — | 0 |
| LYM283 | 13304.4 | B | 0.491 | 4.67E−01 | 36 | LYM289 | 12492.2 | A | 92.947 | 1.86E−01 | 1.4 |
| LYM206 | 12603.1 | B | 0.39 | 4.67E−01 | 8.1 | LYM255 | 13082.5 | A | 92.825 | 2.17E−01 | 1.3 |
| LYM175 | 12651.2 | B | 0.442 | 4.72E−01 | 22.5 | LYM173 | 12981.6 | A | 93.646 | 2.22E−01 | 2.2 |
| LYM73 | 12623.2 | B | 0.425 | 4.91E−01 | 17.8 | LYM106 | 12144.4 | A | 92.705 | 3.20E−01 | 1.2 |
| LYM250 | 12611.3 | B | 0.429 | 4.98E−01 | 19 | LYM212 | 13032.8 | A | 92.513 | 3.49E−01 | 1 |
| LYM206 | 12603.3 | B | 0.39 | 4.98E−01 | 8.1 | LYM102 | 12222.1 | A | 92.53 | 3.64E−01 | 1 |
| LYM159 | 13352.4 | B | 0.396 | 5.08E−01 | 9.7 | LYM61 | 13171.8 | A | 96.667 | 3.77E−01 | 5.5 |
| LYM157 | 13342.4 | B | 0.374 | 5.11E−01 | 3.6 | LYM220 | 12851.12 | A | 92.99 | 4.10E−01 | 1.5 |
| LYM159 | 13354.8 | B | 0.412 | 5.21E−01 | 14.3 | LYM111 | 12254.3 | A | 92.606 | 4.40E−01 | 1.1 |
| LYM99 | 12243.2 | B | 0.451 | 5.34E−01 | 25.1 | LYM287 | 12771.6 | A | 93.304 | 4.59E−01 | 1.8 |
| LYM89 | 12211.2 | B | 0.454 | 5.40E−01 | 25.9 | LYM212 | 13031.5 | A | 93.614 | 4.80E−01 | 2.2 |
| LYM178 | 12163.4 | B | 0.388 | 5.58E−01 | 7.4 | LYM106 | 12142.2 | A | 92.275 | 4.86E−01 | 0.7 |
| LYM129 | 12573.3 | B | 0.393 | 5.67E−01 | 9 | LYM138 | 12562.2 | A | 92.321 | 4.89E−01 | 0.8 |
| LYM178 | 12164.3 | B | 0.448 | 5.70E−01 | 24.2 | LYM119 | 12461.1 | A | 92.376 | 4.93E−01 | 0.8 |
| LYM107 | 12631.4 | B | 0.436 | 5.95E−01 | 20.9 | LYM288 | 12743.8 | A | 92.288 | 5.05E−01 | 0.7 |
| LYM250 | 12613.2 | B | 0.381 | 5.96E−01 | 5.7 | LYM270 | 12871.7 | A | 92.601 | 5.14E−01 | 1.1 |
| LYM178 | 12161.2 | B | 0.396 | 5.98E−01 | 9.7 | LYM183 | 12993.7 | A | 92.209 | 5.32E−01 | 0.6 |
| LYM107 | 12633.4 | B | 0.399 | 6.05E−01 | 10.7 | LYM138 | 12562.1 | A | 92.298 | 5.80E−01 | 0.7 |
| LYM149 | 12341.1 | B | 0.438 | 6.07E−01 | 21.4 | LYM212 | 13031.6 | A | 92.757 | 5.96E−01 | 1.2 |
| LYM149 | 12344.2 | B | 0.446 | 7.09E−01 | 23.7 | LYM220 | 12852.2 | A | 92.225 | 6.15E−01 | 0.7 |
| LYM147 | 12583.3 | B | 0.389 | 7.15E−01 | 7.9 | LYM44 | 11885.4 | A | 92.076 | 6.37E−01 | 0.5 |
| LYM129 | 12572.4 | B | 0.379 | 7.22E−01 | 5.2 | LYM111 | 12251.1 | A | 92.235 | 6.39E−01 | 0.7 |
| LYM88 | 12191.2 | B | 0.368 | 7.24E−01 | 1.9 | LYM183 | 12993.5 | A | 92.276 | 6.42E−01 | 0.7 |
| LYM236 | 12591.1 | B | 0.37 | 7.41E−01 | 2.6 | LYM289 | 12491.1 | A | 92.318 | 6.45E−01 | 0.8 |
| LYM159 | 13354.8 | B | 0.4 | 7.62E−01 | 10.9 | LYM242 | 13053.7 | A | 92.383 | 6.48E−01 | 0.8 |
| LYM147 | 12583.1 | B | 0.366 | 7.74E−01 | 1.5 | LYM201 | 12833.9 | A | 92.111 | 6.51E−01 | 0.5 |
| LYM175 | 12654.4 | B | 0.376 | 7.81E−01 | 4.2 | LYM201 | 12833.7 | A | 92.164 | 6.53E−01 | 0.6 |
| LYM147 | 12584.5 | B | 0.371 | 8.02E−01 | 2.9 | LYM242 | 13051.8 | A | 92.232 | 6.65E−01 | 0.7 |
| LYM256 | 13324.2 | B | 0.375 | 8.21E−01 | 3.9 | LYM208 | 13014.7 | A | 92.484 | 6.76E−01 | 0.9 |
| LYM250 | 12614.1 | B | 0.371 | 8.33E−01 | 2.7 | LYM198 | 13002.8 | A | 92.042 | 6.93E−01 | 0.5 |
| LYM6 | 11735.1 | B | 0.363 | 8.97E−01 | 0.6 | LYM153 | 12323.2 | A | 91.983 | 7.00E−01 | 0.4 |
| LYM91 | 13283.4 | B | 0.363 | 9.28E−01 | 0.6 | LYM142 | 12802.7 | A | 92.044 | 7.19E−01 | 0.5 |
| LYM73 | 12623.3 | B | 0.367 | 9.60E−01 | 1.7 | LYM183 | 12994.8 | A | 92.015 | 7.24E−01 | 0.4 |
| CONTROL | — | B | 0.361 | — | 0 | LYM142 | 12802.9 | A | 91.961 | 7.32E−01 | 0.4 |
| LYM250 | 12613.4 | C | 4.506 | 3.98E−04 | 15.2 | LYM61 | 13174.5 | A | 92.781 | 7.51E−01 | 1.3 |
| LYM206 | 12601.2 | C | 4.463 | 1.11E−03 | 14.1 | LYM107 | 12632.3 | A | 91.922 | 7.63E−01 | 0.3 |
| LYM159 | 13354.6 | C | 4.331 | 2.97E−03 | 10.7 | LYM291 | 12754.9 | A | 91.875 | 7.86E−01 | 0.3 |
| LYM206 | 12603.3 | C | 4.438 | 3.26E−03 | 13.5 | LYM201 | 12833.6 | A | 93.231 | 7.98E−01 | 1.8 |
| LYM73 | 12623.2 | C | 4.3 | 4.40E−03 | 9.9 | LYM44 | 11885.3 | A | 91.867 | 8.04E−01 | 0.3 |
| LYM107 | 12633.4 | C | 4.356 | 5.15E−03 | 11.4 | LYM130 | 12332.1 | A | 92.065 | 8.21E−01 | 0.5 |
| LYM178 | 12163.3 | C | 4.194 | 2.03E−02 | 7.2 | LYM137 | 12153.1 | A | 91.968 | 8.65E−01 | 0.4 |
| LYM250 | 12613.2 | C | 4.175 | 3.20E−02 | 6.7 | LYM111 | 12254.4 | A | 91.877 | 8.89E−01 | 0.3 |
| LYM88 | 12191.2 | C | 4.375 | 3.90E−02 | 11.9 | LYM61 | 13172.4 | A | 92.025 | 8.90E−01 | 0.4 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM159 | 13352.4 | C | 4.275 | 4.86E−02 | 9.3 | LYM100 | 12134.1 | A | 91.757 | 8.94E−01 | 0.1 |
| LYM91 | 13284.3 | C | 4.8 | 6.56E−02 | 22.7 | LYM90 | 12392.1 | A | 91.79 | 9.06E−01 | 0.2 |
| LYM206 | 12603.1 | C | 4.2 | 1.21E−01 | 7.4 | LYM130 | 12333.1 | A | 91.91 | 9.11E−01 | 0.3 |
| LYM236 | 12594.3 | C | 4.181 | 1.21E−01 | 6.9 | LYM197 | 12824.4 | A | 91.779 | 9.37E−01 | 0.2 |
| LYM178 | 12161.2 | C | 4.3 | 1.39E−01 | 9.9 | LYM90 | 12394.2 | A | 91.691 | 9.53E−01 | 0.1 |
| LYM90 | 12395.1 | C | 4.163 | 1.59E−01 | 6.4 | LYM291 | 12753.6 | A | 91.669 | 9.65E−01 | 0 |
| LYM175 | 12651.2 | C | 4.538 | 1.78E−01 | 16 | LYM105 | 12293.1 | A | 91.657 | 9.77E−01 | 0 |
| LYM99 | 12243.1 | C | 4.781 | 1.90E−01 | 22.2 | LYM208 | 13013.6 | A | 91.663 | 9.84E−01 | 0 |
| LYM157 | 13342.4 | C | 4.313 | 2.08E−01 | 10.3 | LYM90 | 12393.4 | A | 91.627 | 9.99E−01 | 0 |
| LYM236 | 12592.3 | C | 4.313 | 2.53E−01 | 10.3 | CONTROL | — | A | 91.624 | — | 0 |
| LYM236 | 12591.1 | C | 4.075 | 2.73E−01 | 4.2 | LYM152 | 12373.2 | B | 0.357 | 1.21E−03 | 50.4 |
| LYM129 | 12573.5 | C | 4.219 | 2.73E−01 | 7.9 | LYM102 | 12222.1 | B | 0.386 | 1.41E−03 | 62.7 |
| LYM256 | 13321.2 | C | 4.188 | 3.23E−01 | 7.1 | LYM174 | 12411.2 | B | 0.344 | 2.44E−03 | 44.8 |
| LYM6 | 11735.1 | C | 4.144 | 3.41E−01 | 5.9 | LYM111 | 12251.1 | B | 0.379 | 3.24E−03 | 59.8 |
| LYM99 | 12241.1 | C | 4.013 | 3.48E−01 | 2.6 | LYM100 | 12133.3 | B | 0.349 | 3.88E−03 | 47.2 |
| LYM88 | 12193.1 | C | 4.138 | 3.66E−01 | 5.8 | LYM106 | 12144.4 | B | 0.334 | 6.10E−03 | 40.6 |
| LYM6 | 11736.1 | C | 4.638 | 3.77E−01 | 18.6 | LYM107 | 12632.3 | B | 0.386 | 6.60E−03 | 62.7 |
| LYM283 | 13304.4 | C | 4.569 | 3.87E−01 | 16.8 | LYM174 | 12414.3 | B | 0.324 | 7.65E−03 | 36.4 |
| LYM250 | 12611.3 | C | 4.569 | 4.20E−01 | 16.8 | LYM102 | 12222.2 | B | 0.345 | 9.57E−03 | 45.4 |
| LYM129 | 12572.4 | C | 4.319 | 4.24E−01 | 10.4 | LYM107 | 12631.2 | B | 0.312 | 1.54E−02 | 31.4 |
| LYM178 | 12163.4 | C | 4.266 | 4.25E−01 | 9.1 | LYM102 | 12221.2 | B | 0.336 | 1.60E−02 | 41.4 |
| LYM147 | 12583.3 | C | 4 | 4.32E−01 | 2.3 | LYM294.3 | B | | 0.313 | 1.62E−02 | 31.7 |
| LYM250 | 12614.1 | C | 4.331 | 4.39E−01 | 10.7 | LYM143 | 12524.5 | B | 0.312 | 1.76E−02 | 31.4 |
| LYM175 | 12654.4 | C | 4.178 | 4.45E−01 | 6.8 | LYM100 | 12133.1 | B | 0.325 | 1.79E−02 | 36.9 |
| LYM6 | 11733.2 | C | 4.113 | 4.62E−01 | 5.1 | LYM198 | 13004.6 | B | 0.319 | 2.41E−02 | 34.3 |
| LYM159 | 13354.5 | C | 4.515 | 4.68E−01 | 15.4 | LYM137 | 12153.1 | B | 0.305 | 2.82E−02 | 28.5 |
| LYM91 | 13283.4 | C | 4.144 | 4.87E−01 | 5.9 | LYM107 | 12632.1 | B | 0.346 | 3.57E−02 | 45.6 |
| LYM178 | 12164.3 | C | 4.481 | 5.11E−01 | 14.6 | LYM111 | 12254.4 | B | 0.404 | 3.60E−02 | 70.4 |
| LYM283 | 13302.1 | C | 4.231 | 5.82E−01 | 8.2 | LYM105 | 12297.2 | B | 0.297 | 4.45E−02 | 25.1 |
| LYM256 | 13323.3 | C | 3.988 | 6.15E−01 | 2 | LYM137 | 12151.1 | B | 0.323 | 4.83E−02 | 36.1 |
| LYM99 | 12243.2 | C | 4.238 | 6.45E−01 | 8.3 | LYM143 | 12523.4 | B | 0.293 | 4.91E−02 | 23.2 |
| LYM107 | 12631.4 | C | 4.1 | 6.53E−01 | 4.8 | LYM111 | 12251.3 | B | 0.319 | 5.49E−02 | 34.6 |
| LYM178 | 12164.2 | C | 4.031 | 6.82E−01 | 3.1 | LYM106 | 12142.3 | B | 0.336 | 5.57E−02 | 41.4 |
| LYM147 | 12584.5 | C | 4.069 | 6.98E−01 | 4 | LYM220 | 12851.8 | B | 0.301 | 5.77E−02 | 26.9 |
| LYM256 | 13324.2 | C | 4.013 | 7.05E−01 | 2.6 | LYM102 | 12221.1 | B | 0.299 | 6.79E−02 | 26.1 |
| LYM88 | 12192.1 | C | 3.988 | 7.11E−01 | 2 | LYM174 | 12412.1 | B | 0.384 | 7.26E−02 | 61.7 |
| LYM236 | 12592.4 | C | 4.138 | 7.17E−01 | 5.8 | LYM137 | 12152.1 | B | 0.286 | 8.50E−02 | 20.3 |
| LYM89 | 12211.2 | C | 4.094 | 7.24E−01 | 4.7 | LYM137 | 12154.5 | B | 0.291 | 8.50E−02 | 22.4 |
| LYM157 | 13341.4 | C | 4.05 | 7.44E−01 | 3.5 | LYM143 | 12524.7 | B | 0.289 | 9.00E−02 | 21.7 |
| LYM89 | 12214.4 | C | 3.956 | 7.54E−01 | 1.2 | LYM138 | 12561.3 | B | 0.293 | 9.03E−02 | 23.2 |
| LYM86 | 12181.2 | C | 3.988 | 7.84E−01 | 2 | LYM102 | 12222.3 | B | 0.404 | 9.03E−02 | 70.1 |
| LYM73 | 12622.2 | C | 4.063 | 8.04E−01 | 3.9 | LYM142 | 12804.1 | B | 0.285 | 9.32E−02 | 20 |
| LYM149 | 12344.2 | C | 4.244 | 8.12E−01 | 8.5 | LYM105 | 12293.1 | B | 0.283 | 1.01E−01 | 19 |
| LYM159 | 13354.8 | C | 4.031 | 8.41E−01 | 3.1 | LYM107 | 12631.1 | B | 0.326 | 1.10E−01 | 37.5 |
| LYM86 | 12183.3 | C | 3.944 | 8.67E−01 | 0.8 | LYM212 | 13031.6 | B | 0.284 | 1.11E−01 | 19.6 |
| LYM256 | 13322.3 | C | 3.925 | 9.00E−01 | 0.4 | LYM291 | 12754.9 | B | 0.516 | 1.24E−01 | 117.5 |
| LYM283 | 13302.2 | C | 3.925 | 9.20E−01 | 0.4 | LYM105 | 12297.1 | B | 0.402 | 1.35E−01 | 69.3 |
| LYM6 | 11735.2 | C | 3.931 | 9.33E−01 | 0.5 | LYM138 | 12562.1 | B | 0.278 | 1.36E−01 | 17.2 |
| CONTROL | — | C | 3.911 | — | 0 | LYM100 | 12131.2 | B | 0.35 | 1.42E−01 | 47.4 |
| LYM107 | 12631.4 | D | 0.286 | 2.09E−03 | 30.2 | LYM100 | 12131.3 | B | 0.3 | 1.45E−01 | 26.4 |
| LYM236 | 12592.3 | D | 0.282 | 3.12E−03 | 28.3 | LYM289 | 12491.1 | B | 0.348 | 1.51E−01 | 46.7 |
| LYM147 | 12583.3 | D | 0.278 | 7.97E−03 | 26.3 | LYM173 | 12982.7 | B | 0.326 | 1.56E−01 | 37.5 |
| LYM129 | 12572.4 | D | 0.27 | 9.42E−03 | 22.7 | LYM106 | 12144.3 | B | 0.351 | 1.59E−01 | 48 |
| LYM6 | 11736.1 | D | 0.268 | 1.07E−02 | 22.1 | LYM174 | 12414.2 | B | 0.384 | 1.60E−01 | 61.7 |
| LYM178 | 12163.4 | D | 0.283 | 1.31E−02 | 28.9 | LYM107 | 12633.4 | B | 0.372 | 1.75E−01 | 56.7 |
| LYM89 | 12211.2 | D | 0.269 | 3.53E−02 | 22.3 | LYM212 | 13032.8 | B | 0.304 | 1.89E−01 | 28.2 |
| LYM73 | 12623.2 | D | 0.254 | 4.68E−02 | 15.5 | LYM153 | 12324.2 | B | 0.271 | 1.90E−01 | 14.3 |
| LYM90 | 12395.3 | D | 0.285 | 6.11E−02 | 29.5 | LYM143 | 12521.1 | B | 0.303 | 1.91E−01 | 27.5 |
| LYM99 | 12243.2 | D | 0.263 | 6.21E−02 | 19.6 | LYM138 | 12561.1 | B | 0.319 | 1.91E−01 | 34.3 |
| LYM88 | 12193.1 | D | 0.288 | 6.59E−02 | 30.9 | LYM100 | 12134.3 | B | 0.298 | 1.91E−01 | 25.6 |
| LYM206 | 12603.1 | D | 0.271 | 6.76E−02 | 23.2 | LYM152 | 12371.3 | B | 0.311 | 2.03E−01 | 30.9 |
| LYM250 | 12613.2 | D | 0.251 | 6.95E−02 | 14.5 | LYM289 | 12493.2 | B | 0.281 | 2.03E−01 | 18.5 |
| LYM90 | 12392.1 | D | 0.249 | 7.55E−02 | 13.5 | LYM106 | 12142.2 | B | 0.451 | 2.04E−01 | 89.9 |
| LYM86 | 12182.3 | D | 0.247 | 9.53E−02 | 12.5 | LYM106 | 12141.4 | B | 0.427 | 2.09E−01 | 79.9 |
| LYM90 | 12395.1 | D | 0.278 | 1.03E−01 | 26.4 | LYM173 | 12982.6 | B | 0.34 | 2.21E−01 | 43.3 |
| LYM147 | 12584.4 | D | 0.244 | 1.25E−01 | 11.2 | LYM107 | 12631.4 | B | 0.503 | 2.37E−01 | 112.1 |
| LYM178 | 12161.2 | D | 0.268 | 1.42E−01 | 22.2 | LYM137 | 12151.4 | B | 0.337 | 2.43E−01 | 41.9 |
| LYM236 | 12594.3 | D | 0.245 | 1.49E−01 | 11.3 | LYM288 | 12744.7 | B | 0.319 | 2.48E−01 | 34.3 |
| LYM128 | 12641.3 | D | 0.243 | 1.63E−01 | 10.8 | LYM153 | 12324.1 | B | 0.376 | 2.54E−01 | 58.3 |
| LYM178 | 12164.3 | D | 0.242 | 1.63E−01 | 10.3 | LYM111 | 12254.3 | B | 0.275 | 2.65E−01 | 15.9 |
| LYM206 | 12603.3 | D | 0.345 | 1.82E−01 | 57 | LYM197 | 12824.4 | B | 0.34 | 2.66E−01 | 43.4 |
| LYM159 | 13354.6 | D | 0.257 | 1.95E−01 | 16.9 | LYM102 | 12222.6 | B | 0.528 | 2.70E−01 | 122.3 |
| LYM73 | 12623.1 | D | 0.247 | 2.14E−01 | 12.5 | LYM152 | 12371.2 | B | 0.323 | 2.76E−01 | 35.9 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM159 | 13354.5 | D | 0.241 | 2.20E−01 | 9.8 | LYM220 | 12851.12 | B | 0.266 | 2.76E−01 | 11.9 |
| LYM129 | 12573.3 | D | 0.267 | 2.33E−01 | 21.4 | LYM138 | 12566.1 | B | 0.296 | 2.78E−01 | 24.6 |
| LYM250 | 12613.4 | D | 0.326 | 2.36E−01 | 48.2 | LYM198 | 13002.6 | B | 0.401 | 2.91E−01 | 68.8 |
| LYM107 | 12633.4 | D | 0.321 | 2.54E−01 | 45.9 | LYM173 | 12981.5 | B | 0.268 | 2.98E−01 | 13 |
| LYM88 | 12191.2 | D | 0.285 | 2.57E−01 | 29.6 | LYM142 | 12802.9 | B | 0.323 | 3.06E−01 | 36.1 |
| LYM175 | 12651.2 | D | 0.241 | 2.65E−01 | 9.5 | LYM44 | 11884.1 | B | 0.263 | 3.14E−01 | 10.6 |
| LYM6 | 11735.1 | D | 0.298 | 2.86E−01 | 35.7 | LYM143 | 12521.2 | B | 0.265 | 3.27E−01 | 11.7 |
| LYM250 | 12614.1 | D | 0.24 | 2.88E−01 | 9.2 | LYM152 | 12372.2 | B | 0.284 | 3.43E−01 | 19.7 |
| LYM157 | 13341.4 | D | 0.235 | 3.14E−01 | 7.1 | LYM288 | 12743.9 | B | 0.381 | 3.52E−01 | 60.6 |
| LYM178 | 12163.3 | D | 0.274 | 3.28E−01 | 24.7 | LYM173 | 12981.6 | B | 0.327 | 3.64E−01 | 37.7 |
| LYM99 | 12243.1 | D | 0.298 | 3.29E−01 | 35.7 | LYM111 | 12252.2 | B | 0.409 | 3.69E−01 | 72.2 |
| LYM88 | 12194.2 | D | 0.242 | 3.37E−01 | 10 | LYM111 | 12251.4 | B | 0.336 | 3.76E−01 | 41.7 |
| LYM129 | 12573.5 | D | 0.286 | 3.40E−01 | 30 | LYM289 | 12491.4 | B | 0.356 | 3.78E−01 | 50.1 |
| LYM86 | 12183.3 | D | 0.235 | 3.42E−01 | 6.9 | LYM198 | 13002.8 | B | 0.276 | 3.80E−01 | 16.1 |
| LYM89 | 12214.2 | D | 0.283 | 3.49E−01 | 29 | LYM119 | 12463.2 | B | 0.336 | 3.81E−01 | 41.4 |
| LYM206 | 12601.2 | D | 0.332 | 3.68E−01 | 51 | LYM105 | 12294.2 | B | 0.309 | 3.82E−01 | 30.3 |
| LYM128 | 12642.3 | D | 0.254 | 4.14E−01 | 15.4 | LYM255 | 13082.5 | B | 0.268 | 3.92E−01 | 12.7 |
| LYM91 | 13284.3 | D | 0.257 | 4.24E−01 | 16.8 | LYM142 | 12803.6 | B | 0.426 | 3.92E−01 | 79.3 |
| LYM236 | 12591.1 | D | 0.27 | 4.45E−01 | 23 | LYM105 | 12295.2 | B | 0.326 | 3.98E−01 | 37.5 |
| LYM91 | 13283.1 | D | 0.231 | 4.60E−01 | 5 | LYM208 | 13013.6 | B | 0.359 | 4.05E−01 | 51.2 |
| LYM89 | 12214.3 | D | 0.256 | 4.88E−01 | 16.3 | LYM242 | 13051.8 | B | 0.312 | 4.11E−01 | 31.4 |
| LYM206 | 12601.3 | D | 0.232 | 5.03E−01 | 5.4 | LYM183 | 12991.7 | B | 0.258 | 4.18E−01 | 8.5 |
| LYM86 | 12183.1 | D | 0.245 | 5.08E−01 | 11.6 | LYM119 | 12461.1 | B | 0.27 | 4.22E−01 | 13.8 |
| LYM236 | 12592.4 | D | 0.269 | 5.38E−01 | 22.2 | LYM142 | 12801.8 | B | 0.258 | 4.22E−01 | 8.8 |
| LYM175 | 12654.4 | D | 0.262 | 5.39E−01 | 19 | LYM288 | 12743.8 | B | 0.269 | 4.37E−01 | 13.5 |
| LYM90 | 12393.1 | D | 0.251 | 5.42E−01 | 14.3 | LYM287 | 12773.7 | B | 0.303 | 4.38E−01 | 27.5 |
| LYM250 | 12614.2 | D | 0.243 | 5.44E−01 | 10.5 | LYM212 | 13031.5 | B | 0.266 | 4.43E−01 | 11.9 |
| LYM250 | 12611.3 | D | 0.265 | 5.54E−01 | 20.5 | LYM255 | 13082.7 | B | 0.264 | 4.46E−01 | 11.4 |
| LYM283 | 13304.4 | D | 0.251 | 6.17E−01 | 14.1 | LYM143 | 12524.2 | B | 0.309 | 4.52E−01 | 30.3 |
| LYM6 | 11733.2 | D | 0.235 | 6.79E−01 | 6.8 | LYM153 | 12321.2 | B | 0.303 | 4.54E−01 | 27.5 |
| LYM147 | 12584.5 | D | 0.227 | 6.93E−01 | 3.3 | LYM270 | 12871.7 | B | 0.264 | 4.64E−01 | 11.1 |
| LYM157 | 13342.4 | D | 0.249 | 7.01E−01 | 13.2 | LYM208 | 13012.8 | B | 0.349 | 4.64E−01 | 46.9 |
| LYM91 | 13283.4 | D | 0.248 | 7.12E−01 | 12.8 | LYM220 | 12851.11 | B | 0.273 | 4.64E−01 | 15 |
| LYM128 | 12641.1 | D | 0.236 | 7.33E−01 | 7.6 | LYM255 | 13082.9 | B | 0.327 | 4.69E−01 | 37.7 |
| LYM206 | 12603.2 | D | 0.225 | 7.44E−01 | 2.4 | LYM152 | 12373.1 | B | 0.256 | 4.76E−01 | 8 |
| LYM73 | 12622.2 | D | 0.234 | 8.40E−01 | 6.4 | LYM174 | 12411.3 | B | 0.265 | 4.89E−01 | 11.7 |
| LYM175 | 12654.6 | D | 0.226 | 8.63E−01 | 2.7 | LYM173 | 12981.8 | B | 0.254 | 4.95E−01 | 7 |
| LYM159 | 13352.4 | D | 0.225 | 8.63E−01 | 2.3 | LYM288 | 12741.9 | B | 0.268 | 5.10E−01 | 12.7 |
| LYM147 | 12583.1 | D | 0.235 | 8.75E−01 | 7.2 | LYM270 | 12871.5 | B | 0.262 | 5.13E−01 | 10.5 |
| LYM178 | 12164.2 | D | 0.226 | 8.77E−01 | 3 | LYM44 | 11885.4 | B | 0.281 | 5.16E−01 | 18.5 |
| LYM88 | 12191.1 | D | 0.225 | 9.11E−01 | 2.2 | LYM119 | 12462.2 | B | 0.361 | 5.34E−01 | 52.2 |
| LYM89 | 12214.4 | D | 0.221 | 9.16E−01 | 0.7 | LYM130 | 12332.2 | B | 0.275 | 5.42E−01 | 15.9 |
| LYM149 | 12344.2 | D | 0.227 | 9.29E−01 | 3.5 | LYM212 | 13034.9 | B | 0.256 | 5.42E−01 | 8 |
| LYM147 | 12581.4 | D | 0.223 | 9.55E−01 | 1.6 | LYM142 | 12804.3 | B | 0.259 | 5.43E−01 | 93 |
| LYM175 | 12651.4 | D | 0.222 | 9.80E−01 | 1 | LYM197 | 12824.7 | B | 0.293 | 5.46E−01 | 23.2 |
| CONTROL | — | D | 0.22 | — | 0 | LYM220 | 12851.13 | B | 0.262 | 5.67E−01 | 10.3 |
| LYM107 | 12633.4 | E | 9.188 | 1.23E−03 | 8.4 | LYM198 | 13002.5 | B | 0.282 | 5.80E−01 | 18.8 |
| LYM206 | 12603.3 | E | 9.188 | 1.23E−03 | 8.4 | LYM137 | 12151.2 | B | 0.252 | 5.93E−01 | 6.1 |
| LYM88 | 12193.1 | E | 9.063 | 3.77E−03 | 6.9 | LYM183 | 12993.7 | B | 0.277 | 6.04E−01 | 16.7 |
| LYM6 | 11734.3 | E | 9.125 | 2.59E−02 | 7.7 | LYM212 | 13034.8 | B | 0.294 | 6.34E−01 | 23.8 |
| LYM157 | 13341.4 | E | 8.813 | 4.79E−02 | 4 | LYM220 | 12852.2 | B | 0.261 | 6.54E−01 | 10.1 |
| LYM283 | 13304.4 | E | 8.813 | 4.79E−02 | 4 | LYM130 | 12331.3 | B | 0.284 | 6.60E−01 | 19.6 |
| LYM178 | 12164.3 | E | 8.875 | 9.63E−02 | 4.7 | LYM288 | 12744.6 | B | 0.258 | 6.65E−01 | 8.8 |
| LYM90 | 12393.1 | E | 9.063 | 1.17E−01 | 6.9 | LYM291 | 12753.6 | B | 0.249 | 6.65E−01 | 5.1 |
| LYM90 | 12395.1 | E | 9.125 | 1.79E−01 | 7.7 | LYM138 | 12564.1 | B | 0.259 | 6.70E−01 | 9 |
| LYM250 | 12613.4 | E | 8.688 | 1.79E−01 | 2.5 | LYM289 | 12492.2 | B | 0.263 | 6.79E−01 | 10.6 |
| LYM99 | 12243.2 | E | 8.688 | 1.79E−01 | 2.5 | LYM201 | 12833.7 | B | 0.281 | 6.89E−01 | 18.5 |
| LYM107 | 12631.4 | E | 8.75 | 2.07E−01 | 3.2 | LYM130 | 12334.1 | B | 0.247 | 7.13E−01 | 4 |
| LYM73 | 12623.2 | E | 8.75 | 2.07E−01 | 3.2 | LYM138 | 12562.2 | B | 0.252 | 7.28E−01 | 6.1 |
| LYM90 | 12395.3 | E | 9.188 | 3.34E−01 | 8.4 | LYM142 | 12802.7 | B | 0.246 | 7.38E−01 | 3.5 |
| LYM147 | 12583.3 | E | 8.688 | 4.46E−01 | 2.5 | LYM130 | 12333.1 | B | 0.257 | 7.42E−01 | 8.2 |
| LYM250 | 12614.1 | E | 8.688 | 4.46E−01 | 2.5 | LYM153 | 12323.2 | B | 0.255 | 7.44E−01 | 7.4 |
| LYM128 | 12642.3 | E | 8.625 | 4.56E−01 | 1.8 | LYM106 | 12142.1 | B | 0.262 | 7.70E−01 | 10.3 |
| LYM129 | 12573.3 | E | 8.625 | 4.56E−01 | 1.8 | LYM270 | 12872.5 | B | 0.244 | 7.99E−01 | 2.7 |
| LYM88 | 12191.2 | E | 8.625 | 4.56E−01 | 1.8 | LYM183 | 12994.7 | B | 0.243 | 8.20E−01 | 2.4 |
| LYM89 | 12211.4 | E | 8.625 | 4.56E−01 | 1.8 | LYM242 | 13053.7 | B | 0.242 | 8.52E−01 | 1.9 |
| LYM99 | 12243.1 | E | 8.625 | 4.56E−01 | 1.8 | LYM183 | 12994.8 | B | 0.243 | 8.58E−01 | 2.2 |
| LYM206 | 12603.1 | E | 8.563 | 5.26E−01 | 1 | LYM291 | 12751.7 | B | 0.243 | 8.65E−01 | 2.4 |
| LYM6 | 11733.2 | E | 8.563 | 5.62E−01 | 1 | LYM287 | 12771.6 | B | 0.241 | 8.75E−01 | 1.6 |
| LYM86 | 12182.3 | E | 8.563 | 5.62E−01 | 1 | LYM44 | 11884.3 | B | 0.246 | 9.08E−01 | 3.8 |
| LYM6 | 11735.1 | E | 8.813 | 5.79E−01 | 4 | LYM270 | 12872.7 | B | 0.245 | 9.08E−01 | 3.2 |
| LYM236 | 12591.1 | E | 8.75 | 5.95E−01 | 3.2 | LYM255 | 13081.5 | B | 0.244 | 9.17E−01 | 3 |
| LYM73 | 12623.1 | E | 8.75 | 5.95E−01 | 3.2 | LYM270 | 12871.8 | B | 0.238 | 9.96E−01 | 0.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM178 | 12163.3 | E | 8.688 | 6.19E−01 | 2.5 | CONTROL | — | B | 0.237 | — | 0 |
| LYM147 | 12584.4 | E | 8.563 | 7.37E−01 | 1 | LYM102 | 12221.2 | C | 3.181 | 7.20E−05 | 59.4 |
| LYM91 | 13283.1 | E | 8.563 | 8.30E−01 | 1 | LYM174 | 12411.2 | C | 3.1 | 1.24E−04 | 55.4 |
| LYM236 | 12594.3 | E | 8.625 | 8.51E−01 | 1.8 | LYM111 | 12254.4 | C | 3.5 | 1.46E−04 | 75.4 |
| LYM250 | 12613.2 | E | 8.5 | 8.55E−01 | 0.3 | LYM137 | 12151.1 | C | 3.044 | 1.55E−04 | 52.5 |
| LYM128 | 12641.3 | E | 8.5 | 8.98E−01 | 0.3 | LYM102 | 12222.2 | C | 3.031 | 2.15E−04 | 51.9 |
| LYM206 | 12601.2 | E | 8.5 | 8.98E−01 | 0.3 | LYM198 | 13004.6 | C | 2.969 | 2.68E−04 | 48.8 |
| LYM236 | 12592.3 | E | 8.5 | 8.98E−01 | 0.3 | LYM106 | 12144.4 | C | 2.881 | 4.76E−04 | 44.4 |
| LYM159 | 13354.5 | E | 8.521 | 9.20E−01 | 0.5 | LYM174 | 12414.3 | C | 2.856 | 5.73E−04 | 43.1 |
| LYM129 | 12572.4 | E | 8.5 | 9.40E−01 | 0.3 | LYM152 | 12373.2 | C | 2.856 | 6.33E−04 | 43.1 |
| LYM175 | 12653.3 | E | 8.5 | 9.40E−01 | 0.3 | LYM105 | 12297.2 | C | 2.869 | 7.57E−04 | 43.8 |
| LYM178 | 12164.2 | E | 8.5 | 9.40E−01 | 0.3 | LYM137 | 12152.1 | C | 2.731 | 1.65E−03 | 36.9 |
| LYM99 | 12241.1 | E | 8.5 | 9.40E−01 | 0.3 | LYM100 | 12134.1 | C | 2.881 | 1.87E−03 | 44.4 |
| LYM157 | 13342.4 | E | 8.5 | 9.59E−01 | 0.3 | LYM107 | 12632.1 | C | 2.913 | 2.19E−03 | 46 |
| CONTROL | — | E | 8.475 | — | 0 | LYM105 | 12294.3 | C | 2.8 | 2.39E−03 | 40.3 |
| LYM206 | 12603.3 | F | 0.579 | 5.70E−05 | 43 | LYM107 | 12631.1 | C | 2.688 | 2.68E−03 | 34.7 |
| LYM236 | 12592.3 | F | 0.487 | 6.32E−03 | 20.3 | LYM107 | 12632.3 | C | 3.3 | 3.16E−03 | 65.4 |
| LYM73 | 12623.1 | F | 0.442 | 1.25E−01 | 9.2 | LYM107 | 12631.2 | C | 2.681 | 6.82E−03 | 34.4 |
| LYM129 | 12572.4 | F | 0.442 | 1.62E−01 | 9.1 | LYM100 | 12133.3 | C | 3.294 | 7.28E−03 | 65.1 |
| LYM73 | 12623.2 | F | 0.438 | 1.80E−01 | 8 | LYM197 | 12824.4 | C | 2.738 | 9.52E−03 | 37.2 |
| LYM159 | 13354.6 | F | 0.443 | 1.85E−01 | 9.4 | LYM106 | 12141.4 | C | 3.675 | 1.04E−02 | 84.2 |
| LYM206 | 12601.3 | F | 0.456 | 1.88E−01 | 12.6 | LYM152 | 12373.1 | C | 2.5 | 1.15E−02 | 25.3 |
| LYM250 | 12613.4 | F | 0.533 | 2.23E−01 | 31.6 | LYM143 | 12523.4 | C | 2.556 | 1.22E−02 | 28.1 |
| LYM147 | 12583.3 | F | 0.434 | 2.25E−01 | 7.1 | LYM111 | 12251.1 | C | 3.525 | 1.30E−02 | 76.7 |
| LYM90 | 12395.3 | F | 0.432 | 2.54E−01 | 6.6 | LYM291 | 12754.9 | C | 4.031 | 1.90E−02 | 102 |
| LYM90 | 12395.1 | F | 0.459 | 2.58E−01 | 13.2 | LYM142 | 12804.1 | C | 2.494 | 2.73E−02 | 25 |
| LYM178 | 12163.4 | F | 0.487 | 2.76E−01 | 20.2 | LYM102 | 12221.1 | C | 2.813 | 3.28E−02 | 41 |
| LYM89 | 12211.4 | F | 0.433 | 2.87E−01 | 7 | LYM288 | 12744.7 | C | 2.638 | 3.46E−02 | 32.2 |
| LYM250 | 12614.1 | F | 0.429 | 3.05E−01 | 5.8 | LYM100 | 12131.2 | C | 3.154 | 3.50E−02 | 58 |
| LYM107 | 12633.4 | F | 0.487 | 3.08E−01 | 20.2 | LYM111 | 12254.3 | C | 2.563 | 3.71E−02 | 28.4 |
| LYM236 | 12591.1 | F | 0.481 | 3.14E−01 | 18.8 | LYM105 | 12297.1 | C | 3.269 | 4.57E−02 | 63.8 |
| LYM88 | 12193.1 | F | 0.49 | 3.39E−01 | 20.9 | LYM212 | 13031.5 | C | 2.354 | 4.66E−02 | 18 |
| LYM236 | 12594.3 | F | 0.46 | 3.51E−01 | 13.6 | LYM183 | 12991.7 | C | 2.456 | 4.75E−02 | 23.1 |
| LYM99 | 12243.1 | F | 0.496 | 3.78E−01 | 22.5 | LYM102 | 12222.1 | C | 3.556 | 5.16E−02 | 78.2 |
| LYM6 | 11735.5 | F | 0.482 | 4.20E−01 | 19.1 | LYM143 | 12524.5 | C | 2.756 | 5.74E−02 | 38.1 |
| LYM178 | 12161.2 | F | 0.465 | 4.22E−01 | 14.9 | LYM102 | 12222.3 | C | 3.769 | 6.05E−02 | 88.9 |
| LYM250 | 12614.2 | F | 0.452 | 4.40E−01 | 11.5 | LYM105 | 12293.1 | C | 2.419 | 6.23E−02 | 21.2 |
| LYM157 | 13341.4 | F | 0.435 | 4.48E−01 | 7.4 | LYM270 | 12871.5 | C | 2.321 | 6.49E−02 | 16.3 |
| LYM175 | 12654.4 | F | 0.472 | 4.48E−01 | 16.5 | LYM153 | 12324.2 | C | 2.313 | 7.05E−02 | 15.9 |
| LYM129 | 12573.5 | F | 0.457 | 4.50E−01 | 12.9 | LYM100 | 12133.1 | C | 3.288 | 7.40E−02 | 64.8 |
| LYM206 | 12603.2 | F | 0.422 | 4.75E−01 | 4.3 | LYM106 | 12142.3 | C | 3.038 | 8.14E−02 | 52.2 |
| LYM128 | 12641.1 | F | 0.424 | 4.85E−01 | 4.7 | LYM152 | 12372.2 | C | 2.605 | 9.07E−02 | 30.6 |
| LYM178 | 12163.3 | F | 0.441 | 4.99E−01 | 8.9 | LYM174 | 12414.2 | C | 3.1 | 9.40E−02 | 55.4 |
| LYM206 | 12601.2 | F | 0.5 | 5.39E−01 | 23.5 | LYM174 | 12412.1 | C | 3.269 | 1.06E−01 | 63.8 |
| LYM88 | 12191.2 | F | 0.446 | 6.11E−01 | 10.2 | LYM106 | 12144.3 | C | 2.813 | 1.07E−01 | 41 |
| LYM159 | 13354.5 | F | 0.416 | 7.19E−01 | 2.8 | LYM270 | 12872.5 | C | 2.375 | 1.14E−01 | 19 |
| LYM129 | 12573.3 | F | 0.418 | 7.51E−01 | 3.1 | LYM138 | 12566.1 | C | 2.838 | 1.14E−01 | 42.2 |
| LYM89 | 12214.3 | F | 0.412 | 8.15E−01 | 1.7 | LYM138 | 12561.3 | C | 2.619 | 1.21E−01 | 31.2 |
| LYM89 | 12214.2 | F | 0.422 | 8.16E−01 | 4.1 | LYM173 | 12981.8 | C | 2.263 | 1.25E−01 | 13.4 |
| LYM283 | 13304.4 | F | 0.42 | 8.23E−01 | 3.8 | LYM289 | 12491.1 | C | 2.9 | 1.26E−01 | 45.3 |
| LYM236 | 12592.4 | F | 0.425 | 8.29E−01 | 5 | LYM143 | 12521.1 | C | 2.613 | 1.32E−01 | 30.9 |
| LYM250 | 12611.3 | F | 0.416 | 8.42E−01 | 2.7 | LYM173 | 12982.6 | C | 2.863 | 1.34E−01 | 43.5 |
| LYM107 | 12631.4 | F | 0.409 | 9.12E−01 | 0.9 | LYM212 | 13032.8 | C | 2.438 | 1.36E−01 | 22.2 |
| LYM90 | 12393.1 | F | 0.411 | 9.45E−01 | 1.4 | LYM138 | 12562.1 | C | 2.569 | 1.40E−01 | 28.7 |
| LYM159 | 13352.4 | F | 0.407 | 9.49E−01 | 0.4 | LYM212 | 13034.9 | C | 2.244 | 1.40E−01 | 12.5 |
| LYM91 | 13284.3 | F | 0.41 | 9.52E−01 | 1.2 | LYM106 | 12142.2 | C | 3.731 | 1.41E−01 | 87 |
| LYM91 | 13283.4 | F | 0.411 | 9.54E−01 | 1.4 | LYM153 | 12324.1 | C | 2.831 | 1.48E−01 | 41.9 |
| CONTROL | — | F | 0.405 | — | 0 | LYM100 | 12131.3 | C | 2.856 | 1.54E−01 | 43.1 |
| LYM6 | 11734.3 | G | 9.53 | 2.63E−01 | 9.9 | LYM107 | 12631.4 | C | 4.221 | 1.57E−01 | 111.6 |
| LYM206 | 12603.3 | G | 9.772 | 3.62E−01 | 12.7 | LYM289 | 12493.2 | C | 2.231 | 1.58E−01 | 11.8 |
| LYM236 | 12591.1 | G | 9.157 | 4.16E−01 | 5.6 | LYM152 | 12371.2 | C | 2.731 | 1.62E−01 | 36.9 |
| LYM99 | 12243.1 | G | 9.096 | 4.92E−01 | 4.9 | LYM220 | 12851.8 | C | 2.8 | 1.62E−01 | 40.3 |
| LYM206 | 12601.2 | G | 9.11 | 5.79E−01 | 5 | LYM220 | 12851.12 | C | 2.244 | 1.69E−01 | 12.5 |
| LYM250 | 12614.2 | G | 8.905 | 6.05E−01 | 2.7 | LYM138 | 12561.1 | C | 3.119 | 1.71E−01 | 56.3 |
| LYM159 | 13354.5 | G | 8.845 | 6.87E−01 | 2 | LYM137 | 12151.2 | C | 2.288 | 1.75E−01 | 14.6 |
| LYM236 | 12592.3 | G | 9.013 | 8.02E−01 | 3.9 | LYM142 | 12802.9 | C | 2.738 | 1.81E−01 | 37.2 |
| LYM175 | 12654.4 | G | 8.974 | 8.11E−01 | 3.5 | LYM111 | 12252.2 | C | 3.175 | 2.04E−01 | 59.1 |
| LYM250 | 12613.4 | G | 8.913 | 8.18E−01 | 2.8 | LYM102 | 12222.6 | C | 4.188 | 2.20E−01 | 109.9 |
| LYM91 | 13284.4 | G | 8.877 | 8.65E−01 | 2.4 | LYM142 | 12801.8 | C | 2.194 | 2.26E−01 | 9.9 |
| LYM206 | 12603.1 | G | 8.75 | 8.71E−01 | 0.9 | LYM105 | 12294.2 | C | 2.725 | 2.36E−01 | 36.6 |
| LYM6 | 11733.2 | G | 8.891 | 8.75E−01 | 2.5 | LYM288 | 12743.9 | C | 2.644 | 2.36E−01 | 32.5 |
| LYM147 | 12584.4 | G | 8.747 | 9.59E−01 | 0.9 | LYM107 | 12633.4 | C | 2.969 | 2.38E−01 | 48.8 |
| LYM175 | 12651.4 | G | 8.748 | 9.72E−01 | 0.9 | LYM111 | 12251.3 | C | 2.938 | 2.59E−01 | 47.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM175 | 12654.6 | G | 8.697 | 9.75E−01 | 0.3 | LYM143 | 12524.7 | C | 2.369 | 2.68E−01 | 18.7 |
| CONTROL | — | G | 8.673 | — | 0 | LYM220 | 12852.4 | C | 2.194 | 2.78E−01 | 9.9 |
| LYM107 | 12631.4 | H | 14.158 | 3.91E−03 | 35.7 | LYM198 | 13002.6 | C | 3.356 | 2.79E−01 | 68.2 |
| LYM147 | 12583.3 | H | 13.534 | 8.52E−03 | 29.7 | LYM208 | 13012.8 | C | 2.65 | 2.79E−01 | 32.8 |
| LYM236 | 12592.3 | H | 13.487 | 9.09E−03 | 29.3 | LYM288 | 12743.8 | C | 2.356 | 2.80E−01 | 18.1 |
| LYM90 | 12395.1 | H | 13.78 | 1.94E−02 | 32.1 | LYM173 | 12982.7 | C | 2.725 | 2.82E−01 | 36.6 |
| LYM129 | 12572.4 | H | 12.866 | 2.83E−02 | 23.3 | LYM289 | 12491.4 | C | 2.775 | 2.83E−01 | 39.1 |
| LYM206 | 12603.1 | H | 13.405 | 4.09E−02 | 28.5 | LYM119 | 12463.2 | C | 2.894 | 2.84E−01 | 45 |
| LYM147 | 12584.4 | H | 12.629 | 4.40E−02 | 21 | LYM90 | 12392.1 | C | 2.475 | 2.89E−01 | 24 |
| LYM88 | 12194.2 | H | 12.515 | 4.87E−02 | 20 | LYM137 | 12153.1 | C | 2.588 | 2.97E−01 | 29.7 |
| LYM6 | 11736.1 | H | 12.391 | 5.69E−02 | 18.8 | LYM288 | 12741.9 | C | 2.319 | 2.97E−01 | 16.2 |
| LYM89 | 12211.4 | H | 12.771 | 6.74E−02 | 22.4 | LYM220 | 12852.2 | C | 2.269 | 3.14E−01 | 13.7 |
| LYM90 | 12395.3 | H | 14.316 | 6.99E−02 | 37.2 | LYM142 | 12803.6 | C | 3.263 | 3.16E−01 | 63.5 |
| LYM73 | 12623.2 | H | 12.201 | 8.98E−02 | 16.9 | LYM287 | 12773.7 | C | 2.469 | 3.34E−01 | 23.7 |
| LYM86 | 12182.3 | H | 12.123 | 9.17E−02 | 16.2 | LYM143 | 12521.2 | C | 2.225 | 3.47E−01 | 11.5 |
| LYM128 | 12641.3 | H | 12.249 | 1.00E−01 | 17.4 | LYM152 | 12371.3 | C | 2.625 | 3.48E−01 | 31.6 |
| LYM206 | 12603.3 | H | 17.874 | 1.01E−01 | 71.3 | LYM212 | 13031.6 | C | 2.469 | 3.77E−01 | 23.7 |
| LYM99 | 12243.2 | H | 12.41 | 1.03E−01 | 18.9 | LYM173 | 12981.6 | C | 2.475 | 3.79E−01 | 24 |
| LYM178 | 12163.4 | H | 12.811 | 1.54E−01 | 22.8 | LYM255 | 13082.7 | C | 2.169 | 3.81E−01 | 8.7 |
| LYM159 | 13354.6 | H | 12.193 | 1.55E−01 | 16.9 | LYM105 | 12295.2 | C | 2.844 | 3.99E−01 | 42.5 |
| LYM236 | 12594.3 | H | 11.884 | 1.59E−01 | 13.9 | LYM137 | 12151.4 | C | 3.006 | 4.08E−01 | 50.7 |
| LYM88 | 12193.1 | H | 14.778 | 1.60E−01 | 41.6 | LYM119 | 12461.2 | C | 2.281 | 4.10E−01 | 14.3 |
| LYM178 | 12164.3 | H | 12.031 | 1.81E−01 | 15.3 | LYM198 | 13002.5 | C | 2.619 | 4.15E−01 | 31.2 |
| LYM250 | 12614.1 | H | 12.094 | 2.04E−01 | 15.9 | LYM111 | 12251.4 | C | 3.275 | 4.15E−01 | 64.1 |
| LYM250 | 12613.4 | H | 16.068 | 2.07E−01 | 54 | LYM138 | 12564.1 | C | 2.263 | 4.26E−01 | 13.4 |
| LYM250 | 12613.2 | H | 11.628 | 2.09E−01 | 11.5 | LYM208 | 13013.6 | C | 2.819 | 4.34E−01 | 41.3 |
| LYM73 | 12623.1 | H | 12.001 | 2.10E−01 | 15 | LYM183 | 12994.8 | C | 2.256 | 4.45E−01 | 13.1 |
| LYM88 | 12191.2 | H | 13.605 | 2.15E−01 | 30.4 | LYM153 | 12321.2 | C | 2.638 | 4.50E−01 | 32.2 |
| LYM99 | 12243.1 | H | 14.765 | 2.34E−01 | 41.5 | LYM143 | 12524.2 | C | 2.519 | 4.55E−01 | 26.2 |
| LYM107 | 12633.4 | H | 15.436 | 2.76E−01 | 47.9 | LYM289 | 12492.2 | C | 2.481 | 4.61E−01 | 24.4 |
| LYM178 | 12163.3 | H | 13.589 | 2.92E−01 | 30.2 | LYM242 | 13051.8 | C | 2.406 | 4.75E−01 | 20.6 |
| LYM6 | 11735.1 | H | 15.004 | 3.12E−01 | 43.8 | LYM183 | 12994.7 | C | 2.431 | 4.77E−01 | 21.8 |
| LYM178 | 12161.2 | H | 12.57 | 3.13E−01 | 20.5 | LYM255 | 13082.5 | C | 2.163 | 4.79E−01 | 8.4 |
| LYM128 | 12642.3 | H | 12.501 | 3.37E−01 | 19.8 | LYM287 | 12771.6 | C | 2.231 | 4.83E−01 | 11.8 |
| LYM129 | 12573.3 | H | 12.931 | 3.61E−01 | 23.9 | LYM173 | 12981.5 | C | 2.331 | 4.84E−01 | 16.8 |
| LYM206 | 12601.2 | H | 17.033 | 3.65E−01 | 63.2 | LYM288 | 12744.6 | C | 2.206 | 4.86E−01 | 10.6 |
| LYM129 | 12573.5 | H | 13.692 | 3.66E−01 | 31.2 | LYM220 | 12851.11 | C | 2.229 | 5.02E−01 | 11.7 |
| LYM89 | 12214.2 | H | 13.553 | 4.00E−01 | 29.9 | LYM291 | 12751.7 | C | 2.206 | 5.06E−01 | 10.6 |
| LYM175 | 12651.2 | H | 11.266 | 4.15E−01 | 8 | LYM255 | 13082.9 | C | 2.394 | 5.08E−01 | 20 |
| LYM6 | 11734.3 | H | 11.461 | 4.19E−01 | 9.8 | LYM220 | 12851.13 | C | 2.175 | 5.17E−01 | 9 |
| LYM90 | 12392.1 | H | 11.166 | 4.25E−01 | 7 | LYM291 | 12753.6 | C | 2.225 | 5.20E−01 | 11.5 |
| LYM236 | 12591.1 | H | 13.166 | 4.56E−01 | 26.2 | LYM44 | 11884.1 | C | 2.15 | 5.32E−01 | 7.8 |
| LYM157 | 13341.4 | H | 11.131 | 4.73E−01 | 6.7 | LYM130 | 12332.2 | C | 2.219 | 5.39E−01 | 11.2 |
| LYM90 | 12393.1 | H | 12.601 | 4.83E−01 | 20.8 | LYM197 | 12824.7 | C | 2.625 | 5.42E−01 | 31.6 |
| LYM89 | 12214.3 | H | 12.181 | 5.09E−01 | 16.7 | LYM119 | 12462.2 | C | 2.925 | 5.45E−01 | 46.6 |
| LYM250 | 12614.2 | H | 11.889 | 5.16E−01 | 14 | LYM242 | 13053.7 | C | 2.094 | 5.53E−01 | 4.9 |
| LYM91 | 13284.5 | H | 11.762 | 5.45E−01 | 12.7 | LYM44 | 11885.4 | C | 2.35 | 5.71E−01 | 17.8 |
| LYM283 | 13304.4 | H | 12.329 | 5.80E−01 | 18.2 | LYM137 | 12154.5 | C | 2.319 | 5.87E−01 | 16.2 |
| LYM86 | 12183.1 | H | 11.569 | 5.87E−01 | 10.9 | LYM130 | 12331.3 | C | 2.5 | 6.12E−01 | 25.3 |
| LYM236 | 12592.4 | H | 12.52 | 5.99E−01 | 20 | LYM142 | 12804.3 | C | 2.156 | 6.19E−01 | 8.1 |
| LYM6 | 11733.2 | H | 11.309 | 6.05E−01 | 8.4 | LYM270 | 12871.7 | C | 2.2 | 6.64E−01 | 10.3 |
| LYM250 | 12611.3 | H | 12.099 | 6.19E−01 | 16 | LYM174 | 12411.3 | C | 2.15 | 6.66E−01 | 7.8 |
| LYM175 | 12654.6 | H | 11.242 | 6.78E−01 | 7.7 | LYM183 | 12993.7 | C | 2.225 | 6.77E−01 | 11.5 |
| LYM175 | 12654.4 | H | 12.126 | 6.86E−01 | 16.2 | LYM138 | 12562.2 | C | 2.181 | 6.86E−01 | 9.3 |
| LYM206 | 12603.2 | H | 10.774 | 7.04E−01 | 3.3 | LYM212 | 13034.8 | C | 2.313 | 6.90E−01 | 15.9 |
| LYM128 | 12641.1 | H | 11.41 | 7.15E−01 | 9.4 | LYM270 | 12872.7 | C | 2.169 | 7.14E−01 | 8.7 |
| LYM91 | 13283.4 | H | 11.798 | 7.22E−01 | 13.1 | LYM130 | 12333.1 | C | 2.294 | 7.33E−01 | 15 |
| LYM147 | 12584.5 | H | 10.733 | 7.53E−01 | 2.9 | LYM153 | 12323.2 | C | 2.188 | 7.44E−01 | 9.6 |
| LYM206 | 12601.3 | H | 10.704 | 7.86E−01 | 2.6 | LYM106 | 12142.1 | C | 2.363 | 7.50E−01 | 18.4 |
| LYM157 | 13342.4 | H | 11.448 | 7.87E−01 | 9.7 | LYM130 | 12334.1 | C | 2.05 | 7.51E−01 | 2.7 |
| LYM147 | 12583.1 | H | 11.545 | 8.28E−01 | 10.7 | LYM198 | 13002.8 | C | 2.213 | 7.61E−01 | 10.9 |
| LYM86 | 12183.3 | H | 10.656 | 8.33E−01 | 2.1 | LYM287 | 12771.7 | C | 2.063 | 8.00E−01 | 3.4 |
| LYM178 | 12164.2 | H | 10.838 | 8.72E−01 | 3.9 | LYM44 | 11882.1 | C | 2.106 | 8.42E−01 | 5.6 |
| LYM91 | 13283.1 | H | 10.514 | 9.28E−01 | 0.8 | LYM198 | 13005.6 | C | 2.063 | 8.64E−01 | 3.4 |
| LYM73 | 12622.2 | H | 10.758 | 9.28E−01 | 3.1 | LYM291 | 12751.2 | C | 2.042 | 8.80E−01 | 2.3 |
| LYM149 | 12344.2 | H | 10.764 | 9.42E−01 | 3.2 | LYM201 | 12833.7 | C | 2.088 | 8.82E−01 | 4.6 |
| CONTROL | — | H | 10.434 | — | 0 | LYM44 | 11884.3 | C | 2.069 | 9.05E−01 | 3.7 |
| LYM206 | 12603.3 | J | 0.042 | 2.32E−03 | 61.6 | LYM44 | 11885.3 | C | 2.013 | 9.12E−01 | 0.9 |
| LYM250 | 12613.4 | J | 0.038 | 1.29E−02 | 47.8 | LYM90 | 12394.2 | C | 2.006 | 9.59E−01 | 0.5 |
| LYM206 | 12601.2 | J | 0.039 | 2.60E−02 | 48.5 | LYM255 | 13082.8 | C | 2 | 9.86E−01 | 0.2 |
| LYM107 | 12633.4 | J | 0.037 | 2.93E−02 | 43.3 | CONTROL | — | C | 1.995 | — | 0 |
| LYM6 | 11735.1 | J | 0.035 | 4.68E−02 | 36.2 | LYM102 | 12222.2 | D | 0.265 | 6.00E−06 | 40 |
| LYM99 | 12243.1 | J | 0.035 | 5.89E−02 | 35.2 | LYM288 | 12743.9 | D | 0.264 | 1.70E−05 | 39.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM88 | 12191.2 | J | 0.035 | 6.27E−02 | 32.8 | LYM173 | 12981.6 | D | 0.248 | 9.60E−05 | 31 |
| LYM129 | 12573.5 | J | 0.035 | 7.06E−02 | 33.1 | LYM138 | 12561.3 | D | 0.31 | 1.04E−04 | 63.6 |
| LYM236 | 12592.3 | J | 0.034 | 7.96E−02 | 30.2 | LYM107 | 12631.4 | D | 0.239 | 1.13E−04 | 26.3 |
| LYM89 | 12214.2 | J | 0.034 | 8.48E−02 | 31.2 | LYM105 | 12297.2 | D | 0.24 | 2.13E−04 | 26.7 |
| LYM90 | 12395.3 | J | 0.033 | 8.93E−02 | 28.3 | LYM130 | 12332.1 | D | 0.283 | 2.74E−03 | 49.6 |
| LYM129 | 12572.4 | J | 0.033 | 1.15E−01 | 27.1 | LYM289 | 12493.1 | D | 0.272 | 3.81E−03 | 43.6 |
| LYM178 | 12163.4 | J | 0.033 | 1.22E−01 | 25.9 | LYM130 | 12334.1 | D | 0.23 | 4.39E−03 | 21.6 |
| LYM147 | 12583.3 | J | 0.033 | 1.28E−01 | 25.3 | LYM102 | 12222.1 | D | 0.228 | 5.99E−03 | 20.7 |
| LYM236 | 12592.4 | J | 0.033 | 1.43E−01 | 28.1 | LYM255 | 13082.8 | D | 0.252 | 6.25E−03 | 33.3 |
| LYM107 | 12631.3 | J | 0.032 | 1.44E−01 | 24.3 | LYM106 | 12144.4 | D | 0.258 | 6.35E−03 | 36.4 |
| LYM89 | 12211.4 | J | 0.032 | 1.56E−01 | 23.7 | LYM107 | 12631.2 | D | 0.216 | 6.37E−03 | 14.2 |
| LYM6 | 11736.1 | J | 0.032 | 1.66E−01 | 24.2 | LYM153 | 12323.2 | D | 0.282 | 7.68E−03 | 49 |
| LYM90 | 12395.1 | J | 0.032 | 1.73E−01 | 22.4 | LYM105 | 12293.1 | D | 0.278 | 1.12E−02 | 47 |
| LYM88 | 12193.1 | J | 0.032 | 1.92E−01 | 21.6 | LYM201 | 12833.7 | D | 0.212 | 1.16E−02 | 12.1 |
| LYM250 | 12611.3 | J | 0.032 | 1.97E−01 | 24.5 | LYM119 | 12461.4 | D | 0.301 | 1.22E−02 | 59 |
| LYM236 | 12591.1 | J | 0.032 | 2.14E−01 | 22.8 | LYM287 | 12771.6 | D | 0.219 | 1.38E−02 | 15.5 |
| LYM99 | 12243.2 | J | 0.031 | 2.28E−01 | 20.1 | LYM105 | 12294.2 | D | 0.248 | 1.47E−02 | 31.1 |
| LYM178 | 12161.2 | J | 0.031 | 2.32E−01 | 20.1 | LYM173 | 12982.6 | D | 0.215 | 1.80E−02 | 13.7 |
| LYM178 | 12163.3 | J | 0.031 | 2.45E−01 | 20 | LYM137 | 12153.1 | D | 0.227 | 2.52E−02 | 19.8 |
| LYM206 | 12603.1 | J | 0.031 | 2.53E−01 | 19 | LYM152 | 12373.1 | D | 0.234 | 2.75E−02 | 23.5 |
| LYM159 | 13354.6 | J | 0.031 | 2.78E−01 | 18.6 | LYM270 | 12873.6 | D | 0.252 | 2.79E−02 | 33.2 |
| LYM129 | 12573.3 | J | 0.031 | 2.87E−01 | 18.4 | LYM138 | 12561.1 | D | 0.399 | 4.37E−02 | 110.9 |
| LYM175 | 12654.4 | J | 0.031 | 2.90E−01 | 19.4 | LYM287 | 12774.6 | D | 0.206 | 4.37E−02 | 8.8 |
| LYM90 | 12392.1 | J | 0.03 | 3.06E−01 | 16.4 | LYM242 | 13052.5 | D | 0.212 | 4.61E−02 | 12.1 |
| LYM91 | 13284.3 | J | 0.031 | 3.18E−01 | 17.4 | LYM137 | 12151.4 | D | 0.27 | 5.04E−02 | 42.4 |
| LYM159 | 13354.5 | J | 0.03 | 3.56E−01 | 15.4 | LYM100 | 12133.3 | D | 0.205 | 5.59E−02 | 8.1 |
| LYM89 | 12214.3 | J | 0.03 | 3.58E−01 | 15.8 | LYM137 | 12151.2 | D | 0.25 | 6.45E−02 | 32.1 |
| LYM250 | 12613.2 | J | 0.03 | 3.76E−01 | 14.5 | LYM289 | 12492.2 | D | 0.246 | 6.50E−02 | 29.9 |
| LYM236 | 12594.3 | J | 0.029 | 4.45E−01 | 12.5 | LYM174 | 12414.3 | D | 0.32 | 7.11E−02 | 69 |
| LYM157 | 13342.4 | J | 0.03 | 4.61E−01 | 14 | LYM153 | 12322.1 | D | 0.218 | 7.32E−02 | 15.3 |
| LYM91 | 13283.1 | J | 0.029 | 4.75E−01 | 13.2 | LYM111 | 12254.4 | D | 0.23 | 7.53E−02 | 21.3 |
| LYM73 | 12623.2 | J | 0.029 | 4.77E−01 | 11.7 | LYM119 | 12463.2 | D | 0.302 | 7.64E−02 | 59.5 |
| LYM175 | 12651.2 | J | 0.029 | 4.79E−01 | 11.9 | LYM106 | 12142.2 | D | 0.307 | 7.80E−02 | 62.1 |
| LYM6 | 11733.2 | J | 0.029 | 4.88E−01 | 11.9 | LYM153 | 12324.2 | D | 0.27 | 7.86E−02 | 42.8 |
| LYM86 | 12182.3 | J | 0.029 | 4.94E−01 | 11 | LYM106 | 12141.4 | D | 0.219 | 7.93E−02 | 15.7 |
| LYM283 | 13304.4 | J | 0.029 | 5.17E−01 | 11.3 | LYM212 | 13032.8 | D | 0.239 | 8.15E−02 | 26.2 |
| LYM90 | 12393.1 | J | 0.029 | 5.43E−01 | 10.3 | LYM119 | 12461.1 | D | 0.308 | 8.59E−02 | 62.9 |
| LYM73 | 12623.1 | J | 0.029 | 5.45E−01 | 9.8 | LYM201 | 12833.9 | D | 0.203 | 8.86E−02 | 7.2 |
| LYM128 | 12642.3 | J | 0.029 | 5.62E−01 | 9.5 | LYM100 | 12131.3 | D | 0.209 | 9.17E−02 | 10.3 |
| LYM73 | 12622.2 | J | 0.029 | 5.64E−01 | 10.5 | LYM288 | 12743.8 | D | 0.236 | 9.25E−02 | 24.6 |
| LYM250 | 12614.2 | J | 0.028 | 5.82E−01 | 9.3 | LYM220 | 12851.8 | D | 0.286 | 9.36E−02 | 51.1 |
| LYM86 | 12183.1 | J | 0.028 | 6.07E−01 | 8.6 | LYM102 | 12222.3 | D | 0.229 | 1.07E−01 | 20.9 |
| LYM86 | 12183.3 | J | 0.028 | 6.17E−01 | 8.1 | LYM105 | 12295.2 | D | 0.269 | 1.09E−01 | 41.9 |
| LYM91 | 13283.1 | J | 0.028 | 6.19E−01 | 8 | LYM174 | 12411.2 | D | 0.276 | 1.10E−01 | 45.9 |
| LYM250 | 12614.1 | J | 0.028 | 6.33E−01 | 7.7 | LYM289 | 12491.1 | D | 0.201 | 1.29E−01 | 6.1 |
| LYM157 | 13341.4 | J | 0.028 | 6.74E−01 | 7.2 | LYM137 | 12151.1 | D | 0.253 | 1.36E−01 | 33.5 |
| LYM178 | 12164.3 | J | 0.028 | 6.96E−01 | 6.2 | LYM138 | 12562.2 | D | 0.246 | 1.48E−01 | 29.8 |
| LYM128 | 12641.1 | J | 0.028 | 6.98E−01 | 6.8 | LYM107 | 12632.3 | D | 0.298 | 1.51E−01 | 57.5 |
| LYM147 | 12584.4 | J | 0.028 | 7.13E−01 | 5.8 | LYM105 | 12294.3 | D | 0.226 | 1.59E−01 | 19.4 |
| LYM175 | 12651.4 | J | 0.028 | 7.62E−01 | 5.8 | LYM119 | 12462.1 | D | 0.278 | 1.80E−01 | 47 |
| LYM159 | 13352.4 | J | 0.027 | 7.80E−01 | 4.6 | LYM153 | 12324.1 | D | 0.283 | 1.89E−01 | 49.3 |
| LYM88 | 12194.2 | J | 0.027 | 7.86E−01 | 4.4 | LYM288 | 12743.5 | D | 0.274 | 1.92E−01 | 44.7 |
| LYM175 | 12654.6 | J | 0.027 | 8.01E−01 | 4.3 | LYM174 | 12412.1 | D | 0.282 | 2.01E−01 | 48.9 |
| LYM147 | 12583.1 | J | 0.027 | 8.50E−01 | 3.7 | LYM212 | 13031.6 | D | 0.211 | 2.07E−01 | 11.6 |
| LYM149 | 12344.2 | J | 0.027 | 8.67E−01 | 3.2 | LYM197 | 12821.6 | D | 0.224 | 2.15E−01 | 18.1 |
| LYM128 | 12641.3 | J | 0.027 | 8.88E−01 | 2.2 | LYM107 | 12631.1 | D | 0.225 | 2.32E−01 | 18.8 |
| LYM88 | 12191.1 | J | 0.027 | 9.00E−01 | 2.1 | LYM90 | 12395.3 | D | 0.23 | 2.34E−01 | 21.4 |
| LYM206 | 12601.3 | J | 0.027 | 9.12E−01 | 1.8 | LYM242 | 13051.8 | D | 0.223 | 2.35E−01 | 17.6 |
| LYM89 | 12214.4 | J | 0.026 | 9.25E−01 | 1.5 | LYM173 | 12981.5 | D | 0.227 | 2.35E−01 | 19.7 |
| LYM147 | 12584.5 | J | 0.026 | 9.58E−01 | 0.9 | LYM130 | 12332.2 | D | 0.246 | 2.46E−01 | 29.8 |
| LYM178 | 12164.2 | J | 0.026 | 9.69E−01 | 0.6 | LYM111 | 12251.1 | D | 0.203 | 2.49E−01 | 7.1 |
| LYM147 | 12581.4 | J | 0.026 | 9.95E−01 | 0.1 | LYM174 | 12411.3 | D | 0.299 | 2.57E−01 | 57.9 |
| CONTROL | — | J | 0.026 | — | 0 | LYM198 | 13005.8 | D | 0.2 | 2.58E−01 | 5.8 |
| LYM157 | 13341.4 | K | 0.697 | 6.89E−02 | 22.1 | LYM119 | 12462.2 | D | 0.25 | 2.82E−01 | 32 |
| LYM88 | 12193.1 | K | 0.617 | 4.88E−01 | 8.1 | LYM153 | 12321.2 | D | 0.235 | 2.89E−01 | 24.2 |
| LYM73 | 12623.2 | K | 0.605 | 6.11E−01 | 6 | LYM111 | 12252.2 | D | 0.239 | 2.92E−01 | 26.1 |
| LYM107 | 12633.4 | K | 0.604 | 6.16E−01 | 5.8 | LYM242 | 13053.7 | D | 0.215 | 3.07E−01 | 13.4 |
| LYM159 | 13354.8 | K | 0.603 | 6.36E−01 | 5.6 | LYM102 | 12221.1 | D | 0.221 | 3.09E−01 | 16.5 |
| LYM90 | 12395.3 | K | 0.6 | 6.64E−01 | 5.1 | LYM255 | 13082.9 | D | 0.22 | 3.26E−01 | 16 |
| LYM175 | 12654.6 | K | 0.6 | 6.86E−01 | 5.2 | LYM255 | 13082.5 | D | 0.28 | 3.38E−01 | 47.9 |
| LYM90 | 12393.2 | K | 0.596 | 7.01E−01 | 4.4 | LYM142 | 12802.9 | D | 0.23 | 3.43E−01 | 21.4 |
| LYM206 | 12603.3 | K | 0.597 | 7.01E−01 | 4.6 | LYM288 | 12741.9 | D | 0.229 | 3.44E−01 | 21.2 |
| LYM250 | 12613.4 | K | 0.595 | 7.13E−01 | 4.2 | LYM106 | 12144.3 | D | 0.24 | 3.50E−01 | 26.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM129 | 12572.4 | K | 0.594 | 7.18E−01 | 4.1 | LYM152 | 12371.2 | D | 0.281 | 3.62E−01 | 48.6 |
| LYM6 | 11734.3 | K | 0.594 | 7.26E−01 | 4.1 | LYM255 | 13082.7 | D | 0.252 | 3.81E−01 | 32.9 |
| LYM157 | 13342.4 | K | 0.594 | 7.43E−01 | 4.1 | LYM106 | 12142.3 | D | 0.208 | 3.88E−01 | 9.9 |
| LYM159 | 13351.1 | K | 0.592 | 7.73E−01 | 3.7 | LYM138 | 12564.1 | D | 0.231 | 4.04E−01 | 22 |
| LYM90 | 12395.1 | K | 0.586 | 8.23E−01 | 2.6 | LYM289 | 12493.2 | D | 0.254 | 4.06E−01 | 34.4 |
| LYM159 | 13354.5 | K | 0.587 | 8.28E−01 | 2.9 | LYM152 | 12371.3 | D | 0.233 | 4.09E−01 | 22.8 |
| LYM90 | 12393.1 | K | 0.586 | 8.34E−01 | 2.6 | LYM107 | 12632.1 | D | 0.218 | 4.39E−01 | 14.9 |
| LYM99 | 12243.1 | K | 0.582 | 8.78E−01 | 1.9 | LYM291 | 12754.9 | D | 0.24 | 4.58E−01 | 26.9 |
| LYM236 | 12591.1 | K | 0.581 | 8.85E−01 | 1.8 | LYM201 | 12834.6 | D | 0.21 | 4.77E−01 | 10.8 |
| LYM99 | 12241.1 | K | 0.578 | 9.22E−01 | 1.2 | LYM102 | 12222.6 | D | 0.215 | 5.01E−01 | 13.5 |
| LYM6 | 11733.2 | K | 0.577 | 9.25E−01 | 1.1 | LYM183 | 12994.8 | D | 0.233 | 5.40E−01 | 23.1 |
| CONTROL | — | K | 0.571 | — | 0 | LYM291 | 12753.6 | D | 0.211 | 5.42E−01 | 11.2 |
| LYM206 | 12603.3 | L | 2.303 | 1.34E−03 | 74.3 | LYM130 | 12331.3 | D | 0.242 | 5.46E−01 | 27.6 |
| LYM250 | 12613.4 | L | 2.054 | 9.93E−03 | 55.4 | LYM287 | 12771.7 | D | 0.2 | 5.49E−01 | 5.6 |
| LYM206 | 12601.2 | L | 2.137 | 1.29E−02 | 61.7 | LYM289 | 12491.4 | D | 0.196 | 5.53E−01 | 3.5 |
| LYM107 | 12633.4 | L | 1.947 | 3.16E−02 | 47.3 | LYM130 | 12333.1 | D | 0.213 | 5.99E−01 | 12.3 |
| LYM6 | 11735.1 | L | 1.898 | 4.09E−02 | 43.6 | LYM143 | 12524.7 | D | 0.231 | 6.05E−01 | 21.8 |
| LYM99 | 12243.1 | L | 1.861 | 4.63E−02 | 40.8 | LYM137 | 12154.5 | D | 0.23 | 6.26E−01 | 21.2 |
| LYM88 | 12193.1 | L | 1.806 | 6.33E−02 | 36.6 | LYM111 | 12251.4 | D | 0.196 | 6.28E−01 | 3.4 |
| LYM90 | 12395.3 | L | 1.794 | 6.59E−02 | 35.8 | LYM183 | 12993.7 | D | 0.205 | 6.65E−01 | 8.1 |
| LYM107 | 12631.4 | L | 1.733 | 1.04E−01 | 31.1 | LYM183 | 12993.5 | D | 0.205 | 6.71E−01 | 8.2 |
| LYM88 | 12191.2 | L | 1.733 | 1.17E−01 | 31.1 | LYM287 | 12773.7 | D | 0.205 | 6.87E−01 | 8.5 |
| LYM129 | 12573.5 | L | 1.749 | 1.18E−01 | 32.3 | LYM270 | 12871.5 | D | 0.22 | 7.04E−01 | 15.9 |
| LYM236 | 12592.3 | L | 1.724 | 1.21E−01 | 30.4 | LYM142 | 12801.8 | D | 0.196 | 7.32E−01 | 3.7 |
| LYM90 | 12395.1 | L | 1.708 | 1.26E−01 | 29.2 | LYM143 | 12524.5 | D | 0.214 | 7.37E−01 | 13.1 |
| LYM147 | 12583.5 | L | 1.696 | 1.38E−01 | 28.3 | LYM270 | 12871.7 | D | 0.197 | 7.40E−01 | 3.8 |
| LYM89 | 12214.2 | L | 1.715 | 1.44E−01 | 29.8 | LYM173 | 12981.8 | D | 0.2 | 7.60E−01 | 5.4 |
| LYM129 | 12572.4 | L | 1.663 | 1.82E−01 | 25.9 | LYM44 | 11885.4 | D | 0.199 | 7.63E−01 | 5.2 |
| LYM178 | 12163.3 | L | 1.667 | 1.88E−01 | 26.2 | LYM208 | 13012.5 | D | 0.209 | 7.67E−01 | 10.3 |
| LYM206 | 12603.1 | L | 1.65 | 1.92E−01 | 24.8 | LYM143 | 12521.1 | D | 0.192 | 7.71E−01 | 1.2 |
| LYM236 | 12591.1 | L | 1.661 | 2.18E−01 | 25.7 | LYM212 | 13034.9 | D | 0.211 | 7.93E−01 | 11.3 |
| LYM89 | 12211.4 | L | 1.61 | 2.51E−01 | 21.8 | LYM173 | 12982.7 | D | 0.205 | 8.10E−01 | 8.3 |
| LYM236 | 12592.4 | L | 1.624 | 2.79E−01 | 22.9 | LYM198 | 13004.6 | D | 0.191 | 8.26E−01 | 1 |
| LYM129 | 12573.3 | L | 1.602 | 2.85E−01 | 21.2 | LYM142 | 12804.3 | D | 0.198 | 8.80E−01 | 4.7 |
| LYM178 | 12163.4 | L | 1.579 | 3.05E−01 | 19.5 | LYM255 | 13081.5 | D | 0.197 | 8.86E−01 | 4.2 |
| LYM6 | 11736.1 | L | 1.579 | 3.15E−01 | 19.5 | LYM197 | 12822.7 | D | 0.196 | 8.90E−01 | 3.2 |
| LYM99 | 12243.2 | L | 1.562 | 3.36E−01 | 18.2 | LYM270 | 12871.8 | D | 0.196 | 9.09E−01 | 3.3 |
| LYM147 | 12584.4 | L | 1.547 | 3.54E−01 | 17.1 | LYM270 | 12872.7 | D | 0.193 | 9.10E−01 | 2 |
| LYM159 | 13354.6 | L | 1.558 | 3.54E−01 | 17.9 | LYM174 | 12414.2 | D | 0.19 | 9.23E−01 | 0.4 |
| LYM178 | 12161.2 | L | 1.556 | 3.55E−01 | 17.7 | LYM111 | 12251.3 | D | 0.19 | 9.75E−01 | 0.3 |
| LYM90 | 12393.1 | L | 1.561 | 3.57E−01 | 18.1 | LYM105 | 12297.1 | D | 0.19 | 9.79E−01 | 0.4 |
| LYM88 | 12194.2 | L | 1.546 | 3.63E−01 | 17 | LYM183 | 12994.7 | D | 0.19 | 9.91E−01 | 0.1 |
| LYM250 | 12611.5 | L | 1.546 | 4.06E−01 | 17 | CONTROL | — | D | 0.189 | — | 0 |
| LYM128 | 12642.3 | L | 1.524 | 4.21E−01 | 15.3 | LYM138 | 12561.1 | E | 9 | 2.20E−03 | 10.8 |
| LYM283 | 13304.4 | L | 1.532 | 4.27E−01 | 15.9 | LYM130 | 12332.1 | E | 8.938 | 3.29E−03 | 10 |
| LYM175 | 12654.4 | L | 1.544 | 4.29E−01 | 16.8 | LYM119 | 12461.4 | E | 9 | 7.75E−03 | 10.8 |
| LYM73 | 12623.2 | L | 1.52 | 4.29E−01 | 15 | LYM130 | 12334.1 | E | 9 | 7.75E−03 | 10.8 |
| LYM250 | 12614.1 | L | 1.516 | 4.32E−01 | 14.7 | LYM153 | 12323.2 | E | 9 | 7.75E−03 | 10.8 |
| LYM89 | 12214.3 | L | 1.523 | 4.32E−01 | 15.2 | LYM174 | 12412.1 | E | 8.625 | 3.12E−02 | 6.2 |
| LYM86 | 12182.3 | L | 1.51 | 4.46E−01 | 14.2 | LYM255 | 13082.8 | E | 8.75 | 3.12E−02 | 7.7 |
| LYM73 | 12623.1 | L | 1.498 | 4.75E−01 | 13.3 | LYM255 | 13082.7 | E | 8.563 | 5.65E−02 | 5.4 |
| LYM178 | 12164.3 | L | 1.489 | 4.93E−01 | 12.7 | LYM130 | 12332.2 | E | 9 | 9.08E−02 | 10.8 |
| LYM250 | 12614.2 | L | 1.499 | 4.94E−01 | 13.4 | LYM119 | 12461.1 | E | 8.688 | 1.11E−01 | 6.9 |
| LYM236 | 12594.3 | L | 1.49 | 5.02E−01 | 12.7 | LYM220 | 12851.8 | E | 8.875 | 1.21E−01 | 9.2 |
| LYM91 | 13284.3 | L | 1.492 | 5.06E−01 | 12.9 | LYM153 | 12324.1 | E | 9.063 | 1.37E−01 | 11.5 |
| LYM91 | 13283.4 | L | 1.495 | 5.25E−01 | 13.1 | LYM174 | 12414.3 | E | 9.063 | 1.37E−01 | 11.5 |
| LYM128 | 12641.3 | L | 1.468 | 5.48E−01 | 11.1 | LYM106 | 12141.4 | E | 8.5 | 1.45E−01 | 4.6 |
| LYM6 | 11733.2 | L | 1.459 | 5.91E−01 | 10.4 | LYM287 | 12771.6 | E | 8.5 | 1.45E−01 | 4.6 |
| LYM250 | 12613.2 | L | 1.454 | 5.93E−01 | 10 | LYM105 | 12297.2 | E | 8.75 | 1.65E−01 | 7.7 |
| LYM175 | 12651.2 | L | 1.452 | 6.05E−01 | 9.9 | LYM107 | 12631.4 | E | 8.545 | 1.71E−01 | 5.2 |
| LYM175 | 12654.6 | L | 1.452 | 6.13E−01 | 9.9 | LYM105 | 12295.2 | E | 8.563 | 1.84E−01 | 5.4 |
| LYM157 | 13342.4 | L | 1.454 | 6.29E−01 | 10 | LYM107 | 12631.2 | E | 8.563 | 1.84E−01 | 5.4 |
| LYM128 | 12641.1 | L | 1.446 | 6.33E−01 | 9.4 | LYM111 | 12252.2 | E | 8.563 | 1.84E−01 | 5.4 |
| LYM86 | 12183.1 | L | 1.432 | 6.61E−01 | 8.4 | LYM143 | 12524.7 | E | 8.375 | 2.21E−01 | 3.1 |
| LYM157 | 13341.4 | L | 1.432 | 6.63E−01 | 8.3 | LYM289 | 12493.2 | E | 8.875 | 2.51E−01 | 9.2 |
| LYM147 | 12583.1 | L | 1.431 | 7.05E−01 | 8.2 | LYM137 | 12153.1 | E | 8.688 | 2.75E−01 | 6.9 |
| LYM90 | 12392.1 | L | 1.406 | 7.24E−01 | 6.4 | LYM152 | 12371.2 | E | 8.375 | 3.07E−01 | 3.1 |
| LYM6 | 11734.3 | L | 1.405 | 7.36E−01 | 6.3 | LYM289 | 12491.1 | E | 8.375 | 3.07E−01 | 3.1 |
| LYM73 | 12622.2 | L | 1.402 | 7.68E−01 | 6.1 | LYM138 | 12562.2 | E | 8.438 | 3.12E−01 | 3.8 |
| LYM206 | 12603.2 | L | 1.361 | 8.74E−01 | 3 | LYM291 | 12754.9 | E | 8.438 | 3.12E−01 | 3.8 |
| LYM91 | 13283.1 | L | 1.343 | 9.30E−01 | 1.6 | LYM119 | 12462.1 | E | 8.813 | 3.33E−01 | 8.5 |
| LYM149 | 12344.2 | L | 1.342 | 9.41E−01 | 1.6 | LYM102 | 12222.6 | E | 8.5 | 3.37E−01 | 4.6 |
| LYM178 | 12164.2 | L | 1.337 | 9.51E−01 | 1.2 | LYM174 | 12411.3 | E | 8.5 | 3.37E−01 | 4.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM86 | 12183.3 | L | 1.33 | 9.73E−01 | 0.6 | LYM288 | 12741.9 | E | 8.875 | 3.53E−01 | 9.2 |
| LYM159 | 13352.4 | L | 1.33 | 9.74E−01 | 0.6 | LYM111 | 12254.4 | E | 8.313 | 3.67E−01 | 2.3 |
| CONTROL | — | L | 1.322 | — | 0 | LYM119 | 12462.2 | E | 8.813 | 4.24E−01 | 8.5 |
| LYM206 | 12603.3 | M | 0.288 | 1.32E−03 | 69.7 | LYM137 | 12154.5 | E | 8.625 | 4.90E−01 | 6.2 |
| LYM250 | 12613.4 | M | 0.257 | 1.04E−02 | 51.3 | LYM137 | 12151.2 | E | 8.688 | 4.92E−01 | 6.9 |
| LYM206 | 12601.2 | M | 0.267 | 1.40E−02 | 57.5 | LYM138 | 12561.3 | E | 8.813 | 4.94E−01 | 8.5 |
| LYM107 | 12633.4 | M | 0.243 | 3.48E−02 | 43.4 | LYM174 | 12411.2 | E | 8.313 | 5.23E−01 | 2.3 |
| LYM6 | 11735.1 | M | 0.237 | 4.53E−02 | 39.8 | LYM288 | 12743.9 | E | 8.313 | 5.23E−01 | 2.3 |
| LYM99 | 12243.1 | M | 0.233 | 5.12E−02 | 37.1 | LYM119 | 12463.2 | E | 8.563 | 5.75E−01 | 5.4 |
| LYM88 | 12193.1 | M | 0.226 | 7.05E−02 | 33.1 | LYM289 | 12493.1 | E | 8.563 | 5.75E−01 | 5.4 |
| LYM90 | 12395.3 | M | 0.224 | 7.35E−02 | 32.2 | LYM106 | 12144.4 | E | 8.5 | 5.87E−01 | 4.6 |
| LYM107 | 12631.4 | M | 0.217 | 1.17E−01 | 27.7 | LYM102 | 12222.3 | E | 8.25 | 5.97E−01 | 1.5 |
| LYM88 | 12191.2 | M | 0.217 | 1.33E−01 | 27.6 | LYM242 | 13051.8 | E | 8.25 | 5.97E−01 | 1.5 |
| LYM129 | 12573.5 | M | 0.219 | 1.34E−01 | 28.8 | LYM137 | 12151.1 | E | 8.625 | 6.24E−01 | 6.2 |
| LYM236 | 12592.3 | M | 0.215 | 1.38E−01 | 27 | LYM130 | 12331.3 | E | 8.375 | 7.06E−01 | 3.1 |
| LYM90 | 12395.1 | M | 0.214 | 1.44E−01 | 25.9 | LYM242 | 13052.5 | E | 8.25 | 7.22E−01 | 1.5 |
| LYM147 | 12583.3 | M | 0.212 | 1.57E−01 | 24.9 | LYM289 | 12491.4 | E | 8.25 | 7.22E−01 | 1.5 |
| LYM89 | 12214.2 | M | 0.214 | 1.65E−01 | 26.3 | LYM44 | 11885.4 | E | 8.25 | 7.22E−01 | 1.5 |
| LYM178 | 12163.4 | M | 0.21 | 1.72E−01 | 24 | LYM106 | 12144.3 | E | 8.375 | 7.96E−01 | 3.1 |
| LYM129 | 12572.4 | M | 0.208 | 2.08E−01 | 22.6 | LYM106 | 12142.2 | E | 8.25 | 8.01E−01 | 1.5 |
| LYM178 | 12163.3 | M | 0.208 | 2.16E−01 | 22.8 | LYM138 | 12564.1 | E | 8.25 | 8.01E−01 | 1.5 |
| LYM206 | 12603.1 | M | 0.206 | 2.21E−01 | 21.5 | LYM183 | 12993.7 | E | 8.25 | 8.01E−01 | 1.5 |
| LYM236 | 12591.1 | M | 0.208 | 2.50E−01 | 22.4 | LYM255 | 13082.5 | E | 8.25 | 8.01E−01 | 1.5 |
| LYM89 | 12211.4 | M | 0.201 | 2.90E−01 | 18.6 | LYM288 | 12743.8 | E | 8.25 | 8.01E−01 | 1.5 |
| LYM175 | 12654.4 | M | 0.203 | 3.08E−01 | 19.7 | LYM102 | 12222.2 | E | 8.188 | 8.26E−01 | 0.8 |
| LYM236 | 12592.4 | M | 0.203 | 3.19E−01 | 19.7 | LYM270 | 12873.6 | E | 8.188 | 8.26E−01 | 0.8 |
| LYM129 | 12573.3 | M | 0.2 | 3.27E−01 | 18 | LYM288 | 12743.5 | E | 8.313 | 8.56E−01 | 2.3 |
| LYM6 | 11736.1 | M | 0.197 | 3.63E−01 | 16.4 | LYM143 | 12524.5 | E | 8.25 | 8.96E−01 | 1.5 |
| LYM99 | 12243.2 | M | 0.195 | 3.88E−01 | 15.1 | LYM288 | 12744.6 | E | 8.188 | 9.43E−01 | 0.8 |
| LYM159 | 13354.6 | M | 0.195 | 4.08E−01 | 14.8 | CONTROL | — | E | 8.125 | — | 0 |
| LYM147 | 12584.4 | M | 0.193 | 4.09E−01 | 14 | LYM138 | 12561.3 | F | 0.52 | 2.90E−05 | 66 |
| LYM178 | 12161.2 | M | 0.194 | 4.10E−01 | 14.6 | LYM289 | 12493.1 | F | 0.53 | 4.10E−05 | 69.3 |
| LYM90 | 12393.1 | M | 0.195 | 4.11E−01 | 15 | LYM153 | 12323.2 | F | 0.486 | 1.01E−04 | 55.1 |
| LYM88 | 12194.2 | M | 0.193 | 4.20E−01 | 13.9 | LYM255 | 13082.8 | F | 0.465 | 2.39E−04 | 48.5 |
| LYM250 | 12611.3 | M | 0.193 | 4.65E−01 | 13.9 | LYM119 | 12463.2 | F | 0.468 | 2.41E−04 | 49.5 |
| LYM128 | 12642.3 | M | 0.19 | 4.85E−01 | 12.3 | LYM137 | 12151.1 | F | 0.46 | 2.99E−04 | 46.9 |
| LYM283 | 13304.4 | M | 0.192 | 4.90E−01 | 12.9 | LYM107 | 12631.4 | F | 0.458 | 3.34E−04 | 46.1 |
| LYM73 | 12623.2 | M | 0.19 | 4.95E−01 | 12 | LYM153 | 12324.2 | F | 0.455 | 3.98E−04 | 45.1 |
| LYM89 | 12214.3 | M | 0.19 | 4.97E−01 | 12.2 | LYM137 | 12151.4 | F | 0.483 | 5.10E−04 | 54.3 |
| LYM250 | 12614.1 | M | 0.189 | 4.99E−01 | 11.7 | LYM105 | 12293.1 | F | 0.448 | 5.60E−04 | 42.9 |
| LYM86 | 12182.3 | M | 0.189 | 5.15E−01 | 11.2 | LYM119 | 12462.1 | F | 0.474 | 1.01E−03 | 51.2 |
| LYM73 | 12623.1 | M | 0.187 | 5.48E−01 | 10.4 | LYM102 | 12222.3 | F | 0.432 | 1.14E−03 | 38 |
| LYM250 | 12614.2 | M | 0.187 | 5.67E−01 | 10.4 | LYM105 | 12297.2 | F | 0.429 | 1.36E−03 | 37 |
| LYM178 | 12164.3 | M | 0.186 | 5.69E−01 | 9.7 | LYM102 | 12221.1 | F | 0.424 | 1.85E−03 | 35.5 |
| LYM236 | 12594.3 | M | 0.186 | 5.78E−01 | 9.8 | LYM288 | 12743.9 | F | 0.434 | 1.86E−03 | 38.6 |
| LYM91 | 13284.3 | M | 0.187 | 5.80E−01 | 10 | LYM138 | 12562.2 | F | 0.407 | 4.58E−03 | 29.8 |
| LYM91 | 13283.4 | M | 0.187 | 5.98E−01 | 10.1 | LYM153 | 12321.2 | F | 0.4 | 6.82E−03 | 27.8 |
| LYM128 | 12641.3 | M | 0.184 | 6.31E−01 | 8.2 | LYM102 | 12222.2 | F | 0.421 | 7.13E−03 | 34.3 |
| LYM6 | 11733.2 | M | 0.182 | 6.76E−01 | 7.5 | LYM107 | 12631.1 | F | 0.398 | 9.15E−03 | 27.1 |
| LYM250 | 12613.2 | M | 0.182 | 6.80E−01 | 7.1 | LYM119 | 12461.1 | F | 0.454 | 9.42E−03 | 44.9 |
| LYM175 | 12651.2 | M | 0.181 | 6.92E−01 | 7 | LYM174 | 12412.1 | F | 0.52 | 1.39E−02 | 66 |
| LYM175 | 12654.6 | M | 0.181 | 7.00E−01 | 7 | LYM130 | 12332.2 | F | 0.401 | 1.60E−02 | 27.9 |
| LYM157 | 13342.4 | M | 0.182 | 7.13E−01 | 7.1 | LYM100 | 12133.3 | F | 0.382 | 2.01E−02 | 21.9 |
| LYM128 | 12641.1 | M | 0.181 | 7.21E−01 | 6.5 | LYM137 | 12153.1 | F | 0.397 | 2.03E−02 | 26.8 |
| LYM86 | 12183.1 | M | 0.179 | 7.55E−01 | 5.5 | LYM173 | 12982.6 | F | 0.398 | 2.07E−02 | 26.9 |
| LYM157 | 13341.4 | M | 0.179 | 7.57E−01 | 5.5 | LYM102 | 12222.1 | F | 0.381 | 2.15E−02 | 21.6 |
| LYM159 | 13354.5 | M | 0.178 | 7.87E−01 | 4.8 | LYM288 | 12743.5 | F | 0.483 | 2.36E−02 | 54.1 |
| LYM147 | 12583.1 | M | 0.179 | 7.91E−01 | 5.4 | LYM242 | 13051.8 | F | 0.389 | 2.77E−02 | 24.2 |
| LYM90 | 12392.1 | M | 0.176 | 8.29E−01 | 3.6 | LYM174 | 12414.2 | F | 0.374 | 3.39E−02 | 19.4 |
| LYM6 | 11734.3 | M | 0.176 | 8.39E−01 | 3.5 | LYM143 | 12521.1 | F | 0.395 | 3.46E−02 | 26 |
| LYM73 | 12622.2 | M | 0.175 | 8.64E−01 | 3.3 | LYM287 | 12771.6 | F | 0.374 | 3.57E−02 | 19.3 |
| LYM206 | 12603.2 | M | 0.17 | 9.89E−01 | 0.2 | LYM105 | 12295.2 | F | 0.409 | 3.81E−02 | 30.5 |
| CONTROL | — | M | 0.17 | — | 0 | LYM198 | 13005.8 | F | 0.392 | 4.29E−02 | 25.3 |
| LYM206 | 12603.3 | N | 0.249 | 2.57E−02 | 31.4 | LYM106 | 12142.3 | F | 0.369 | 4.67E−02 | 17.7 |
| LYM250 | 12613.4 | N | 0.24 | 5.39E−02 | 27 | LYM212 | 13031.6 | F | 0.403 | 5.15E−02 | 28.7 |
| LYM107 | 12633.4 | N | 0.239 | 8.02E−02 | 26.2 | LYM130 | 12334.1 | F | 0.401 | 5.54E−02 | 28.1 |
| LYM88 | 12191.2 | N | 0.231 | 1.01E−01 | 22.1 | LYM130 | 12332.1 | F | 0.481 | 5.69E−02 | 53.6 |
| LYM6 | 11735.1 | N | 0.23 | 1.18E−01 | 21.4 | LYM289 | 12493.2 | F | 0.411 | 5.77E−02 | 31.1 |
| LYM206 | 12601.2 | N | 0.236 | 1.28E−01 | 24.9 | LYM107 | 12632.1 | F | 0.388 | 6.16E−02 | 23.7 |
| LYM236 | 12592.3 | N | 0.225 | 1.46E−01 | 19.1 | LYM44 | 11882.1 | F | 0.365 | 6.29E−02 | 16.4 |
| LYM236 | 12592.4 | N | 0.228 | 1.67E−01 | 20.7 | LYM197 | 12821.6 | F | 0.432 | 7.71E−02 | 37.7 |
| LYM129 | 12573.5 | N | 0.222 | 2.12E−01 | 17.1 | LYM138 | 12561.1 | F | 0.557 | 7.77E−02 | 77.9 |
| LYM99 | 12243.1 | N | 0.221 | 2.18E−01 | 16.8 | LYM201 | 12834.6 | F | 0.39 | 7.85E−02 | 24.4 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM250 | 12611.3 | N | 0.222 | 2.41E−01 | 17.3 | LYM173 | 12981.8 | F | 0.375 | 8.92E−02 | 19.8 |
| LYM159 | 13354.5 | N | 0.218 | 2.47E−01 | 15.2 | LYM111 | 12254.4 | F | 0.375 | 9.07E−02 | 19.8 |
| LYM157 | 13341.4 | N | 0.216 | 2.84E−01 | 14.2 | LYM174 | 12411.2 | F | 0.4 | 9.19E−02 | 27.8 |
| LYM91 | 13284.3 | N | 0.218 | 2.91E−01 | 15.2 | LYM174 | 12414.3 | F | 0.483 | 9.49E−02 | 54.1 |
| LYM89 | 12211.4 | N | 0.211 | 3.54E−01 | 11.7 | LYM100 | 12131.3 | F | 0.459 | 9.57E−02 | 46.4 |
| LYM129 | 12572.4 | N | 0.211 | 3.67E−01 | 11.3 | LYM242 | 13052.5 | F | 0.357 | 9.97E−02 | 14 |
| LYM159 | 13354.6 | N | 0.21 | 3.95E−01 | 11 | LYM107 | 12632.3 | F | 0.491 | 1.05E−01 | 56.9 |
| LYM90 | 12395.3 | N | 0.209 | 4.04E−01 | 10.4 | LYM111 | 12251.4 | F | 0.356 | 1.07E−01 | 13.6 |
| LYM178 | 12161.2 | N | 0.21 | 4.14E−01 | 10.9 | LYM111 | 12252.2 | F | 0.483 | 1.09E−01 | 54.1 |
| LYM73 | 12623.2 | N | 0.209 | 4.32E−01 | 10.2 | LYM106 | 12141.4 | F | 0.416 | 1.12E−01 | 32.8 |
| LYM236 | 12591.1 | N | 0.211 | 4.35E−01 | 11.3 | LYM173 | 12981.6 | F | 0.387 | 1.14E−01 | 23.6 |
| LYM206 | 12603.1 | N | 0.209 | 4.38E−01 | 10.3 | LYM105 | 12294.3 | F | 0.356 | 1.20E−01 | 13.5 |
| LYM178 | 12163.4 | N | 0.208 | 4.45E−01 | 9.8 | LYM119 | 12461.4 | F | 0.539 | 1.23E−01 | 71.9 |
| LYM6 | 11736.1 | N | 0.208 | 4.50E−01 | 9.8 | LYM152 | 12373.1 | F | 0.398 | 1.26E−01 | 27.1 |
| LYM99 | 12243.2 | N | 0.207 | 4.52E−01 | 9.6 | LYM255 | 13082.9 | F | 0.413 | 1.28E−01 | 31.9 |
| LYM89 | 12214.2 | N | 0.208 | 4.71E−01 | 10.1 | LYM107 | 12633.4 | F | 0.364 | 1.38E−01 | 16.1 |
| LYM236 | 12594.3 | N | 0.206 | 5.03E−01 | 8.7 | LYM287 | 12774.6 | F | 0.372 | 1.44E−01 | 18.9 |
| LYM88 | 12193.1 | N | 0.206 | 5.05E−01 | 8.7 | LYM255 | 13082.7 | F | 0.524 | 1.53E−01 | 67.3 |
| LYM178 | 12163.3 | N | 0.206 | 5.07E−01 | 8.9 | LYM289 | 12491.4 | F | 0.372 | 1.56E−01 | 18.7 |
| LYM175 | 12654.4 | N | 0.206 | 5.32E−01 | 9 | LYM242 | 13054.9 | F | 0.35 | 1.59E−01 | 11.6 |
| LYM175 | 12651.2 | N | 0.205 | 5.44E−01 | 8.2 | LYM153 | 12322.1 | F | 0.437 | 1.73E−01 | 39.4 |
| LYM73 | 12622.2 | N | 0.207 | 5.48E−01 | 9.2 | LYM106 | 12144.4 | F | 0.419 | 1.77E−01 | 33.6 |
| LYM90 | 12392.1 | N | 0.203 | 5.60E−01 | 7.2 | LYM106 | 12144.3 | F | 0.417 | 1.79E−01 | 33.2 |
| LYM129 | 12573.3 | N | 0.204 | 5.70E−01 | 7.8 | LYM105 | 12294.2 | F | 0.394 | 1.86E−01 | 25.9 |
| LYM250 | 12614.2 | N | 0.203 | 5.87E−01 | 7.2 | LYM143 | 12524.2 | F | 0.363 | 2.01E−01 | 15.8 |
| LYM147 | 12583.3 | N | 0.202 | 5.92E−01 | 6.9 | LYM119 | 12462.2 | F | 0.497 | 2.05E−01 | 58.5 |
| LYM91 | 13283.4 | N | 0.204 | 5.95E−01 | 7.7 | LYM152 | 12371.2 | F | 0.448 | 2.08E−01 | 42.9 |
| LYM90 | 12395.1 | N | 0.202 | 6.07E−01 | 6.6 | LYM153 | 12324.1 | F | 0.496 | 2.14E−01 | 58.4 |
| LYM6 | 11733.2 | N | 0.201 | 6.29E−01 | 6.3 | LYM137 | 12151.2 | F | 0.429 | 2.24E−01 | 36.8 |
| LYM250 | 12613.2 | N | 0.201 | 6.31E−01 | 6.1 | LYM201 | 12833.9 | F | 0.356 | 2.26E−01 | 13.5 |
| LYM159 | 13352.4 | N | 0.201 | 6.42E−01 | 6.1 | LYM137 | 12154.5 | F | 0.459 | 2.29E−01 | 44.6 |
| LYM157 | 13342.4 | N | 0.202 | 6.50E−01 | 6.9 | LYM270 | 12872.7 | F | 0.342 | 2.46E−01 | 9.3 |
| LYM6 | 11734.3 | N | 0.2 | 6.63E−01 | 5.5 | LYM174 | 12411.3 | F | 0.484 | 2.50E−01 | 54.5 |
| LYM175 | 12651.4 | N | 0.198 | 7.57E−01 | 4.9 | LYM242 | 13053.7 | F | 0.351 | 2.53E−01 | 12 |
| LYM107 | 12631.4 | N | 0.196 | 7.70E−01 | 3.7 | LYM270 | 12873.6 | F | 0.44 | 2.56E−01 | 40.5 |
| LYM89 | 12214.3 | N | 0.193 | 8.96E−01 | 1.7 | LYM138 | 12564.1 | F | 0.455 | 2.60E−01 | 45.3 |
| LYM283 | 13304.4 | N | 0.192 | 9.03E−01 | 1.7 | LYM270 | 12872.5 | F | 0.341 | 2.66E−01 | 8.9 |
| LYM88 | 12194.2 | N | 0.191 | 9.26E−01 | 1.2 | LYM111 | 12251.3 | F | 0.355 | 2.73E−01 | 13.4 |
| LYM90 | 12393.1 | N | 0.192 | 9.27E−01 | 1.2 | LYM102 | 12222.1 | F | 0.388 | 2.84E−01 | 23.7 |
| LYM73 | 12623.1 | N | 0.191 | 9.45E−01 | 0.9 | LYM255 | 13082.5 | F | 0.466 | 2.88E−01 | 48.6 |
| LYM175 | 12654.6 | N | 0.191 | 9.48E−01 | 0.9 | LYM100 | 12134.1 | F | 0.349 | 3.08E−01 | 11.4 |
| LYM256 | 13323.3 | N | 0.19 | 9.77E−01 | 0.4 | LYM143 | 12524.7 | F | 0.438 | 3.10E−01 | 39.9 |
| LYM128 | 12641.1 | N | 0.19 | 9.78E−01 | 0.4 | LYM152 | 12371.3 | F | 0.365 | 3.10E−01 | 16.5 |
| CONTROL | — | N | 0.189 | — | 0 | LYM291 | 12753.6 | F | 0.338 | 3.10E−01 | 8 |
| LYM107 | 12631.4 | O | 1.77 | 3.57E−03 | 32.1 | LYM183 | 12994.8 | F | 0.422 | 3.14E−01 | 34.8 |
| LYM178 | 12163.4 | O | 1.708 | 5.93E−03 | 27.5 | LYM44 | 11885.4 | F | 0.339 | 3.19E−01 | 8.1 |
| LYM147 | 12583.3 | O | 1.692 | 7.49E−03 | 26.3 | LYM220 | 12851.8 | F | 0.468 | 3.32E−01 | 49.4 |
| LYM236 | 12592.3 | O | 1.686 | 7.99E−03 | 25.9 | LYM142 | 12804.1 | F | 0.408 | 3.37E−01 | 30.4 |
| LYM90 | 12395.1 | O | 1.723 | 2.51E−02 | 28.6 | LYM288 | 12741.9 | F | 0.442 | 3.47E−01 | 41 |
| LYM129 | 12572.4 | O | 1.608 | 3.01E−02 | 20.1 | LYM107 | 12631.2 | F | 0.377 | 3.60E−01 | 20.3 |
| LYM147 | 12584.4 | O | 1.579 | 4.98E−02 | 17.9 | LYM130 | 12331.3 | F | 0.438 | 3.65E−01 | 39.9 |
| LYM206 | 12603.1 | O | 1.676 | 5.34E−02 | 25.1 | LYM197 | 12821.11 | F | 0.351 | 3.71E−01 | 12.1 |
| LYM88 | 12194.2 | O | 1.564 | 5.43E−02 | 16.8 | LYM183 | 12994.7 | F | 0.388 | 3.71E−01 | 23.9 |
| LYM6 | 11736.1 | O | 1.549 | 6.34E−02 | 15.6 | LYM90 | 12395.3 | F | 0.433 | 3.94E−01 | 38.2 |
| LYM89 | 12211.4 | O | 1.596 | 8.59E−02 | 19.2 | LYM255 | 13081.5 | F | 0.38 | 3.98E−01 | 21.4 |
| LYM90 | 12395.3 | O | 1.789 | 8.97E−02 | 33.6 | LYM287 | 12771.7 | F | 0.349 | 4.04E−01 | 11.3 |
| LYM86 | 12182.3 | O | 1.515 | 1.09E−01 | 13.1 | LYM288 | 12744.6 | F | 0.399 | 4.10E−01 | 27.3 |
| LYM73 | 12623.2 | O | 1.525 | 1.09E−01 | 13.9 | LYM143 | 12524.5 | F | 0.395 | 4.19E−01 | 26 |
| LYM206 | 12603.3 | O | 2.234 | 1.15E−01 | 66.8 | LYM289 | 12491.1 | F | 0.333 | 4.32E−01 | 6.2 |
| LYM128 | 12641.3 | O | 1.531 | 1.26E−01 | 14.3 | LYM173 | 12981.5 | F | 0.398 | 4.35E−01 | 27.1 |
| LYM99 | 12243.2 | O | 1.551 | 1.32E−01 | 15.8 | LYM106 | 12142.2 | F | 0.413 | 4.38E−01 | 31.7 |
| LYM88 | 12193.1 | O | 1.847 | 1.84E−01 | 37.9 | LYM137 | 12152.1 | F | 0.391 | 4.50E−01 | 24.8 |
| LYM159 | 13354.6 | O | 1.524 | 1.99E−01 | 13.8 | LYM143 | 12521.2 | F | 0.346 | 4.92E−01 | 10.4 |
| LYM236 | 12594.3 | O | 1.486 | 2.04E−01 | 10.9 | LYM198 | 13004.6 | F | 0.339 | 5.17E−01 | 8.1 |
| LYM250 | 12613.4 | O | 2.009 | 2.25E−01 | 49.9 | LYM270 | 12871.8 | F | 0.36 | 5.27E−01 | 15 |
| LYM178 | 12164.3 | O | 1.504 | 2.35E−01 | 12.3 | LYM152 | 12372.2 | F | 0.364 | 5.34E−01 | 16.1 |
| LYM88 | 12191.2 | O | 1.701 | 2.49E−01 | 27 | LYM208 | 13012.5 | F | 0.399 | 5.44E−01 | 27.4 |
| LYM99 | 12243.1 | O | 1.846 | 2.59E−01 | 37.8 | LYM208 | 13013.6 | F | 0.353 | 5.52E−01 | 12.6 |
| LYM250 | 12614.1 | O | 1.512 | 2.61E−01 | 12.9 | LYM130 | 12333.1 | F | 0.372 | 5.61E−01 | 18.7 |
| LYM73 | 12623.1 | O | 1.5 | 2.71E−01 | 12 | LYM142 | 12801.8 | F | 0.327 | 5.89E−01 | 4.3 |
| LYM250 | 12613.2 | O | 1.454 | 2.72E−01 | 8.5 | LYM291 | 12751.2 | F | 0.336 | 5.96E−01 | 7.2 |
| LYM107 | 12633.4 | O | 1.93 | 2.97E−01 | 44.1 | LYM242 | 13051.9 | F | 0.361 | 5.96E−01 | 15.1 |
| LYM178 | 12163.3 | O | 1.699 | 3.27E−01 | 26.8 | LYM212 | 13032.8 | F | 0.338 | 6.12E−01 | 7.9 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM6 | 11735.1 | O | 1.875 | 3.35E−01 | 40 | LYM289 | 12492.2 | F | 0.332 | 6.33E−01 | 5.8 |
| LYM178 | 12161.2 | O | 1.571 | 3.67E−01 | 17.3 | LYM270 | 12871.5 | F | 0.368 | 6.53E−01 | 17.3 |
| LYM206 | 12601.2 | O | 2.129 | 3.80E−01 | 58.9 | LYM183 | 12993.7 | F | 0.357 | 6.81E−01 | 13.9 |
| LYM128 | 12642.3 | O | 1.563 | 3.92E−01 | 16.7 | LYM100 | 12133.1 | F | 0.343 | 6.89E−01 | 9.6 |
| LYM129 | 12573.5 | O | 1.711 | 3.99E−01 | 27.8 | LYM111 | 12251.1 | F | 0.33 | 6.90E−01 | 5.5 |
| LYM129 | 12573.3 | O | 1.616 | 4.06E−01 | 20.7 | LYM288 | 12743.8 | F | 0.363 | 7.05E−01 | 15.8 |
| LYM89 | 12214.2 | O | 1.694 | 4.34E−01 | 26.5 | LYM61 | 13174.7 | F | 0.336 | 7.42E−01 | 7.2 |
| LYM236 | 12591.1 | O | 1.646 | 4.95E−01 | 22.9 | LYM291 | 12754.9 | F | 0.35 | 7.44E−01 | 11.8 |
| LYM6 | 11734.3 | O | 1.433 | 5.31E−01 | 7 | LYM138 | 12566.1 | F | 0.352 | 7.57E−01 | 12.5 |
| LYM90 | 12393.1 | O | 1.575 | 5.32E−01 | 17.6 | LYM197 | 12824.7 | F | 0.332 | 7.58E−01 | 5.8 |
| LYM175 | 12651.2 | O | 1.408 | 5.50E−01 | 5.1 | LYM212 | 13034.9 | F | 0.338 | 7.64E−01 | 7.9 |
| LYM175 | 12654.4 | O | 1.596 | 5.60E−01 | 19.1 | LYM287 | 12773.7 | F | 0.337 | 7.64E−01 | 7.6 |
| LYM89 | 12214.3 | O | 1.523 | 5.70E−01 | 13.7 | LYM198 | 13002.6 | F | 0.328 | 7.83E−01 | 4.8 |
| LYM90 | 12392.1 | O | 1.396 | 5.76E−01 | 4.2 | LYM198 | 13002.5 | F | 0.337 | 8.11E−01 | 7.5 |
| LYM250 | 12614.2 | O | 1.486 | 5.89E−01 | 11 | LYM102 | 12221.2 | F | 0.32 | 8.28E−01 | 2.3 |
| LYM91 | 13284.3 | O | 1.47 | 6.23E−01 | 9.8 | LYM201 | 12831.5 | F | 0.326 | 8.38E−01 | 4.1 |
| LYM283 | 13304.4 | O | 1.541 | 6.30E−01 | 15.1 | LYM183 | 12993.5 | F | 0.32 | 8.80E−01 | 2.1 |
| LYM157 | 13341.4 | O | 1.391 | 6.32E−01 | 3.9 | LYM142 | 12802.9 | F | 0.319 | 8.84E−01 | 1.9 |
| LYM236 | 12592.4 | O | 1.565 | 6.43E−01 | 16.8 | LYM142 | 12804.3 | F | 0.332 | 8.91E−01 | 5.8 |
| LYM86 | 12183.1 | O | 1.446 | 6.73E−01 | 8 | LYM201 | 12833.7 | F | 0.32 | 9.02E−01 | 2.3 |
| LYM250 | 12611.3 | O | 1.512 | 6.74E−01 | 12.9 | LYM105 | 12297.1 | F | 0.322 | 9.11E−01 | 2.7 |
| LYM6 | 11733.2 | O | 1.414 | 7.15E−01 | 5.5 | LYM208 | 13011.6 | F | 0.325 | 9.20E−01 | 3.8 |
| LYM91 | 13283.4 | O | 1.475 | 7.75E−01 | 10.1 | LYM198 | 13005.6 | F | 0.316 | 9.23E−01 | 0.9 |
| LYM175 | 12654.6 | O | 1.405 | 7.80E−01 | 4.9 | LYM197 | 12822.7 | F | 0.316 | 9.30E−01 | 0.7 |
| LYM128 | 12641.1 | O | 1.426 | 7.91E−01 | 6.5 | LYM173 | 12982.7 | F | 0.32 | 9.33E−01 | 2.1 |
| LYM159 | 13354.5 | O | 1.365 | 8.31E−01 | 1.9 | LYM270 | 12871.7 | F | 0.315 | 9.39E−01 | 0.6 |
| LYM157 | 13342.4 | O | 1.431 | 8.44E−01 | 6.8 | LYM208 | 13012.8 | F | 0.317 | 9.44E−01 | 1.2 |
| LYM147 | 12583.1 | O | 1.443 | 8.70E−01 | 7.7 | LYM143 | 12523.4 | F | 0.317 | 9.74E−01 | 1.3 |
| LYM206 | 12603.2 | O | 1.347 | 9.41E−01 | 0.5 | LYM90 | 12392.1 | F | 0.315 | 9.85E−01 | 0.4 |
| LYM178 | 12164.2 | O | 1.355 | 9.61E−01 | 1.1 | LYM291 | 12751.7 | F | 0.313 | 9.97E−01 | 0 |
| LYM147 | 12584.5 | O | 1.342 | 9.84E−01 | 0.2 | CONTROL | — | F | 0.313 | — | 0 |
| LYM73 | 12622.2 | O | 1.345 | 9.91E−01 | 0.4 | LYM137 | 12154.5 | G | 9.652 | 2.50E−03 | 28.4 |
| LYM149 | 12344.2 | O | 1.346 | 9.92E−01 | 0.5 | LYM100 | 12131.3 | G | 9.793 | 2.50E−03 | 30.3 |
| CONTROL | — | O | 1.339 | — | 0 | LYM138 | 12566.1 | G | 9.6 | 3.03E−03 | 27.8 |
| LYM178 | 12163.4 | P | 2.405 | 5.91E−03 | 17 | LYM197 | 12821.6 | G | 9.487 | 4.52E−03 | 26.3 |
| LYM236 | 12592.3 | P | 2.371 | 7.03E−03 | 15.4 | LYM288 | 12744.6 | G | 10.091 | 4.70E−03 | 34.3 |
| LYM90 | 12395.3 | P | 2.356 | 1.03E−02 | 14.6 | LYM153 | 12324.2 | G | 9.399 | 5.04E−03 | 25.1 |
| LYM88 | 12193.1 | P | 2.445 | 2.73E−02 | 19 | LYM174 | 12412.1 | G | 9.898 | 6.17E−03 | 31.7 |
| LYM89 | 12211.4 | P | 2.286 | 3.08E−02 | 11.2 | LYM288 | 12743.7 | G | 9.309 | 6.49E−03 | 23.9 |
| LYM147 | 12583.3 | P | 2.321 | 3.39E−02 | 12.9 | LYM143 | 12524.7 | G | 9.948 | 7.18E−03 | 32.4 |
| LYM206 | 12603.3 | P | 2.67 | 3.75E−02 | 29.9 | LYM174 | 12411.3 | G | 8.938 | 1.97E−02 | 18.9 |
| LYM206 | 12603.1 | P | 2.365 | 4.22E−02 | 15 | LYM143 | 12524.5 | G | 9.436 | 2.22E−02 | 25.6 |
| LYM159 | 13354.6 | P | 2.244 | 6.96E−02 | 9.2 | LYM138 | 12561.1 | G | 8.803 | 2.93E−02 | 17.1 |
| LYM73 | 12623.2 | P | 2.228 | 8.37E−02 | 8.4 | LYM174 | 12414.3 | G | 9.918 | 3.00E−02 | 32 |
| LYM99 | 12243.2 | P | 2.217 | 9.87E−02 | 7.8 | LYM102 | 12222.3 | G | 8.786 | 3.08E−02 | 16.9 |
| LYM90 | 12395.1 | P | 2.348 | 1.12E−01 | 14.2 | LYM242 | 13052.5 | G | 8.763 | 3.35E−02 | 16.6 |
| LYM6 | 11735.1 | P | 2.459 | 1.30E−01 | 19.6 | LYM105 | 12295.2 | G | 8.76 | 3.42E−02 | 16.6 |
| LYM147 | 12584.4 | P | 2.197 | 1.35E−01 | 6.9 | LYM255 | 13082.9 | G | 9.044 | 3.44E−02 | 20.4 |
| LYM88 | 12194.2 | P | 2.194 | 1.52E−01 | 6.8 | LYM289 | 12491.4 | G | 8.796 | 3.65E−02 | 17.1 |
| LYM107 | 12631.4 | P | 2.302 | 1.87E−01 | 12 | LYM102 | 12221.2 | G | 9.395 | 3.66E−02 | 25 |
| LYM6 | 11734.3 | P | 2.255 | 1.95E−01 | 9.7 | LYM100 | 12131.2 | G | 8.713 | 3.84E−02 | 15.9 |
| LYM6 | 11736.1 | P | 2.175 | 1.97E−01 | 5.8 | LYM153 | 12321.9 | G | 9.902 | 4.76E−02 | 31.8 |
| LYM73 | 12623.1 | P | 2.201 | 2.31E−01 | 7.1 | LYM137 | 12151.4 | G | 8.637 | 4.92E−02 | 14.9 |
| LYM236 | 12594.3 | P | 2.181 | 2.39E−01 | 6.1 | LYM90 | 12395.1 | G | 8.672 | 4.94E−02 | 15.4 |
| LYM250 | 12613.4 | P | 2.573 | 2.42E−01 | 25.2 | LYM137 | 12152.1 | G | 9.49 | 5.11E−02 | 26.3 |
| LYM178 | 12161.2 | P | 2.337 | 2.59E−01 | 13.7 | LYM107 | 12631.1 | G | 9.234 | 5.21E−02 | 22.9 |
| LYM107 | 12633.4 | P | 2.571 | 2.61E−01 | 25.1 | LYM289 | 12493.1 | G | 11.018 | 5.29E−02 | 46.6 |
| LYM178 | 12163.3 | P | 2.335 | 2.65E−01 | 13.6 | LYM183 | 12994.7 | G | 8.609 | 5.68E−02 | 14.6 |
| LYM129 | 12572.4 | P | 2.18 | 2.78E−01 | 6.1 | LYM153 | 12323.2 | G | 8.693 | 6.46E−02 | 15.7 |
| LYM250 | 12613.2 | P | 2.186 | 2.87E−01 | 6.3 | LYM106 | 12142.1 | G | 8.737 | 6.51E−02 | 16.3 |
| LYM86 | 12182.3 | P | 2.149 | 3.06E−01 | 4.5 | LYM44 | 11885.3 | G | 8.74 | 7.16E−02 | 16.3 |
| LYM88 | 12191.2 | P | 2.362 | 3.07E−01 | 14.9 | LYM270 | 12872.5 | G | 8.542 | 7.30E−02 | 13.7 |
| LYM250 | 12614.1 | P | 2.156 | 3.08E−01 | 4.9 | LYM174 | 12414.2 | G | 9.38 | 7.53E−02 | 24.8 |
| LYM129 | 12573.5 | P | 2.34 | 3.12E−01 | 13.8 | LYM61 | 13174.7 | G | 8.675 | 7.55E−02 | 15.4 |
| LYM129 | 12573.3 | P | 2.279 | 3.13E−01 | 10.9 | LYM106 | 12142.3 | G | 8.481 | 7.93E−02 | 12.9 |
| LYM99 | 12243.1 | P | 2.452 | 3.36E−01 | 19.3 | LYM102 | 12221.1 | G | 8.523 | 8.03E−02 | 13.4 |
| LYM178 | 12164.3 | P | 2.146 | 3.40E−01 | 4.4 | LYM100 | 12134.1 | G | 8.547 | 8.05E−02 | 13.7 |
| LYM128 | 12641.3 | P | 2.149 | 3.45E−01 | 4.6 | LYM288 | 12741.9 | G | 8.472 | 8.26E−02 | 12.7 |
| LYM206 | 12601.2 | P | 2.588 | 3.87E−01 | 25.9 | LYM289 | 12491.1 | G | 8.522 | 8.40E−02 | 13.4 |
| LYM157 | 13341.4 | P | 2.143 | 4.06E−01 | 4.2 | LYM173 | 12981.8 | G | 8.649 | 8.84E−02 | 15.1 |
| LYM250 | 12614.2 | P | 2.216 | 4.21E−01 | 7.8 | LYM107 | 12632.3 | G | 8.469 | 9.28E−02 | 12.7 |
| LYM90 | 12392.1 | P | 2.121 | 4.64E−01 | 3.2 | LYM138 | 12561.3 | G | 9.89 | 9.40E−02 | 31.6 |
| LYM89 | 12214.2 | P | 2.296 | 4.65E−01 | 11.7 | LYM287 | 12771.7 | G | 8.573 | 9.43E−02 | 14.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM159 | 13354.5 | P | 2.143 | 4.69E−01 | 4.2 | LYM119 | 12461.4 | G | 10.068 | 9.61E−02 | 34 |
| LYM236 | 12591.1 | P | 2.305 | 5.02E−01 | 12.1 | LYM183 | 12994.8 | G | 8.641 | 9.88E−02 | 15 |
| LYM90 | 12393.1 | P | 2.202 | 5.67E−01 | 7.1 | LYM111 | 12252.2 | G | 9.767 | 1.10E−01 | 30 |
| LYM236 | 12592.4 | P | 2.266 | 5.72E−01 | 10.2 | LYM173 | 12982.7 | G | 8.456 | 1.10E−01 | 12.5 |
| LYM175 | 12654.4 | P | 2.247 | 5.93E−01 | 9.3 | LYM291 | 12753.6 | G | 8.43 | 1.13E−01 | 12.2 |
| LYM250 | 12611.3 | P | 2.252 | 6.16E−01 | 9.6 | LYM105 | 12293.1 | G | 8.749 | 1.13E−01 | 16.4 |
| LYM89 | 12214.3 | P | 2.192 | 6.24E−01 | 6.6 | LYM130 | 12331.3 | G | 9.171 | 1.24E−01 | 22 |
| LYM91 | 13284.3 | P | 2.216 | 6.26E−01 | 7.8 | LYM220 | 12852.4 | G | 8.54 | 1.27E−01 | 13.6 |
| LYM283 | 13304.4 | P | 2.184 | 6.55E−01 | 6.3 | LYM90 | 12393.1 | G | 8.368 | 1.28E−01 | 11.4 |
| LYM128 | 12642.3 | P | 2.143 | 6.86E−01 | 4.3 | LYM44 | 11884.1 | G | 8.324 | 1.29E−01 | 10.8 |
| LYM175 | 12651.2 | P | 2.091 | 6.92E−01 | 1.7 | LYM208 | 13014.7 | G | 8.336 | 1.38E−01 | 10.9 |
| LYM91 | 13283.4 | P | 2.177 | 7.80E−01 | 5.9 | LYM152 | 12371.2 | G | 8.316 | 1.41E−01 | 10.7 |
| LYM157 | 13342.4 | P | 2.129 | 8.55E−01 | 3.6 | LYM270 | 12871.8 | G | 9.587 | 1.48E−01 | 27.6 |
| LYM86 | 12183.1 | P | 2.086 | 8.93E−01 | 1.5 | LYM106 | 12144.3 | G | 8.492 | 1.51E−01 | 13 |
| LYM128 | 12641.1 | P | 2.081 | 9.09E−01 | 1.3 | LYM100 | 12133.1 | G | 9.105 | 1.51E−01 | 21.2 |
| LYM6 | 11733.2 | P | 2.08 | 9.12E−01 | 1.2 | LYM291 | 12751.7 | G | 8.332 | 1.55E−01 | 10.9 |
| LYM159 | 13352.4 | P | 2.07 | 9.20E−01 | 0.7 | LYM90 | 12395.3 | G | 8.261 | 1.57E−01 | 9.9 |
| LYM73 | 12622.2 | P | 2.085 | 9.45E−01 | 1.4 | LYM61 | 13171.7 | G | 9.396 | 1.58E−01 | 25 |
| LYM147 | 12583.1 | P | 2.095 | 9.49E−01 | 1.9 | LYM44 | 11884.3 | G | 8.442 | 1.59E−01 | 12.3 |
| CONTROL | — | P | 2.056 | — | 0 | LYM288 | 12743.5 | G | 11.095 | 1.61E−01 | 47.6 |
| LYM165 | 12973.8 | A | 91.461 | 5.84E−02 | 2.5 | LYM174 | 12411.2 | G | 8.324 | 1.65E−01 | 10.8 |
| LYM142 | 12803.6 | A | 91.285 | 7.62E−02 | 2.3 | LYM287 | 12774.6 | G | 8.768 | 1.68E−01 | 16.7 |
| LYM242 | 13052.5 | A | 91.179 | 8.25E−02 | 2.1 | LYM255 | 13082.7 | G | 9.398 | 1.69E−01 | 25.1 |
| LYM142 | 12804.4 | A | 91.52 | 1.16E−01 | 2.5 | LYM143 | 12521.1 | G | 9.119 | 1.76E−01 | 21.4 |
| LYM220 | 12851.7 | A | 92.043 | 1.54E−01 | 3.1 | LYM90 | 12392.1 | G | 8.32 | 1.76E−01 | 10.7 |
| LYM142 | 12802.9 | A | 90.734 | 1.57E−01 | 1.6 | LYM255 | 13082.8 | G | 10.97 | 1.80E−01 | 46 |
| LYM220 | 12851.13 | A | 90.671 | 1.90E−01 | 1.6 | LYM212 | 13034.8 | G | 9.016 | 1.83E−01 | 20 |
| LYM270 | 12874.7 | A | 90.187 | 3.71E−01 | 1 | LYM102 | 12222.2 | G | 8.422 | 1.87E−01 | 12.1 |
| LYM212 | 13032.8 | A | 90.258 | 4.05E−01 | 1.1 | LYM242 | 13054.9 | G | 9.013 | 1.90E−01 | 19.9 |
| LYM165 | 12973.6 | A | 90.35 | 4.28E−01 | 1.2 | LYM106 | 12141.4 | G | 8.558 | 2.06E−01 | 13.9 |
| LYM223 | 12674.2 | A | 90.259 | 4.31E−01 | 1.1 | LYM107 | 12631.4 | G | 9.993 | 2.10E−01 | 33 |
| LYM270 | 12872.5 | A | 90.341 | 4.99E−01 | 1.2 | LYM143 | 12521.2 | G | 8.357 | 2.11E−01 | 11.2 |
| LYM220 | 12851.11 | A | 90.446 | 5.73E−01 | 1.3 | LYM208 | 13013.9 | G | 8.782 | 2.14E−01 | 16.9 |
| LYM203 | 12664.1 | A | 89.791 | 5.92E−01 | 0.6 | LYM138 | 12562.2 | G | 8.175 | 2.14E−01 | 8.8 |
| LYM165 | 12972.6 | A | 89.924 | 6.77E−01 | 0.7 | LYM255 | 13082.5 | G | 8.237 | 2.26E−01 | 9.6 |
| LYM142 | 12804.3 | A | 89.663 | 6.98E−01 | 0.4 | LYM107 | 12633.4 | G | 9.106 | 2.32E−01 | 21.2 |
| LYM203 | 12662.3 | A | 89.592 | 7.80E−01 | 0.4 | LYM142 | 12804.1 | G | 10.662 | 2.37E−01 | 41.9 |
| LYM212 | 13031.5 | A | 89.76 | 8.24E−01 | 0.6 | LYM242 | 13051.9 | G | 8.604 | 2.43E−01 | 14.5 |
| LYM165 | 12974.5 | A | 89.451 | 8.70E−01 | 0.2 | LYM197 | 12822.5 | G | 9.435 | 2.48E−01 | 25.6 |
| LYM142 | 12801.8 | A | 89.833 | 9.02E−01 | 0.6 | LYM44 | 11882.1 | G | 9.758 | 2.48E−01 | 29.9 |
| LYM220 | 12852.4 | A | 89.491 | 9.29E−01 | 0.2 | LYM270 | 12871.5 | G | 8.255 | 2.54E−01 | 9.9 |
| LYM207 | 13252.2 | A | 89.464 | 9.67E−01 | 0.2 | LYM100 | 12133.3 | G | 8.864 | 2.58E−01 | 18 |
| LYM212 | 13034.9 | A | 89.317 | 9.73E−01 | 0.1 | LYM153 | 12324.1 | G | 9.765 | 2.62E−01 | 29.9 |
| CONTROL | — | A | 89.268 | — | 0 | LYM105 | 12297.2 | G | 8.081 | 2.72E−01 | 7.5 |
| LYM203 | 12662.3 | B | 0.357 | 2.54E−03 | 16.5 | LYM102 | 12222.1 | G | 8.19 | 2.75E−01 | 9 |
| LYM142 | 12804.4 | B | 0.346 | 2.59E−02 | 13.1 | LYM119 | 12463.2 | G | 8.455 | 2.83E−01 | 12.5 |
| LYM270 | 12872.8 | B | 0.32 | 1.49E−01 | 4.5 | LYM130 | 12333.1 | G | 8.851 | 2.85E−01 | 17.8 |
| LYM207 | 13251.5 | B | 0.32 | 2.19E−01 | 4.5 | LYM152 | 12372.2 | G | 9.446 | 2.96E−01 | 25.7 |
| LYM242 | 13051.8 | B | 0.323 | 2.70E−01 | 5.5 | LYM198 | 13002.5 | G | 8.897 | 2.97E−01 | 18.4 |
| LYM212 | 13032.8 | B | 0.328 | 3.94E−01 | 6.9 | LYM152 | 12373.1 | G | 10.53 | 3.04E−01 | 40.1 |
| LYM165 | 12973.5 | B | 0.311 | 5.21E−01 | 1.6 | LYM130 | 12332.2 | G | 8.949 | 3.07E−01 | 19.1 |
| LYM165 | 12974.5 | B | 0.343 | 5.67E−01 | 11.8 | LYM208 | 13013.6 | G | 8.78 | 3.08E−01 | 16.8 |
| LYM220 | 12851.11 | B | 0.324 | 5.74E−01 | 5.9 | LYM197 | 12824.7 | G | 8.209 | 3.20E−01 | 9.2 |
| LYM165 | 12973.6 | B | 0.339 | 5.91E−01 | 10.8 | LYM130 | 12334.1 | G | 8.524 | 3.27E−01 | 13.4 |
| LYM212 | 13034.9 | B | 0.322 | 6.03E−01 | 5.1 | LYM153 | 12322.1 | G | 10.078 | 3.33E−01 | 34.1 |
| LYM165 | 12972.6 | B | 0.31 | 6.28E−01 | 1.2 | LYM119 | 12462.1 | G | 11.322 | 3.43E−01 | 50.7 |
| LYM223 | 12674.5 | B | 0.311 | 6.63E−01 | 1.6 | LYM212 | 13031.6 | G | 8.344 | 3.43E−01 | 11 |
| LYM242 | 13054.9 | B | 0.321 | 6.88E−01 | 4.7 | LYM152 | 12371.3 | G | 8.835 | 3.43E−01 | 17.6 |
| LYM223 | 12674.2 | B | 0.318 | 7.66E−01 | 3.9 | LYM255 | 13081.5 | G | 8.369 | 3.44E−01 | 11.4 |
| LYM212 | 13034.8 | B | 0.314 | 8.88E−01 | 2.6 | LYM138 | 12564.1 | G | 9.043 | 3.61E−01 | 20.3 |
| LYM142 | 12804.3 | B | 0.308 | 9.13E−01 | 0.4 | LYM119 | 12462.2 | G | 8.791 | 3.63E−01 | 17 |
| LYM270 | 12872.7 | B | 0.308 | 9.59E−01 | 0.4 | LYM288 | 12743.8 | G | 7.991 | 3.87E−01 | 6.3 |
| CONTROL | — | B | 0.306 | — | 0 | LYM208 | 13011.6 | G | 9.207 | 3.94E−01 | 22.5 |
| LYM270 | 12872.8 | C | 3.214 | 1.73E−02 | 9 | LYM183 | 12993.8 | G | 8.732 | 4.00E−01 | 16.2 |
| LYM242 | 13051.8 | C | 3.056 | 2.19E−01 | 3.6 | LYM220 | 12851.13 | G | 7.962 | 4.01E−01 | 6 |
| LYM203 | 12662.3 | C | 3.394 | 2.48E−01 | 15.1 | LYM220 | 12852.2 | G | 8.431 | 4.14E−01 | 12.2 |
| LYM165 | 12973.6 | C | 3.363 | 2.58E−01 | 14 | LYM111 | 12251.4 | G | 7.938 | 4.15E−01 | 5.6 |
| LYM220 | 12851.11 | C | 3.088 | 3.21E−01 | 4.7 | LYM201 | 12833.9 | G | 8.436 | 4.26E−01 | 12.3 |
| LYM270 | 12872.7 | C | 3.025 | 4.73E−01 | 2.6 | LYM119 | 12461.1 | G | 8.188 | 4.34E−01 | 9 |
| LYM207 | 13251.5 | C | 3.081 | 4.87E−01 | 4.5 | LYM143 | 12524.2 | G | 8.464 | 4.56E−01 | 12.6 |
| LYM142 | 12804.3 | C | 3.006 | 4.98E−01 | 1.9 | LYM291 | 12754.9 | G | 8.193 | 4.61E−01 | 9 |
| LYM165 | 12974.5 | C | 3.319 | 5.38E−01 | 12.5 | LYM198 | 13005.8 | G | 7.987 | 4.62E−01 | 6.3 |
| LYM212 | 13032.8 | C | 3.144 | 5.50E−01 | 6.6 | LYM130 | 12332.1 | G | 9.025 | 4.71E−01 | 20.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM242 | 13054.9 | C | 3.075 | 6.60E−01 | 4.3 | LYM201 | 12834.6 | G | 9.028 | 4.74E−01 | 20.1 |
| LYM142 | 12804.4 | C | 3.119 | 6.89E−01 | 5.7 | LYM173 | 12981.5 | G | 9.308 | 4.78E−01 | 23.9 |
| LYM212 | 13034.9 | C | 3.069 | 7.34E−01 | 4 | LYM212 | 13034.9 | G | 7.933 | 4.85E−01 | 5.6 |
| LYM212 | 13034.8 | C | 3.081 | 7.88E−01 | 4.5 | LYM105 | 12294.2 | G | 8.765 | 4.98E−01 | 16.6 |
| LYM165 | 12974.6 | C | 2.981 | 8.42E−01 | 1.1 | LYM137 | 12151.1 | G | 7.906 | 5.03E−01 | 5.2 |
| LYM223 | 12674.2 | C | 2.981 | 8.42E−01 | 1.1 | LYM197 | 12821.11 | G | 8.258 | 5.15E−01 | 9.9 |
| CONTROL | — | C | 2.949 | — | 0 | LYM208 | 13012.5 | G | 8.238 | 5.34E−01 | 9.6 |
| LYM165 | 12973.8 | D | 0.32 | 2.37E−03 | 23 | LYM289 | 12493.2 | G | 9.265 | 5.36E−01 | 23.3 |
| LYM207 | 13251.6 | D | 0.305 | 1.11E−02 | 17.4 | LYM137 | 12153.1 | G | 8.62 | 5.42E−01 | 14.7 |
| LYM165 | 12973.6 | D | 0.36 | 3.31E−02 | 38.6 | LYM151.2 | 12151.2 | G | 10.046 | 5.51E−01 | 33.7 |
| LYM207 | 13251.4 | D | 0.295 | 5.21E−02 | 13.4 | LYM142 | 12801.8 | G | 8.686 | 5.67E−01 | 15.6 |
| LYM203 | 12664.1 | D | 0.295 | 1.18E−01 | 13.7 | LYM138 | 12562.1 | G | 7.819 | 5.85E−01 | 4.1 |
| LYM142 | 12804.4 | D | 0.327 | 1.20E−01 | 25.7 | LYM288 | 12744.7 | G | 8.895 | 5.96E−01 | 18.4 |
| LYM220 | 12851.7 | D | 0.289 | 1.21E−01 | 11.3 | LYM183 | 12991.7 | G | 8.057 | 6.16E−01 | 7.2 |
| LYM212 | 13034.9 | D | 0.321 | 1.28E−01 | 23.6 | LYM198 | 13002.8 | G | 7.831 | 6.34E−01 | 4.2 |
| LYM203 | 12662.3 | D | 0.392 | 1.71E−01 | 50.9 | LYM242 | 13053.7 | G | 7.802 | 6.36E−01 | 3.8 |
| LYM165 | 12972.6 | D | 0.337 | 2.51E−01 | 29.6 | LYM198 | 13004.6 | G | 8.078 | 6.38E−01 | 7.5 |
| LYM142 | 12802.9 | D | 0.288 | 2.59E−01 | 10.9 | LYM291 | 12751.1 | G | 7.808 | 6.53E−01 | 3.9 |
| LYM220 | 12851.11 | D | 0.275 | 2.93E−01 | 5.7 | LYM107 | 12631.2 | G | 8.188 | 6.54E−01 | 9 |
| LYM165 | 12974.5 | D | 0.366 | 3.60E−01 | 40.7 | LYM111 | 12251.3 | G | 8.43 | 6.54E−01 | 12.2 |
| LYM142 | 12804.3 | D | 0.28 | 3.67E−01 | 7.9 | LYM111 | 12254.4 | G | 8.21 | 6.60E−01 | 9.3 |
| LYM203.2 | 13032.8 | D | 0.313 | 3.99E−01 | 20.5 | LYM173 | 12982.6 | G | 8.196 | 6.75E−01 | 9.1 |
| LYM207 | 13251.5 | D | 0.271 | 4.58E−01 | 4.2 | LYM90 | 12394.2 | G | 7.749 | 6.78E−01 | 3.1 |
| LYM212 | 13034.8 | D | 0.326 | 4.77E−01 | 25.5 | LYM289 | 12492.2 | G | 7.878 | 6.78E−01 | 4.8 |
| LYM242 | 13051.8 | D | 0.317 | 5.01E−01 | 22.2 | LYM270 | 12873.6 | G | 8.656 | 6.86E−01 | 15.2 |
| LYM242 | 13054.9 | D | 0.296 | 5.23E−01 | 14 | LYM142 | 12804.3 | G | 8.105 | 6.98E−01 | 7.9 |
| LYM142 | 12801.8 | D | 0.277 | 5.35E−01 | 6.7 | LYM291 | 12751.2 | G | 8.022 | 6.99E−01 | 6.7 |
| LYM270 | 12871.7 | D | 0.266 | 6.43E−01 | 2.4 | LYM107 | 12632.1 | G | 8.133 | 7.08E−01 | 8.2 |
| LYM165 | 12973.5 | D | 0.285 | 6.48E−01 | 9.5 | LYM106 | 12142.2 | G | 7.736 | 7.26E−01 | 3 |
| LYM203 | 12664.2 | D | 0.273 | 7.59E−01 | 5.1 | LYM142 | 12803.6 | G | 7.723 | 7.27E−01 | 2.8 |
| LYM142 | 12804.1 | D | 0.271 | 8.59E−01 | 4.2 | LYM61 | 13174.5 | G | 7.916 | 7.37E−01 | 5.3 |
| LYM270 | 12872.7 | D | 0.262 | 8.71E−01 | 0.8 | LYM270 | 12872.7 | G | 7.673 | 7.48E−01 | 2.1 |
| LYM223 | 12674.2 | D | 0.261 | 9.23E−01 | 0.5 | LYM220 | 12851.8 | G | 8.082 | 7.70E−01 | 7.6 |
| CONTROL | — | D | 0.26 | — | 0 | LYM152 | 12373.2 | G | 7.82 | 7.80E−01 | 4.1 |
| LYM165 | 12973.8 | E | 8.625 | 4.10E−04 | 12 | LYM201 | 12831.5 | G | 7.64 | 7.97E−01 | 1.7 |
| LYM212 | 13034.9 | E | 8.438 | 1.77E−03 | 9.6 | LYM198 | 13005.6 | G | 7.688 | 8.21E−01 | 2.3 |
| LYM165 | 12973.6 | E | 8.75 | 4.04E−03 | 13.6 | LYM111 | 12254.3 | G | 7.707 | 8.31E−01 | 2.6 |
| LYM165 | 12972.6 | E | 8.313 | 5.10E−03 | 7.9 | LYM198 | 13002.6 | G | 7.837 | 8.35E−01 | 4.3 |
| LYM142 | 12803.6 | E | 8.188 | 1.61E−02 | 6.3 | LYM143 | 12523.4 | G | 7.685 | 8.37E−01 | 2.3 |
| LYM207 | 13251.5 | E | 8.188 | 1.61E−02 | 6.3 | LYM197 | 12824.4 | G | 7.755 | 8.48E−01 | 3.2 |
| LYM203 | 12664.1 | E | 9 | 5.72E−02 | 16.9 | LYM201 | 12833.6 | G | 7.594 | 8.73E−01 | 1.1 |
| LYM220 | 12851.11 | E | 8 | 8.14E−02 | 3.9 | LYM208 | 13012.8 | G | 7.631 | 9.07E−01 | 1.6 |
| LYM142 | 12804.3 | E | 8.313 | 1.00E−01 | 7.9 | LYM106 | 12144.4 | G | 7.553 | 9.41E−01 | 0.5 |
| LYM212 | 13034.8 | E | 8.438 | 2.09E−01 | 9.6 | LYM102 | 12222.6 | G | 7.564 | 9.61E−01 | 0.7 |
| LYM203 | 12662.3 | E | 8.625 | 2.09E−01 | 12 | LYM220 | 12851.11 | G | 7.521 | 9.92E−01 | 0.1 |
| LYM165 | 12974.5 | E | 8.313 | 2.60E−01 | 7.9 | CONTROL | — | G | 7.514 | — | 0 |
| LYM203.2 | 13032.8 | E | 8.313 | 2.60E−01 | 7.9 | LYM174 | 12414.3 | H | 16.748 | 1.00E−06 | 72.1 |
| LYM220 | 12851.7 | E | 8.25 | 3.59E−01 | 7.1 | LYM288 | 12743.9 | H | 13.843 | 3.30E−05 | 42.2 |
| LYM270 | 12871.7 | E | 7.938 | 4.08E−01 | 3.1 | LYM255 | 13082.8 | H | 13.698 | 4.70E−05 | 40.7 |
| LYM142 | 12801.8 | E | 8 | 4.22E−01 | 3.9 | LYM106 | 12144.4 | H | 12.994 | 2.04E−04 | 33.5 |
| LYM207 | 13251.6 | E | 8 | 4.22E−01 | 3.9 | LYM270 | 12873.6 | H | 12.695 | 4.90E−04 | 30.4 |
| LYM142 | 12804.1 | E | 8.125 | 4.47E−01 | 5.5 | LYM289 | 12492.2 | H | 12.141 | 1.30E−03 | 24.7 |
| LYM223 | 12674.2 | E | 7.813 | 5.05E−01 | 1.4 | LYM105 | 12294.2 | H | 11.967 | 1.87E−03 | 22.9 |
| LYM270 | 12872.5 | E | 8.125 | 5.48E−01 | 5.5 | LYM130 | 12332.1 | H | 15.426 | 3.71E−03 | 58.5 |
| LYM242 | 13051.8 | E | 8.063 | 5.55E−01 | 4.7 | LYM153 | 12323.2 | H | 14.628 | 4.86E−03 | 50.3 |
| LYM142 | 12802.9 | E | 8 | 5.67E−01 | 3.9 | LYM130 | 12334.1 | H | 12.621 | 5.52E−03 | 29.7 |
| LYM203 | 12664.2 | E | 7.75 | 8.10E−01 | 0.6 | LYM137 | 12153.1 | H | 11.476 | 7.32E−03 | 17.9 |
| LYM142 | 12804.3 | E | 7.813 | 8.76E−01 | 1.4 | LYM153 | 12324.2 | H | 13.515 | 7.63E−03 | 38.9 |
| LYM242 | 13052.5 | E | 7.75 | 8.83E−01 | 0.6 | LYM173 | 12981.6 | H | 11.701 | 8.10E−03 | 20.2 |
| LYM220 | 12851.13 | E | 7.75 | 9.38E−01 | 0.6 | LYM138 | 12561.1 | H | 21.81 | 8.93E−03 | 124.1 |
| LYM242 | 13054.9 | E | 7.75 | 9.50E−01 | 0.6 | LYM289 | 12493.1 | H | 14.547 | 1.07E−02 | 49.5 |
| CONTROL | — | E | 7.701 | — | 0 | LYM119 | 12461.4 | H | 16.244 | 1.16E−02 | 66.9 |
| LYM165 | 12973.6 | F | 0.596 | 7.95E−02 | 13.5 | LYM102 | 12222.2 | H | 13.408 | 1.46E−02 | 37.7 |
| LYM142 | 12804.4 | F | 0.592 | 1.09E−01 | 12.7 | LYM102 | 12222.3 | H | 11.638 | 1.94E−02 | 19.6 |
| LYM165 | 12973.8 | F | 0.586 | 1.31E−01 | 11.7 | LYM105 | 12297.2 | H | 12.783 | 2.07E−02 | 31.3 |
| LYM203 | 12664.1 | F | 0.633 | 2.49E−01 | 20.5 | LYM107 | 12631.2 | H | 11.091 | 2.27E−02 | 14 |
| LYM203 | 12662.3 | F | 0.694 | 2.67E−01 | 32.3 | LYM138 | 12561.3 | H | 16.524 | 3.41E−02 | 69.8 |
| LYM242 | 13051.8 | F | 0.582 | 3.48E−01 | 10.9 | LYM119 | 12461.1 | H | 15.582 | 6.22E−02 | 60.1 |
| LYM207 | 13251.6 | F | 0.561 | 3.53E−01 | 6.8 | LYM105 | 12293.1 | H | 13.558 | 6.63E−02 | 39.3 |
| LYM242 | 13054.9 | F | 0.57 | 4.74E−01 | 8.5 | LYM106 | 12141.4 | H | 11.104 | 7.61E−02 | 14.1 |
| LYM212 | 13034.8 | F | 0.587 | 5.70E−01 | 11.8 | LYM212 | 13032.8 | H | 11.593 | 7.79E−02 | 19.1 |
| LYM165 | 12972.6 | F | 0.557 | 5.84E−01 | 6 | LYM119 | 12463.2 | H | 15.335 | 8.15E−02 | 57.6 |
| LYM165 | 12974.5 | F | 0.578 | 6.31E−01 | 10 | LYM105 | 12295.2 | H | 12.855 | 8.74E−02 | 32.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM212 | 13034.9 | F | 0.54 | 7.29E−01 | 2.9 | LYM173 | 12982.6 | H | 10.659 | 8.92E−02 | 9.5 |
| LYM142 | 12804.1 | F | 0.541 | 7.41E−01 | 3 | LYM111 | 12254.4 | H | 11.442 | 9.17E−02 | 17.6 |
| LYM207 | 13251.4 | F | 0.538 | 7.77E−01 | 2.4 | LYM174 | 12411.2 | H | 13.791 | 1.04E−01 | 41.7 |
| LYM165 | 12973.5 | F | 0.534 | 8.72E−01 | 1.6 | LYM220 | 12851.8 | H | 15.087 | 1.22E−01 | 55 |
| LYM212 | 13032.8 | F | 0.527 | 9.61E−01 | 0.5 | LYM105 | 12294.3 | H | 10.846 | 1.28E−01 | 11.4 |
| CONTROL | — | F | 0.525 | — | 0 | LYM137 | 12151.4 | H | 13.064 | 1.38E−01 | 34.2 |
| LYM203 | 12662.3 | G | 10.773 | 2.09E−01 | 11.7 | LYM174 | 12412.1 | H | 14.775 | 1.64E−01 | 51.8 |
| LYM223 | 12671.2 | G | 10.217 | 5.89E−01 | 6 | LYM106 | 12142.2 | H | 15.871 | 1.65E−01 | 63.1 |
| LYM212 | 13034.8 | G | 10.024 | 7.08E−01 | 4 | LYM130 | 12332.2 | H | 12.921 | 1.74E−01 | 32.8 |
| LYM142 | 12804.1 | G | 9.731 | 8.40E−01 | 0.9 | LYM242 | 13051.8 | H | 11.319 | 1.75E−01 | 16.3 |
| LYM270 | 12871.7 | G | 9.681 | 9.77E−01 | 0.4 | LYM107 | 12632.3 | H | 14.768 | 1.82E−01 | 51.7 |
| CONTROL | — | G | 9.641 | — | 0 | LYM152 | 12373.1 | H | 11.022 | 2.05E−01 | 13.2 |
| LYM165 | 12973.6 | H | 16.961 | 8.98E−04 | 45.3 | LYM137 | 12151.1 | H | 12.658 | 2.07E−01 | 30 |
| LYM165 | 12973.8 | H | 14.778 | 4.30E−03 | 26.6 | LYM153 | 12324.1 | H | 14.197 | 2.09E−01 | 45.9 |
| LYM207 | 13251.6 | H | 14.326 | 3.04E−02 | 22.7 | LYM107 | 12631.4 | H | 11.147 | 2.14E−01 | 14.5 |
| LYM142 | 12804.4 | H | 15.589 | 3.30E−02 | 33.5 | LYM119 | 12462.1 | H | 14.806 | 2.26E−01 | 52.1 |
| LYM203 | 12664.1 | H | 14.085 | 5.01E−02 | 20.7 | LYM138 | 12562.2 | H | 12.098 | 2.27E−01 | 24.3 |
| LYM212 | 13034.9 | H | 14.993 | 9.74E−02 | 28.4 | LYM289 | 12491.1 | H | 10.624 | 2.38E−01 | 9.1 |
| LYM203 | 12662.3 | H | 19.328 | 1.50E−01 | 65.6 | LYM174 | 12411.3 | H | 15.539 | 2.45E−01 | 59.6 |
| LYM165 | 12972.6 | H | 15.617 | 2.04E−01 | 33.8 | LYM137 | 12151.2 | H | 12.694 | 2.45E−01 | 30.4 |
| LYM207 | 13251.5 | H | 12.719 | 2.12E−01 | 9 | LYM153 | 12322.1 | H | 10.728 | 2.52E−01 | 10.2 |
| LYM220 | 12851.7 | H | 13.019 | 2.47E−01 | 11.5 | LYM111 | 12252.2 | H | 12.372 | 2.55E−01 | 27.1 |
| LYM207 | 13251.4 | H | 13.224 | 2.75E−01 | 13.3 | LYM288 | 12743.8 | H | 11.715 | 2.62E−01 | 20.4 |
| LYM220 | 12851.11 | H | 12.536 | 3.05E−01 | 7.4 | LYM287 | 12774.6 | H | 10.425 | 2.70E−01 | 7.1 |
| LYM165 | 12974.5 | H | 17.137 | 3.08E−01 | 46.8 | LYM288 | 12743.5 | H | 14.237 | 2.75E−01 | 46.3 |
| LYM212 | 13032.8 | H | 14.504 | 4.27E−01 | 24.3 | LYM242 | 13052.5 | H | 10.922 | 2.99E−01 | 12.2 |
| LYM212 | 13034.8 | H | 15.169 | 4.30E−01 | 29.9 | LYM107 | 12631.1 | H | 11.258 | 3.08E−01 | 15.7 |
| LYM142 | 12801.8 | H | 12.83 | 4.42E−01 | 9.9 | LYM100 | 12131.3 | H | 10.877 | 3.20E−01 | 11.7 |
| LYM142 | 12802.9 | H | 12.829 | 4.65E−01 | 9.9 | LYM289 | 12491.4 | H | 10.577 | 3.20E−01 | 8.7 |
| LYM242 | 13054.9 | H | 13.501 | 4.67E−01 | 15.7 | LYM90 | 12395.3 | H | 11.546 | 3.34E−01 | 18.6 |
| LYM242 | 13051.8 | H | 14.412 | 5.21E−01 | 23.5 | LYM102 | 12222.1 | H | 10.714 | 3.34E−01 | 10.1 |
| LYM142 | 12804.3 | H | 12.49 | 5.36E−01 | 7 | LYM197 | 12821.6 | H | 11.08 | 3.37E−01 | 13.8 |
| LYM165 | 12973.5 | H | 12.626 | 6.39E−01 | 8.2 | LYM255 | 13082.7 | H | 13.691 | 3.37E−01 | 40.7 |
| LYM223 | 12674.2 | H | 11.968 | 7.07E−01 | 2.5 | LYM119 | 12462.2 | H | 13.506 | 3.41E−01 | 38.8 |
| LYM142 | 12804.1 | H | 12.327 | 8.32E−01 | 5.6 | LYM152 | 12371.2 | H | 14.331 | 3.57E−01 | 47.2 |
| LYM203 | 12664.2 | H | 12.083 | 8.49E−01 | 3.5 | LYM153 | 12321.2 | H | 12.36 | 3.58E−01 | 27 |
| LYM270 | 12871.7 | H | 11.794 | 8.95E−01 | 1 | LYM287 | 12771.6 | H | 10.273 | 3.68E−01 | 5.5 |
| LYM270 | 12872.7 | H | 11.754 | 9.22E−01 | 0.7 | LYM289 | 12493.2 | H | 14.017 | 3.69E−01 | 44 |
| CONTROL | — | H | 11.673 | — | 0 | LYM106 | 12144.3 | H | 12.356 | 3.75E−01 | 26.9 |
| LYM203 | 12662.3 | J | 0.046 | 2.04E−03 | 50.5 | LYM255 | 13082.5 | H | 14.481 | 3.83E−01 | 48.8 |
| LYM165 | 12973.6 | J | 0.042 | 6.22E−03 | 38.8 | LYM288 | 12741.9 | H | 11.834 | 4.12E−01 | 21.6 |
| LYM165 | 12974.5 | J | 0.043 | 1.62E−02 | 41 | LYM138 | 12564.1 | H | 11.616 | 4.26E−01 | 19.3 |
| LYM165 | 12972.6 | J | 0.039 | 4.57E−02 | 29.2 | LYM291 | 12754.9 | H | 12.303 | 4.35E−01 | 26.4 |
| LYM142 | 12804.4 | J | 0.038 | 6.13E−02 | 25.6 | LYM102 | 12221.1 | H | 10.824 | 4.81E−01 | 11.2 |
| LYM212 | 13034.8 | J | 0.038 | 9.39E−02 | 26.4 | LYM152 | 12371.3 | H | 11.586 | 4.88E−01 | 19 |
| LYM212 | 13034.9 | J | 0.037 | 1.03E−01 | 22.1 | LYM255 | 13082.9 | H | 10.851 | 5.04E−01 | 11.5 |
| LYM165 | 12973.8 | J | 0.037 | 1.07E−01 | 21.7 | LYM130 | 12331.3 | H | 12.714 | 5.44E−01 | 30.6 |
| LYM212 | 13032.8 | J | 0.037 | 1.53E−01 | 20.9 | LYM212 | 13031.6 | H | 10.172 | 5.47E−01 | 4.5 |
| LYM242 | 13051.8 | J | 0.037 | 1.67E−01 | 20.7 | LYM143 | 12524.7 | H | 11.939 | 5.72E−01 | 22.7 |
| LYM207 | 13251.6 | J | 0.036 | 1.84E−01 | 17.5 | LYM173 | 12981.5 | H | 10.649 | 5.74E−01 | 9.4 |
| LYM203 | 12664.1 | J | 0.035 | 2.26E−01 | 16 | LYM106 | 12142.3 | H | 10.139 | 5.74E−01 | 4.2 |
| LYM207 | 13251.4 | J | 0.035 | 2.79E−01 | 14.1 | LYM142 | 12802.9 | H | 11.041 | 5.91E−01 | 13.4 |
| LYM142 | 12802.9 | J | 0.035 | 3.01E−01 | 14 | LYM198 | 13005.8 | H | 10.183 | 5.92E−01 | 4.6 |
| LYM220 | 12851.7 | J | 0.035 | 3.06E−01 | 13.9 | LYM102 | 12222.6 | H | 10.759 | 6.01E−01 | 10.5 |
| LYM242 | 13054.9 | J | 0.034 | 3.48E−01 | 13 | LYM137 | 12154.5 | H | 12.354 | 6.05E−01 | 26.9 |
| LYM165 | 12973.5 | J | 0.034 | 3.92E−01 | 12.3 | LYM201 | 12834.6 | H | 10.294 | 7.03E−01 | 5.8 |
| LYM142 | 12804.3 | J | 0.033 | 4.73E−01 | 9.4 | LYM183 | 12994.8 | H | 11.314 | 7.10E−01 | 16.2 |
| LYM203 | 12664.2 | J | 0.033 | 5.96E−01 | 7.4 | LYM44 | 11885.4 | H | 10.256 | 7.27E−01 | 5.4 |
| LYM220 | 12851.11 | J | 0.032 | 6.35E−01 | 6.1 | LYM242 | 13053.7 | H | 10.093 | 7.36E−01 | 3.7 |
| LYM142 | 12804.1 | J | 0.032 | 6.79E−01 | 6 | LYM291 | 12753.6 | H | 10.337 | 7.51E−01 | 6.2 |
| LYM242 | 13053.7 | J | 0.032 | 6.82E−01 | 5.5 | LYM143 | 12524.5 | H | 10.926 | 7.58E−01 | 12.2 |
| LYM142 | 12801.8 | J | 0.031 | 7.91E−01 | 3.5 | LYM201 | 12833.7 | H | 9.927 | 7.73E−01 | 2 |
| LYM270 | 12871.7 | J | 0.031 | 8.11E−01 | 3 | LYM130 | 12333.1 | H | 10.353 | 7.92E−01 | 6.4 |
| LYM223 | 12674.2 | J | 0.031 | 9.08E−01 | 1.6 | LYM287 | 12773.7 | H | 10.34 | 8.02E−01 | 6.2 |
| LYM207 | 13251.5 | J | 0.031 | 9.50E−01 | 0.8 | LYM183 | 12993.7 | H | 10.225 | 8.25E−01 | 5 |
| CONTROL | — | J | 0.03 | — | 0 | LYM183 | 12994.7 | H | 9.924 | 8.96E−01 | 2 |
| LYM207 | 13251.5 | K | 0.594 | 5.66E−02 | 26.1 | LYM212 | 13034.9 | H | 10.157 | 9.25E−01 | 4.4 |
| LYM165 | 12973.6 | K | 0.578 | 9.58E−02 | 22.8 | LYM208 | 13012.5 | H | 9.992 | 9.35E−01 | 2.7 |
| LYM203 | 12664.1 | K | 0.575 | 1.28E−01 | 22.2 | CONTROL | — | H | 9.733 | — | 0 |
| LYM203 | 12662.3 | K | 0.564 | 1.31E−01 | 19.8 | LYM138 | 12561.1 | J | 0.044 | 0.00E+00 | 114 |
| LYM220 | 12851.7 | K | 0.543 | 2.71E−01 | 15.2 | LYM119 | 12461.1 | J | 0.037 | 1.00E−06 | 76.2 |
| LYM207 | 13251.6 | K | 0.536 | 3.18E−01 | 13.9 | LYM138 | 12561.3 | J | 0.035 | 5.00E−06 | 69.7 |
| LYM212 | 13034.9 | K | 0.53 | 3.55E−01 | 12.6 | LYM174 | 12414.3 | J | 0.036 | 1.20E−05 | 71.7 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM212 | 13034.8 | K | 0.533 | 3.98E−01 | 13.1 | LYM119 | 12461.4 | J | 0.034 | 1.30E−05 | 64.1 |
| LYM165 | 12974.5 | K | 0.522 | 4.02E−01 | 10.8 | LYM119 | 12463.2 | J | 0.034 | 1.90E−05 | 64.3 |
| LYM165 | 12973.8 | K | 0.522 | 4.55E−01 | 10.8 | LYM107 | 12632.3 | J | 0.034 | 7.40E−05 | 63 |
| LYM223 | 12672.5 | K | 0.513 | 5.04E−01 | 8.9 | LYM106 | 12142.2 | J | 0.034 | 1.01E−04 | 65.8 |
| LYM142 | 12804.1 | K | 0.514 | 5.15E−01 | 9.2 | LYM153 | 12324.1 | J | 0.033 | 1.07E−04 | 60.5 |
| LYM223 | 12671.2 | K | 0.512 | 5.28E−01 | 8.8 | LYM153 | 12323.2 | J | 0.032 | 1.80E−04 | 53.5 |
| LYM242 | 13054.9 | K | 0.504 | 6.16E−01 | 7.1 | LYM137 | 12151.4 | J | 0.031 | 1.99E−04 | 50.4 |
| LYM212 | 13032.8 | K | 0.501 | 6.28E−01 | 6.4 | LYM220 | 12851.8 | J | 0.032 | 2.34E−04 | 54.5 |
| LYM223 | 12674.5 | K | 0.496 | 6.88E−01 | 5.3 | LYM130 | 12332.1 | J | 0.031 | 2.64E−04 | 50.1 |
| LYM212 | 13033.6 | K | 0.489 | 7.67E−01 | 4 | LYM174 | 12411.3 | J | 0.034 | 3.59E−04 | 63.7 |
| LYM165 | 12972.6 | K | 0.491 | 7.69E−01 | 4.3 | LYM105 | 12293.1 | J | 0.031 | 6.37E−04 | 49.9 |
| LYM203 | 12663.2 | K | 0.488 | 7.77E−01 | 3.6 | LYM174 | 12412.1 | J | 0.032 | 8.23E−04 | 51.7 |
| LYM142 | 12804.4 | K | 0.48 | 8.75E−01 | 2 | LYM105 | 12295.2 | J | 0.031 | 1.04E−03 | 48 |
| LYM207 | 13252.2 | K | 0.479 | 8.90E−01 | 1.8 | LYM289 | 12493.1 | J | 0.03 | 1.42E−03 | 44.8 |
| LYM242 | 13051.8 | K | 0.479 | 8.95E−01 | 1.7 | LYM255 | 13082.5 | J | 0.032 | 1.50E−03 | 56.1 |
| LYM142 | 12801.8 | K | 0.479 | 9.03E−01 | 1.7 | LYM153 | 12324.2 | J | 0.03 | 1.83E−03 | 45.6 |
| LYM270 | 12872.5 | K | 0.479 | 9.09E−01 | 1.7 | LYM106 | 12144.4 | J | 0.029 | 1.94E−03 | 40.2 |
| LYM212 | 13032.6 | K | 0.477 | 9.20E−01 | 1.4 | LYM102 | 12222.1 | J | 0.029 | 2.58E−03 | 41.7 |
| LYM207 | 13251.4 | K | 0.477 | 9.26E−01 | 1.2 | LYM288 | 12743.5 | J | 0.03 | 2.77E−03 | 46 |
| LYM220 | 12851.13 | K | 0.477 | 9.27E−01 | 1.2 | LYM105 | 12294.2 | J | 0.029 | 3.58E−03 | 39 |
| LYM142 | 12803.6 | K | 0.476 | 9.37E−01 | 1.1 | LYM174 | 12411.2 | J | 0.03 | 3.72E−03 | 44.5 |
| CONTROL | — | K | 0.471 | — | 0 | LYM137 | 12151.1 | J | 0.029 | 3.78E−03 | 38.1 |
| LYM203 | 12662.3 | L | 2.454 | 6.01E−04 | 67.5 | LYM119 | 12462.1 | J | 0.03 | 3.98E−03 | 43.3 |
| LYM165 | 12973.6 | L | 2.138 | 6.78E−03 | 45.9 | LYM288 | 12743.9 | J | 0.029 | 4.98E−03 | 37.8 |
| LYM165 | 12974.5 | L | 2.15 | 1.34E−02 | 46.8 | LYM152 | 12371.2 | J | 0.031 | 5.43E−03 | 50.5 |
| LYM142 | 12804.4 | L | 1.961 | 3.94E−02 | 33.9 | LYM138 | 12562.2 | J | 0.029 | 5.54E−03 | 38.3 |
| LYM165 | 12972.6 | L | 1.948 | 5.24E−02 | 33 | LYM137 | 12151.2 | J | 0.028 | 6.64E−03 | 36.8 |
| LYM212 | 13034.9 | L | 1.862 | 9.49E−02 | 27.2 | LYM173 | 12981.6 | J | 0.028 | 7.33E−03 | 34.4 |
| LYM212 | 13034.8 | L | 1.905 | 9.76E−02 | 30 | LYM270 | 12873.6 | J | 0.028 | 7.96E−03 | 36.4 |
| LYM165 | 12973.8 | L | 1.832 | 1.21E−01 | 25.1 | LYM255 | 13082.8 | J | 0.028 | 8.97E−03 | 35.1 |
| LYM207 | 13251.6 | L | 1.819 | 1.25E−01 | 24.2 | LYM119 | 12462.2 | J | 0.029 | 1.07E−02 | 37.4 |
| LYM203 | 12664.1 | L | 1.796 | 1.54E−01 | 22.6 | LYM255 | 13082.7 | J | 0.029 | 1.24E−02 | 37.2 |
| LYM212 | 13032.8 | L | 1.807 | 1.78E−01 | 23.3 | LYM212 | 13032.8 | J | 0.027 | 1.37E−02 | 31.2 |
| LYM242 | 13051.8 | L | 1.792 | 1.99E−01 | 22.3 | LYM153 | 12321.2 | J | 0.027 | 1.78E−02 | 31.6 |
| LYM242 | 13054.9 | L | 1.709 | 3.00E−01 | 16.7 | LYM105 | 12297.2 | J | 0.027 | 1.78E−02 | 30.6 |
| LYM207 | 13251.4 | L | 1.685 | 3.34E−01 | 15 | LYM111 | 12252.2 | J | 0.027 | 2.00E−02 | 31.9 |
| LYM220 | 12851.7 | L | 1.652 | 4.23E−01 | 12.8 | LYM130 | 12334.1 | J | 0.026 | 2.61E−02 | 26.9 |
| LYM142 | 12802.9 | L | 1.618 | 5.12E−01 | 10.5 | LYM106 | 12144.3 | J | 0.027 | 2.82E−02 | 30.8 |
| LYM165 | 12973.5 | L | 1.595 | 5.81E−01 | 8.9 | LYM289 | 12493.2 | J | 0.028 | 3.23E−02 | 34.8 |
| LYM207 | 13251.5 | L | 1.589 | 5.87E−01 | 8.5 | LYM137 | 12153.1 | J | 0.026 | 3.50E−02 | 26.5 |
| LYM142 | 12804.3 | L | 1.581 | 6.12E−01 | 7.9 | LYM152 | 12373.1 | J | 0.026 | 3.60E−02 | 26.5 |
| LYM142 | 12801.8 | L | 1.568 | 6.52E−01 | 7.1 | LYM197 | 12821.6 | J | 0.026 | 3.74E−02 | 25.9 |
| LYM220 | 12851.11 | L | 1.564 | 6.64E−01 | 6.7 | LYM130 | 12332.2 | J | 0.026 | 4.55E−02 | 27.4 |
| LYM142 | 12804.1 | L | 1.55 | 7.25E−01 | 5.8 | LYM90 | 12395.3 | J | 0.026 | 4.79E−02 | 25.8 |
| LYM203 | 12664.2 | L | 1.524 | 7.99E−01 | 4.1 | LYM288 | 12743.8 | J | 0.026 | 5.52E−02 | 24.7 |
| LYM223 | 12674.2 | L | 1.508 | 8.52E−01 | 3 | LYM287 | 12771.6 | J | 0.026 | 5.89E−02 | 23.5 |
| LYM242 | 13053.7 | L | 1.491 | 9.09E−01 | 1.8 | LYM201 | 12833.7 | J | 0.025 | 6.60E−02 | 22.3 |
| LYM270 | 12871.7 | L | 1.471 | 9.76E−01 | 0.5 | LYM102 | 12222.3 | J | 0.026 | 7.07E−02 | 22.7 |
| LYM203 | 12663.2 | L | 1.467 | 9.91E−01 | 0.2 | LYM173 | 12981.5 | J | 0.026 | 7.84E−02 | 23.1 |
| CONTROL | — | L | 1.465 | — | 0 | LYM291 | 12754.9 | J | 0.026 | 8.08E−02 | 26.4 |
| LYM203 | 12662.3 | M | 0.307 | 6.02E−04 | 65.1 | LYM111 | 12254.4 | J | 0.025 | 8.41E−02 | 22 |
| LYM165 | 12973.6 | M | 0.267 | 7.02E−03 | 43.8 | LYM130 | 12331.3 | J | 0.027 | 8.47E−02 | 31 |
| LYM165 | 12974.5 | M | 0.269 | 1.43E−02 | 44.6 | LYM153 | 12322.1 | J | 0.025 | 1.13E−01 | 19.3 |
| LYM142 | 12804.4 | M | 0.245 | 4.25E−02 | 31.9 | LYM102 | 12221.1 | J | 0.025 | 1.20E−01 | 20 |
| LYM165 | 12972.6 | M | 0.244 | 5.69E−02 | 31 | LYM107 | 12631.4 | J | 0.025 | 1.20E−01 | 20.2 |
| LYM212 | 13034.9 | M | 0.233 | 1.04E−01 | 25.3 | LYM143 | 12524.7 | J | 0.026 | 1.22E−01 | 26.9 |
| LYM212 | 13034.8 | M | 0.238 | 1.07E−01 | 28.1 | LYM102 | 12222.1 | J | 0.025 | 1.30E−01 | 19.7 |
| LYM165 | 12973.8 | M | 0.229 | 1.33E−01 | 23.2 | LYM183 | 12994.8 | J | 0.026 | 1.32E−01 | 24.3 |
| LYM207 | 13251.6 | M | 0.227 | 1.38E−01 | 22.4 | LYM107 | 12631.2 | J | 0.025 | 1.38E−01 | 18.9 |
| LYM203 | 12664.1 | M | 0.224 | 1.69E−01 | 20.8 | LYM288 | 12741.9 | J | 0.025 | 1.56E−01 | 19.2 |
| LYM212 | 13032.8 | M | 0.226 | 1.96E−01 | 21.5 | LYM212 | 13031.6 | J | 0.024 | 1.70E−01 | 16.3 |
| LYM242 | 13051.8 | M | 0.224 | 2.19E−01 | 20.5 | LYM137 | 12154.5 | J | 0.026 | 1.75E−01 | 22.8 |
| LYM242 | 13054.9 | M | 0.214 | 3.31E−01 | 14.9 | LYM289 | 12492.2 | J | 0.025 | 1.76E−01 | 20.6 |
| LYM207 | 13251.4 | M | 0.211 | 3.69E−01 | 13.3 | LYM152 | 12371.3 | J | 0.025 | 1.77E−01 | 20.4 |
| LYM220 | 12851.7 | M | 0.206 | 4.66E−01 | 11.1 | LYM138 | 12564.1 | J | 0.025 | 1.84E−01 | 19 |
| LYM142 | 12802.9 | M | 0.202 | 5.62E−01 | 8.9 | LYM242 | 13051.8 | J | 0.024 | 1.87E−01 | 17.1 |
| LYM165 | 12973.5 | M | 0.199 | 6.37E−01 | 7.3 | LYM105 | 12294.3 | J | 0.024 | 1.91E−01 | 16.8 |
| LYM207 | 13251.5 | M | 0.199 | 6.45E−01 | 6.9 | LYM106 | 12141.4 | J | 0.024 | 1.95E−01 | 16.3 |
| LYM142 | 12804.3 | M | 0.198 | 6.72E−01 | 6.3 | LYM255 | 13082.9 | J | 0.024 | 2.05E−01 | 16.4 |
| LYM142 | 12801.8 | M | 0.196 | 7.14E−01 | 5.5 | LYM130 | 12333.1 | J | 0.024 | 2.15E−01 | 16.4 |
| LYM220 | 12851.11 | M | 0.195 | 7.28E−01 | 5.2 | LYM142 | 12802.9 | J | 0.024 | 2.26E−01 | 17.3 |
| LYM142 | 12804.1 | M | 0.194 | 7.89E−01 | 4.3 | LYM242 | 13052.5 | J | 0.024 | 2.31E−01 | 14.8 |
| LYM203 | 12664.2 | M | 0.191 | 8.68E−01 | 2.5 | LYM107 | 12631.1 | J | 0.024 | 2.35E−01 | 15.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM223 | 12674.2 | M | 0.188 | 9.25E−01 | 1.4 | LYM183 | 12993.5 | J | 0.024 | 2.40E−01 | 15.5 |
| LYM242 | 13053.7 | M | 0.186 | 9.85E−01 | 0.3 | LYM201 | 12834.6 | J | 0.024 | 2.60E−01 | 13.6 |
| CONTROL | — | M | 0.186 | — | 0 | LYM183 | 12993.7 | J | 0.024 | 2.63E−01 | 15.1 |
| LYM203 | 12662.3 | N | 0.264 | 3.40E−02 | 25.7 | LYM106 | 12142.3 | J | 0.024 | 3.01E−01 | 13.1 |
| LYM165 | 12973.6 | N | 0.252 | 7.08E−02 | 19.8 | LYM212 | 13034.9 | J | 0.024 | 3.25E−01 | 17.3 |
| LYM207 | 13251.6 | N | 0.239 | 2.15E−01 | 13.5 | LYM107 | 12632.1 | J | 0.023 | 3.27E−01 | 13 |
| LYM165 | 12974.5 | N | 0.245 | 2.21E−01 | 16.6 | LYM102 | 12222.6 | J | 0.023 | 3.49E−01 | 12.4 |
| LYM203 | 12664.1 | N | 0.236 | 2.76E−01 | 12.4 | LYM143 | 12524.5 | J | 0.024 | 3.52E−01 | 15.7 |
| LYM165 | 12972.6 | N | 0.238 | 2.78E−01 | 13.2 | LYM291 | 12753.6 | J | 0.023 | 3.61E−01 | 12.4 |
| LYM212 | 13034.9 | N | 0.235 | 2.89E−01 | 11.8 | LYM198 | 13005.8 | J | 0.023 | 3.80E−01 | 10.4 |
| LYM212 | 13034.8 | N | 0.238 | 2.99E−01 | 13.2 | LYM287 | 12771.7 | J | 0.023 | 4.35E−01 | 9.5 |
| LYM142 | 12804.4 | N | 0.227 | 4.59E−01 | 8 | LYM201 | 12833.9 | J | 0.023 | 4.54E−01 | 9.4 |
| LYM165 | 12973.8 | N | 0.222 | 6.03E−01 | 5.6 | LYM142 | 12804.3 | J | 0.023 | 4.60E−01 | 11.2 |
| LYM242 | 13053.7 | N | 0.222 | 6.06E−01 | 5.7 | LYM270 | 12871.7 | J | 0.023 | 4.62E−01 | 9.4 |
| LYM142 | 12804.1 | N | 0.223 | 6.06E−01 | 5.9 | LYM142 | 12801.8 | J | 0.023 | 4.62E−01 | 9 |
| LYM142 | 12802.9 | N | 0.22 | 6.96E−01 | 4.3 | LYM287 | 12773.7 | J | 0.023 | 4.62E−01 | 10.2 |
| LYM242 | 13051.8 | N | 0.218 | 7.46E−01 | 3.8 | LYM289 | 12491.4 | J | 0.023 | 4.64E−01 | 8.6 |
| LYM270 | 12871.7 | N | 0.218 | 7.46E−01 | 3.5 | LYM173 | 12982.7 | J | 0.023 | 4.68E−01 | 11.3 |
| LYM165 | 12973.5 | N | 0.217 | 7.75E−01 | 3.3 | LYM208 | 13012.5 | J | 0.023 | 4.71E−01 | 12.1 |
| LYM220 | 12851.7 | N | 0.217 | 7.88E−01 | 3.1 | LYM44 | 11885.4 | J | 0.022 | 5.57E−01 | 7.6 |
| LYM212 | 13032.8 | N | 0.217 | 7.96E−01 | 3 | LYM105 | 12297.1 | J | 0.022 | 5.76E−01 | 7.3 |
| LYM242 | 13054.9 | N | 0.213 | 9.14E−01 | 1.2 | LYM270 | 12871.8 | J | 0.022 | 5.94E−01 | 7.6 |
| LYM207 | 13251.4 | N | 0.213 | 9.16E−01 | 1.1 | LYM255 | 13081.5 | J | 0.022 | 5.99E−01 | 8 |
| LYM203 | 12664.2 | N | 0.213 | 9.31E−01 | 1 | LYM270 | 12871.5 | J | 0.023 | 6.13E−01 | 9.1 |
| LYM142 | 12804.3 | N | 0.212 | 9.52E−01 | 0.6 | LYM111 | 12251.1 | J | 0.022 | 6.31E−01 | 5.9 |
| LYM203 | 12663.2 | N | 0.211 | 9.76E−01 | 0.3 | LYM289 | 12491.1 | J | 0.022 | 6.50E−01 | 5.6 |
| LYM220 | 12851.11 | N | 0.211 | 9.90E−01 | 0.1 | LYM242 | 13053.7 | J | 0.022 | 6.73E−01 | 5.4 |
| CONTROL | — | N | 0.21 | — | 0 | LYM183 | 12994.7 | J | 0.022 | 7.41E−01 | 4.1 |
| LYM165 | 12973.6 | O | 2.12 | 1.10E−03 | 43.2 | LYM270 | 12872.7 | J | 0.022 | 7.82E−01 | 3.7 |
| LYM165 | 12973.8 | O | 1.847 | 4.09E−03 | 24.8 | LYM197 | 12824.4 | J | 0.021 | 7.94E−01 | 3.2 |
| LYM207 | 13251.6 | O | 1.791 | 3.64E−02 | 20.9 | LYM287 | 12774.6 | J | 0.022 | 7.96E−01 | 3.5 |
| LYM142 | 12804.4 | O | 1.949 | 4.00E−02 | 31.6 | LYM173 | 12982.6 | J | 0.021 | 8.19E−01 | 2.9 |
| LYM203 | 12664.1 | O | 1.761 | 6.02E−02 | 18.9 | LYM208 | 13013.6 | J | 0.021 | 8.22E−01 | 3 |
| LYM212 | 13034.9 | O | 1.874 | 1.12E−01 | 26.6 | LYM100 | 12131.3 | J | 0.021 | 8.23E−01 | 2.8 |
| LYM203 | 12662.3 | O | 2.416 | 1.58E−01 | 63.2 | LYM143 | 12521.2 | J | 0.021 | 8.76E−01 | 2 |
| LYM165 | 12972.6 | O | 1.952 | 2.19E−01 | 31.8 | LYM143 | 12523.4 | J | 0.021 | 8.78E−01 | 2.7 |
| LYM207 | 13251.5 | O | 1.59 | 2.62E−01 | 7.4 | LYM212 | 13034.8 | J | 0.021 | 8.79E−01 | 1.9 |
| LYM220 | 12851.7 | O | 1.627 | 2.95E−01 | 9.9 | LYM198 | 13004.6 | J | 0.021 | 8.86E−01 | 1.7 |
| LYM207 | 13251.4 | O | 1.653 | 3.18E−01 | 11.6 | LYM143 | 12521.1 | J | 0.021 | 9.11E−01 | 1.3 |
| LYM165 | 12974.5 | O | 2.142 | 3.19E−01 | 44.7 | LYM291 | 12751.2 | J | 0.021 | 9.32E−01 | 1 |
| LYM220 | 12851.11 | O | 1.567 | 3.79E−01 | 5.8 | LYM100 | 12133.3 | J | 0.021 | 9.61E−01 | 0.6 |
| LYM212 | 13034.8 | O | 1.896 | 4.48E−01 | 28.1 | LYM152 | 12372.2 | J | 0.021 | 9.80E−01 | 0.3 |
| LYM212 | 13032.8 | O | 1.813 | 4.49E−01 | 22.4 | LYM208 | 13012.8 | J | 0.021 | 9.84E−01 | 0.3 |
| LYM142 | 12801.8 | O | 1.604 | 5.02E−01 | 8.3 | CONTROL | — | J | 0.021 | — | 0 |
| LYM242 | 13054.9 | O | 1.688 | 5.03E−01 | 14 | LYM288 | 12741.9 | K | 0.713 | 2.72E−01 | 13.6 |
| LYM142 | 12802.9 | O | 1.604 | 5.24E−01 | 8.3 | LYM119 | 12462.2 | K | 0.706 | 3.08E−01 | 12.4 |
| LYM242 | 13051.8 | O | 1.802 | 5.42E−01 | 21.7 | LYM289 | 12493.1 | K | 0.704 | 3.13E−01 | 12.1 |
| LYM142 | 12804.3 | O | 1.561 | 6.15E−01 | 5.4 | LYM142 | 12804.1 | K | 0.695 | 3.86E−01 | 10.7 |
| LYM165 | 12973.5 | O | 1.578 | 6.95E−01 | 6.6 | LYM44 | 11882.1 | K | 0.695 | 3.88E−01 | 10.7 |
| LYM223 | 12674.2 | O | 1.496 | 8.67E−01 | 1 | LYM143 | 12524.7 | K | 0.688 | 4.41E−01 | 9.5 |
| LYM142 | 12804.1 | O | 1.541 | 8.75E−01 | 4.1 | LYM61 | 13174.7 | K | 0.695 | 4.79E−01 | 10.7 |
| LYM203 | 12664.2 | O | 1.51 | 9.11E−01 | 2 | LYM119 | 12461.4 | K | 0.676 | 5.05E−01 | 7.6 |
| CONTROL | — | O | 1.481 | — | 0 | LYM137 | 12154.5 | K | 0.675 | 5.37E−01 | 7.5 |
| LYM165 | 12973.6 | P | 2.643 | 2.53E−03 | 17.9 | LYM61 | 13174.5 | K | 0.675 | 5.82E−01 | 7.5 |
| LYM207 | 13251.6 | P | 2.525 | 1.43E−02 | 12.6 | LYM183 | 12994.7 | K | 0.665 | 6.12E−01 | 5.9 |
| LYM165 | 12973.8 | P | 2.472 | 3.44E−02 | 10.2 | LYM102 | 12222.3 | K | 0.663 | 6.21E−01 | 5.6 |
| LYM203 | 12662.3 | P | 2.9 | 8.02E−02 | 29.3 | LYM174 | 12414.3 | K | 0.663 | 6.23E−01 | 5.6 |
| LYM142 | 12804.4 | P | 2.42 | 1.34E−01 | 7.9 | LYM220 | 12851.8 | K | 0.657 | 6.76E−01 | 4.7 |
| LYM207 | 13251.4 | P | 2.389 | 1.67E−01 | 6.5 | LYM255 | 13082.7 | K | 0.657 | 6.95E−01 | 4.7 |
| LYM203 | 12664.1 | P | 2.478 | 3.11E−01 | 10.5 | LYM289 | 12493.2 | K | 0.653 | 7.43E−01 | 4 |
| LYM212 | 13034.9 | P | 2.45 | 3.23E−01 | 9.2 | LYM198 | 13005.8 | K | 0.65 | 7.67E−01 | 3.5 |
| LYM165 | 12972.6 | P | 2.558 | 3.80E−01 | 14.1 | LYM111 | 12252.2 | K | 0.649 | 7.68E−01 | 3.3 |
| LYM270 | 12871.7 | P | 2.314 | 4.47E−01 | 3.2 | LYM90 | 12395.1 | K | 0.65 | 7.75E−01 | 3.5 |
| LYM212 | 13032.8 | P | 2.37 | 4.77E−01 | 5.7 | LYM242 | 13052.5 | K | 0.649 | 7.83E−01 | 3.3 |
| LYM165 | 12974.5 | P | 2.607 | 4.77E−01 | 16.2 | LYM289 | 12491.1 | K | 0.647 | 7.89E−01 | 3 |
| LYM242 | 13051.8 | P | 2.422 | 4.96E−01 | 8 | LYM153 | 12322.1 | K | 0.645 | 8.11E−01 | 2.7 |
| LYM212 | 13034.8 | P | 2.57 | 5.11E−01 | 14.6 | LYM105 | 12297.2 | K | 0.644 | 8.23E−01 | 2.7 |
| LYM242 | 13054.9 | P | 2.358 | 6.45E−01 | 5.1 | LYM44 | 11885.3 | K | 0.643 | 8.28E−01 | 2.5 |
| LYM142 | 12802.9 | P | 2.286 | 6.67E−01 | 1.9 | LYM102 | 12222.6 | K | 0.643 | 8.39E−01 | 2.5 |
| LYM165 | 12973.5 | P | 2.315 | 7.84E−01 | 3.2 | LYM288 | 12744.7 | K | 0.643 | 8.42E−01 | 2.5 |
| LYM203 | 12664.2 | P | 2.28 | 8.53E−01 | 1.7 | LYM291 | 12754.9 | K | 0.643 | 8.48E−01 | 2.5 |
| LYM142 | 12804.1 | P | 2.276 | 8.85E−01 | 1.5 | LYM107 | 12631.4 | K | 0.641 | 8.56E−01 | 2.1 |
| LYM220 | 12851.7 | P | 2.26 | 9.04E−01 | 0.8 | LYM291 | 12751.7 | K | 0.64 | 8.64E−01 | 2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM270 | 12872.7 | P | 2.25 | 9.41E-01 | 0.3 | LYM288 | 12743.9 | K | 0.64 | 8.66E-01 | 2 |
| LYM142 | 12804.3 | P | 2.245 | 9.83E-01 | 0.1 | LYM174 | 12414.2 | K | 0.64 | 8.72E-01 | 2 |
| CONTROL | — | P | 2.243 | — | 0 | LYM90 | 12392.1 | K | 0.64 | 8.76E-01 | 1.9 |
| LYM4 | 11701.1 | A | 93.653 | 1.73E-03 | 4 | LYM143 | 12523.4 | K | 0.641 | 8.77E-01 | 2.1 |
| LYM21 | 11672.4 | A | 93.589 | 1.90E-03 | 3.9 | LYM111 | 12251.3 | K | 0.639 | 8.79E-01 | 1.8 |
| LYM162 | 12231.3 | A | 93.4 | 2.63E-03 | 3.7 | LYM102 | 12221.1 | K | 0.636 | 9.12E-01 | 1.3 |
| LYM1 | 11602.6 | A | 93.352 | 2.88E-03 | 3.7 | LYM102 | 12221.2 | K | 0.633 | 9.47E-01 | 0.8 |
| LYM4 | 11702.3 | A | 93.289 | 3.25E-03 | 3.6 | LYM174 | 12412.1 | K | 0.631 | 9.60E-01 | 0.6 |
| LYM129 | 12571.3 | A | 93.281 | 3.37E-03 | 3.6 | LYM255 | 13082.8 | K | 0.63 | 9.70E-01 | 0.4 |
| LYM2 | 11692.3 | A | 93.197 | 3.86E-03 | 3.5 | LYM137 | 12152.1 | K | 0.629 | 9.82E-01 | 0.3 |
| LYM2 | 11695.3 | A | 93.169 | 4.02E-03 | 3.5 | LYM44 | 11884.1 | K | 0.628 | 9.94E-01 | 0.1 |
| LYM174 | 12411.2 | A | 93.189 | 4.79E-03 | 3.5 | CONTROL | — | K | 0.628 | — | 0 |
| LYM129 | 12573.5 | A | 93.264 | 5.07E-03 | 3.6 | LYM138 | 12561.1 | L | 2.7 | 0.00E+00 | 124.8 |
| LYM9 | 11632.2 | A | 92.963 | 5.75E-03 | 3.2 | LYM174 | 12414.3 | L | 2.075 | 1.50E-05 | 72.8 |
| LYM9 | 11634.5 | A | 92.788 | 8.06E-03 | 3 | LYM138 | 12561.3 | L | 2.062 | 2.00E-05 | 71.7 |
| LYM1 | 11602.1 | A | 92.634 | 1.10E-02 | 2.9 | LYM119 | 12461.4 | L | 2.016 | 4.40E-05 | 67.8 |
| LYM17 | 11684.5 | A | 92.539 | 1.23E-02 | 2.8 | LYM119 | 12461.1 | L | 1.978 | 1.02E-04 | 64.7 |
| LYM111 | 12251.3 | A | 92.44 | 1.48E-02 | 2.6 | LYM130 | 12332.1 | L | 1.895 | 1.67E-04 | 57.8 |
| LYM162 | 12234.4 | A | 92.526 | 1.48E-02 | 2.7 | LYM106 | 12142.2 | L | 1.969 | 3.33E-04 | 63.9 |
| LYM4 | 11706.5 | A | 92.404 | 1.58E-02 | 2.6 | LYM119 | 12463.2 | L | 1.884 | 4.03E-04 | 56.8 |
| LYM130 | 12333.1 | A | 92.728 | 1.74E-02 | 3 | LYM220 | 12851.8 | L | 1.88 | 5.61E-04 | 56.5 |
| LYM143 | 12521.1 | A | 92.355 | 1.77E-02 | 2.5 | LYM174 | 12411.3 | L | 1.931 | 8.78E-04 | 60.7 |
| LYM289 | 12491.4 | A | 92.293 | 1.95E-02 | 2.5 | LYM174 | 12412.1 | L | 1.831 | 1.48E-03 | 52.4 |
| LYM143 | 12523.4 | A | 92.243 | 2.22E-02 | 2.4 | LYM289 | 12493.1 | L | 1.805 | 1.50E-03 | 50.2 |
| LYM130 | 12331.3 | A | 92.67 | 2.48E-02 | 2.9 | LYM107 | 12632.3 | L | 1.799 | 2.47E-03 | 49.7 |
| LYM4 | 11706.3 | A | 92.134 | 2.66E-02 | 2.3 | LYM153 | 12323.2 | L | 1.781 | 2.51E-03 | 48.2 |
| LYM290 | 12502.1 | A | 93.971 | 2.67E-02 | 4.3 | LYM153 | 12324.1 | L | 1.798 | 2.61E-03 | 49.7 |
| LYM17 | 11683.1 | A | 93.189 | 2.71E-02 | 3.5 | LYM119 | 12462.1 | L | 1.78 | 5.10E-03 | 48.1 |
| LYM17 | 11681.4 | A | 92.382 | 2.78E-02 | 2.6 | LYM288 | 12743.9 | L | 1.704 | 5.72E-03 | 41.9 |
| LYM132 | 12275.1 | A | 92.086 | 2.93E-02 | 2.2 | LYM255 | 13082.5 | L | 1.826 | 5.79E-03 | 52 |
| LYM268 | 12482.3 | A | 92.799 | 3.40E-02 | 3 | LYM255 | 13082.8 | L | 1.687 | 7.22E-03 | 40.4 |
| LYM143 | 12524.7 | A | 92.003 | 3.43E-02 | 2.2 | LYM288 | 12743.5 | L | 1.745 | 8.60E-03 | 45.3 |
| LYM16 | 11623.5 | A | 91.994 | 3.52E-02 | 2.1 | LYM255 | 13082.7 | L | 1.719 | 1.08E-02 | 43.1 |
| LYM100 | 12131.3 | A | 93.235 | 3.92E-02 | 3.5 | LYM153 | 12324.2 | L | 1.661 | 1.28E-02 | 38.3 |
| LYM141 | 12404.3 | A | 92.279 | 3.95E-02 | 2.5 | LYM119 | 12462.2 | L | 1.705 | 1.33E-02 | 42 |
| LYM9 | 11633.7 | A | 91.968 | 4.61E-02 | 2.1 | LYM102 | 12222.2 | L | 1.642 | 1.38E-02 | 36.7 |
| LYM16 | 11623.2 | A | 91.948 | 4.62E-02 | 2.1 | LYM152 | 12371.2 | L | 1.732 | 1.45E-02 | 44.2 |
| LYM113 | 12441.4 | A | 91.832 | 4.82E-02 | 2 | LYM105 | 12293.1 | L | 1.648 | 1.48E-02 | 37.1 |
| LYM16 | 11622.2 | A | 91.795 | 5.19E-02 | 1.9 | LYM137 | 12151.4 | L | 1.625 | 1.60E-02 | 35.3 |
| LYM289 | 12491.1 | A | 92.554 | 5.47E-02 | 2.8 | LYM174 | 12411.2 | L | 1.651 | 1.70E-02 | 37.4 |
| LYM174 | 12414.2 | A | 91.886 | 5.60E-02 | 2 | LYM289 | 12493.2 | L | 1.715 | 1.88E-02 | 42.8 |
| LYM15 | 11612.3 | A | 92.3 | 6.55E-02 | 2.5 | LYM106 | 12144.4 | L | 1.588 | 2.45E-02 | 32.2 |
| LYM143 | 12521.2 | A | 92.339 | 6.73E-02 | 2.5 | LYM105 | 12295.2 | L | 1.594 | 2.68E-02 | 32.7 |
| LYM22 | 11762.2 | A | 92.049 | 7.65E-02 | 2.2 | LYM105 | 12297.2 | L | 1.591 | 2.80E-02 | 32.4 |
| LYM148 | 12173.1 | A | 93.623 | 7.77E-02 | 4 | LYM130 | 12332.2 | L | 1.585 | 2.81E-02 | 31.9 |
| LYM268 | 12483.4 | A | 92.11 | 7.91E-02 | 2.3 | LYM130 | 12334.1 | L | 1.57 | 2.87E-02 | 30.7 |
| LYM153 | 12323.2 | A | 92.018 | 8.66E-02 | 2.2 | LYM270 | 12873.6 | L | 1.558 | 4.30E-02 | 29.7 |
| LYM129 | 12572.4 | A | 95.426 | 8.79E-02 | 6 | LYM111 | 12252.2 | L | 1.56 | 4.53E-02 | 29.8 |
| LYM152 | 12373.1 | A | 92.994 | 9.17E-02 | 3.3 | LYM153 | 12321.2 | L | 1.566 | 4.59E-02 | 30.4 |
| LYM16 | 11624.6 | A | 91.607 | 9.39E-02 | 1.7 | LYM137 | 12151.1 | L | 1.548 | 4.97E-02 | 28.8 |
| LYM111 | 12251.2 | A | 91.531 | 9.51E-02 | 1.6 | LYM137 | 12151.2 | L | 1.543 | 6.15E-02 | 28.5 |
| LYM102 | 12222.3 | A | 91.611 | 1.04E-01 | 1.7 | LYM105 | 12294.2 | L | 1.502 | 7.39E-02 | 25.1 |
| LYM152 | 12371.3 | A | 91.465 | 1.08E-01 | 1.6 | LYM106 | 12144.3 | L | 1.531 | 7.99E-02 | 27.4 |
| LYM105 | 12293.1 | A | 92.855 | 1.10E-01 | 3.1 | LYM138 | 12562.2 | L | 1.51 | 8.00E-02 | 25.7 |
| LYM148 | 12171.2 | A | 97.189 | 1.13E-01 | 7.9 | LYM291 | 12754.9 | L | 1.524 | 8.85E-02 | 26.8 |
| LYM3 | 12041.2 | A | 91.82 | 1.20E-01 | 2 | LYM130 | 12331.3 | L | 1.584 | 9.07E-02 | 31.9 |
| LYM290 | 12502.4 | A | 92.541 | 1.25E-01 | 2.8 | LYM137 | 12154.5 | L | 1.535 | 1.33E-01 | 27.8 |
| LYM22 | 11762.1 | A | 91.581 | 1.28E-01 | 1.7 | LYM143 | 12524.7 | L | 1.504 | 1.44E-01 | 25.2 |
| LYM268 | 12482.1 | A | 91.518 | 1.36E-01 | 1.6 | LYM289 | 12492.2 | L | 1.442 | 1.47E-01 | 20.1 |
| LYM3 | 12043.1 | A | 92.154 | 1.37E-01 | 2.3 | LYM102 | 12222.3 | L | 1.44 | 1.55E-01 | 19.8 |
| LYM111 | 12252.2 | A | 92.017 | 1.44E-01 | 2.2 | LYM288 | 12741.9 | L | 1.451 | 1.68E-01 | 20.8 |
| LYM138 | 12561.3 | A | 91.741 | 1.49E-01 | 1.9 | LYM173 | 12981.6 | L | 1.427 | 1.71E-01 | 18.8 |
| LYM148 | 12172.1 | A | 91.854 | 1.50E-01 | 2 | LYM137 | 12153.1 | L | 1.427 | 1.79E-01 | 18.8 |
| LYM15 | 11611.3 | A | 91.282 | 1.57E-01 | 1.4 | LYM138 | 12564.1 | L | 1.432 | 1.94E-01 | 19.2 |
| LYM134 | 12313.2 | A | 92.927 | 1.58E-01 | 3.2 | LYM90 | 12395.3 | L | 1.425 | 1.97E-01 | 18.6 |
| LYM141 | 12404.2 | A | 92.666 | 1.60E-01 | 2.9 | LYM152 | 12371.3 | L | 1.439 | 2.02E-01 | 19.8 |
| LYM15 | 11612.2 | A | 92.399 | 1.67E-01 | 2.6 | LYM212 | 13032.8 | L | 1.409 | 2.12E-01 | 17.3 |
| LYM138 | 12561.1 | A | 91.667 | 1.72E-01 | 1.8 | LYM288 | 12743.8 | L | 1.41 | 2.21E-01 | 17.4 |
| LYM10 | 11741.2 | A | 93.084 | 1.84E-01 | 3.4 | LYM111 | 12254.4 | L | 1.396 | 2.43E-01 | 16.2 |
| LYM2 | 11693.3 | A | 91.311 | 1.94E-01 | 1.4 | LYM197 | 12821.6 | L | 1.383 | 2.76E-01 | 15.1 |
| LYM13 | 11772.1 | A | 91.162 | 1.96E-01 | 1.2 | LYM242 | 13051.8 | L | 1.376 | 3.06E-01 | 14.6 |
| LYM152 | 12371.2 | A | 94.035 | 1.98E-01 | 4.4 | LYM107 | 12631.4 | L | 1.367 | 3.11E-01 | 13.8 |
| LYM141 | 12404.4 | A | 91.382 | 2.00E-01 | 1.5 | LYM242 | 13052.5 | L | 1.371 | 3.18E-01 | 14.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM268 | 12483.2 | A | 91.085 | 2.10E−01 | 1.1 | LYM153 | 12322.1 | L | 1.356 | 3.52E−01 | 12.8 |
| LYM290 | 12502.2 | A | 91.245 | 2.10E−01 | 1.3 | LYM106 | 12141.4 | L | 1.355 | 3.53E−01 | 12.8 |
| LYM132 | 12276.1 | A | 91.905 | 2.21E−01 | 2 | LYM152 | 12373.1 | L | 1.354 | 3.59E−01 | 12.7 |
| LYM130 | 12332.1 | A | 91.423 | 2.26E−01 | 1.5 | LYM107 | 12631.2 | L | 1.356 | 3.69E−01 | 12.9 |
| LYM137 | 12154.5 | A | 92.634 | 2.36E−01 | 2.9 | LYM107 | 12631.1 | L | 1.354 | 3.80E−01 | 12.7 |
| LYM141 | 12402.4 | A | 92.747 | 2.36E−01 | 3 | LYM102 | 12221.1 | L | 1.351 | 3.82E−01 | 12.4 |
| LYM13 | 11771.6 | A | 92.602 | 2.48E−01 | 2.8 | LYM183 | 12994.8 | L | 1.385 | 3.83E−01 | 15.3 |
| LYM15 | 11614.3 | A | 90.956 | 2.69E−01 | 1 | LYM105 | 12294.3 | L | 1.321 | 4.64E−01 | 10 |
| LYM22 | 11764.7 | A | 92.154 | 2.90E−01 | 2.3 | LYM173 | 12981.5 | L | 1.32 | 4.93E−01 | 9.9 |
| LYM132 | 12273.2 | A | 91.678 | 2.99E−01 | 1.8 | LYM289 | 12491.4 | L | 1.312 | 5.04E−01 | 9.2 |
| LYM119 | 12462.1 | A | 92.884 | 2.99E−01 | 3.1 | LYM102 | 12222.1 | L | 1.31 | 5.15E−01 | 9.1 |
| LYM9 | 11633.2 | A | 92.37 | 3.05E−01 | 2.6 | LYM255 | 13082.9 | L | 1.314 | 5.16E−01 | 9.4 |
| LYM1 | 11603.2 | A | 91.105 | 3.08E−01 | 1.2 | LYM143 | 12524.5 | L | 1.335 | 5.26E−01 | 11.1 |
| LYM17 | 11682.1 | A | 91.575 | 3.09E−01 | 1.7 | LYM289 | 12491.1 | L | 1.305 | 5.32E−01 | 8.6 |
| LYM19 | 11751.5 | A | 91.971 | 3.18E−01 | 2.1 | LYM142 | 12802.9 | L | 1.316 | 5.37E−01 | 9.5 |
| LYM10 | 11744.1 | A | 90.973 | 3.22E−01 | 1 | LYM100 | 12131.3 | L | 1.3 | 5.51E−01 | 8.2 |
| LYM119 | 12463.2 | A | 91.619 | 3.27E−01 | 1.7 | LYM102 | 12222.6 | L | 1.303 | 5.63E−01 | 8.5 |
| LYM16 | 11624.4 | A | 91.328 | 3.34E−01 | 1.4 | LYM287 | 12774.6 | L | 1.282 | 6.30E−01 | 6.7 |
| LYM141 | 12404.1 | A | 90.894 | 3.38E−01 | 0.9 | LYM130 | 12333.1 | L | 1.274 | 6.78E−01 | 6 |
| LYM19 | 11751.4 | A | 92.374 | 3.42E−01 | 2.6 | LYM198 | 13005.8 | L | 1.266 | 6.94E−01 | 5.4 |
| LYM17 | 11684.4 | A | 91.321 | 3.42E−01 | 1.4 | LYM183 | 12993.7 | L | 1.27 | 7.00E−01 | 5.7 |
| LYM174 | 12411.3 | A | 90.996 | 3.43E−01 | 1 | LYM106 | 12142.3 | L | 1.265 | 7.00E−01 | 5.3 |
| LYM105 | 12297.1 | A | 92.511 | 3.51E−01 | 2.7 | LYM183 | 12994.7 | L | 1.264 | 7.06E−01 | 5.3 |
| LYM152 | 12372.2 | A | 91.633 | 3.54E−01 | 1.7 | LYM201 | 12834.6 | L | 1.261 | 7.14E−01 | 5 |
| LYM153 | 12324.2 | A | 90.881 | 3.57E−01 | 0.9 | LYM291 | 12753.6 | L | 1.263 | 7.29E−01 | 5.1 |
| LYM289 | 12493.6 | A | 90.791 | 3.59E−01 | 0.8 | LYM287 | 12771.6 | L | 1.258 | 7.30E−01 | 4.7 |
| LYM130 | 12332.2 | A | 92.223 | 3.66E−01 | 2.4 | LYM287 | 12773.7 | L | 1.263 | 7.39E−01 | 5.1 |
| LYM10 | 11744.5 | A | 93.031 | 3.89E−01 | 3.3 | LYM212 | 13031.6 | L | 1.255 | 7.40E−01 | 4.4 |
| LYM143 | 12524.2 | A | 90.77 | 4.06E−01 | 0.8 | LYM44 | 11885.4 | L | 1.254 | 7.56E−01 | 4.4 |
| LYM106 | 12141.4 | A | 90.774 | 4.06E−01 | 0.8 | LYM212 | 13034.9 | L | 1.267 | 7.63E−01 | 5.5 |
| LYM21 | 11671.2 | A | 91.532 | 4.18E−01 | 1.6 | LYM173 | 12982.6 | L | 1.23 | 8.61E−01 | 2.4 |
| LYM290 | 12504.1 | A | 91.068 | 4.24E−01 | 1.1 | LYM201 | 12833.7 | L | 1.227 | 8.72E−01 | 2.2 |
| LYM111 | 12254.4 | A | 91.031 | 4.40E−01 | 1.1 | LYM44 | 11882.1 | L | 1.209 | 9.64E−01 | 0.7 |
| LYM119 | 12461.4 | A | 91.197 | 4.58E−01 | 1.3 | LYM208 | 13012.5 | L | 1.206 | 9.83E−01 | 0.4 |
| LYM21 | 11673.1 | A | 91.387 | 4.60E−01 | 1.5 | CONTROL | — | L | 1.201 | — | 0 |
| LYM140 | 12262.3 | A | 91.389 | 4.61E−01 | 1.5 | LYM138 | 12561.1 | M | 0.338 | 0.00E+00 | 124.8 |
| LYM148 | 12174.2 | A | 91.662 | 4.77E−01 | 1.8 | LYM174 | 12414.3 | M | 0.259 | 1.50E−05 | 72.8 |
| LYM111 | 12254.3 | A | 91.161 | 4.82E−01 | 1.2 | LYM138 | 12561.3 | M | 0.258 | 2.00E−05 | 71.7 |
| LYM138 | 12564.1 | A | 91.567 | 4.91E−01 | 1.7 | LYM119 | 12461.4 | M | 0.252 | 4.40E−05 | 67.8 |
| LYM19 | 11754.1 | A | 90.586 | 5.02E−01 | 0.6 | LYM119 | 12461.1 | M | 0.247 | 1.02E−04 | 64.7 |
| LYM119 | 12462.2 | A | 91.266 | 5.04E−01 | 1.3 | LYM130 | 12332.1 | M | 0.237 | 1.67E−04 | 57.8 |
| LYM102 | 12222.2 | A | 91.356 | 5.05E−01 | 1.4 | LYM106 | 12142.2 | M | 0.246 | 3.33E−04 | 63.9 |
| LYM105 | 12297.2 | A | 90.882 | 5.68E−01 | 0.9 | LYM119 | 12463.2 | M | 0.235 | 4.03E−04 | 56.8 |
| LYM119 | 12461.1 | A | 91.225 | 5.83E−01 | 1.3 | LYM220 | 12851.8 | M | 0.235 | 5.61E−04 | 56.5 |
| LYM22 | 11764.1 | A | 91.311 | 5.88E−01 | 1.4 | LYM174 | 12411.3 | M | 0.241 | 8.78E−04 | 60.7 |
| LYM22 | 11761.3 | A | 90.621 | 6.14E−01 | 0.6 | LYM174 | 12412.1 | M | 0.229 | 1.48E−03 | 52.4 |
| LYM113 | 12442.1 | A | 90.893 | 6.16E−01 | 0.9 | LYM289 | 12493.1 | M | 0.226 | 1.50E−03 | 50.2 |
| LYM134 | 12311.2 | A | 90.868 | 6.23E−01 | 0.9 | LYM107 | 12632.3 | M | 0.225 | 2.47E−03 | 49.7 |
| LYM129 | 12573.3 | A | 91.722 | 6.45E−01 | 1.8 | LYM153 | 12323.2 | M | 0.223 | 2.51E−03 | 48.2 |
| LYM174 | 12414.3 | A | 90.625 | 6.59E−01 | 0.6 | LYM153 | 12324.1 | M | 0.225 | 2.61E−03 | 49.7 |
| LYM10 | 11742.1 | A | 90.422 | 6.74E−01 | 0.4 | LYM119 | 12462.1 | M | 0.222 | 5.10E−03 | 48.1 |
| LYM1 | 11601.1 | A | 90.906 | 6.83E−01 | 0.9 | LYM288 | 12743.9 | M | 0.213 | 5.72E−03 | 41.9 |
| LYM290 | 12501.3 | A | 90.39 | 6.87E−01 | 0.4 | LYM255 | 13082.5 | M | 0.228 | 5.79E−03 | 52 |
| LYM140 | 12261.2 | A | 91.222 | 6.93E−01 | 1.3 | LYM255 | 13082.8 | M | 0.211 | 7.22E−03 | 40.4 |
| LYM3 | 12041.1 | A | 91.583 | 6.94E−01 | 1.7 | LYM288 | 12743.5 | M | 0.218 | 8.60E−03 | 45.3 |
| LYM153 | 12321.2 | A | 90.616 | 7.11E−01 | 0.6 | LYM255 | 13082.7 | M | 0.215 | 1.08E−02 | 43.1 |
| LYM148 | 12174.1 | A | 90.592 | 7.15E−01 | 0.6 | LYM153 | 12324.2 | M | 0.208 | 1.28E−02 | 38.3 |
| LYM102 | 12221.1 | A | 90.466 | 7.40E−01 | 0.4 | LYM119 | 12462.2 | M | 0.213 | 1.33E−02 | 42 |
| LYM140 | 12261.4 | A | 90.837 | 7.42E−01 | 0.9 | LYM102 | 12222.2 | M | 0.205 | 1.38E−02 | 36.7 |
| LYM162 | 12234.3 | A | 90.909 | 7.49E−01 | 0.9 | LYM152 | 12371.2 | M | 0.217 | 1.45E−02 | 44.2 |
| LYM132 | 12271.4 | A | 90.298 | 7.84E−01 | 0.3 | LYM105 | 12293.1 | M | 0.206 | 1.48E−02 | 37.1 |
| LYM129 | 12572.2 | A | 90.907 | 7.96E−01 | 0.9 | LYM137 | 12151.4 | M | 0.203 | 1.60E−02 | 35.3 |
| LYM100 | 12134.1 | A | 90.809 | 8.05E−01 | 0.8 | LYM174 | 12411.2 | M | 0.206 | 1.70E−02 | 37.4 |
| LYM19 | 11753.1 | A | 90.31 | 8.11E−01 | 0.3 | LYM289 | 12493.2 | M | 0.214 | 1.88E−02 | 42.8 |
| LYM289 | 12493.2 | A | 90.591 | 8.24E−01 | 0.6 | LYM106 | 12144.4 | M | 0.199 | 2.45E−02 | 32.2 |
| LYM102 | 12222.6 | A | 90.769 | 8.26E−01 | 0.8 | LYM105 | 12295.2 | M | 0.199 | 2.68E−02 | 32.7 |
| LYM10 | 11742.2 | A | 90.507 | 8.27E−01 | 0.5 | LYM105 | 12297.2 | M | 0.199 | 2.80E−02 | 32.4 |
| LYM9 | 11632.1 | A | 90.231 | 8.32E−01 | 0.2 | LYM130 | 12332.2 | M | 0.198 | 2.81E−02 | 31.9 |
| LYM113 | 12444.5 | A | 90.243 | 8.32E−01 | 0.2 | LYM130 | 12334.1 | M | 0.196 | 2.87E−02 | 30.7 |
| LYM102 | 12222.1 | A | 90.968 | 8.39E−01 | 1 | LYM270 | 12873.6 | M | 0.195 | 4.30E−02 | 29.7 |
| LYM1 | 11604.4 | A | 90.574 | 8.76E−01 | 0.6 | LYM111 | 12252.2 | M | 0.195 | 4.53E−02 | 29.8 |
| LYM3 | 12043.2 | A | 90.701 | 8.80E−01 | 0.7 | LYM153 | 12321.2 | M | 0.196 | 4.59E−02 | 30.4 |
| LYM105 | 12294.3 | A | 90.228 | 8.91E−01 | 0.2 | LYM137 | 12151.1 | M | 0.193 | 4.97E−02 | 28.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM153 | 12324.1 | A | 90.308 | 8.94E−01 | 0.3 | LYM137 | 12151.2 | M | 0.193 | 6.15E−02 | 28.5 |
| LYM15 | 11614.4 | A | 90.158 | 9.00E−01 | 0.1 | LYM105 | 12294.2 | M | 0.188 | 7.39E−02 | 25.1 |
| LYM13 | 11772.2 | A | 90.26 | 9.44E−01 | 0.2 | LYM106 | 12144.3 | M | 0.191 | 7.99E−02 | 27.4 |
| LYM289 | 12492.2 | A | 90.234 | 9.48E−01 | 0.2 | LYM138 | 12562.2 | M | 0.189 | 8.00E−02 | 25.7 |
| LYM162 | 12231.1 | A | 90.145 | 9.78E−01 | 0.1 | LYM291 | 12754.9 | M | 0.19 | 8.85E−02 | 26.8 |
| CONTROL | — | A | 90.061 | — | 0 | LYM130 | 12331.3 | M | 0.198 | 9.07E−02 | 31.9 |
| LYM13 | 11771.6 | B | 0.272 | 1.17E−02 | 23.1 | LYM107 | 12631.4 | M | 0.182 | 1.23E−01 | 21.4 |
| LYM129 | 12573.3 | B | 0.288 | 2.16E−02 | 30.2 | LYM137 | 12154.5 | M | 0.192 | 1.33E−01 | 27.8 |
| LYM129 | 12573.5 | B | 0.364 | 2.30E−02 | 65 | LYM153 | 12322.1 | M | 0.181 | 1.40E−01 | 20.6 |
| LYM4 | 11702.3 | B | 0.27 | 3.35E−02 | 22.3 | LYM143 | 12524.7 | M | 0.188 | 1.44E−01 | 25.2 |
| LYM4 | 11701.1 | B | 0.259 | 4.26E−02 | 17.5 | LYM289 | 12492.2 | M | 0.18 | 1.47E−01 | 20.1 |
| LYM152 | 12373.2 | B | 0.376 | 4.78E−02 | 70.4 | LYM102 | 12222.3 | M | 0.18 | 1.55E−01 | 19.8 |
| LYM19 | 11752.2 | B | 0.255 | 5.74E−02 | 15.5 | LYM288 | 12741.9 | M | 0.181 | 1.68E−01 | 20.8 |
| LYM15 | 11611.3 | B | 0.255 | 6.26E−02 | 15.5 | LYM173 | 12981.6 | M | 0.178 | 1.71E−01 | 18.8 |
| LYM138 | 12561.1 | B | 0.261 | 6.50E−02 | 18.3 | LYM137 | 12153.1 | M | 0.178 | 1.79E−01 | 18.8 |
| LYM17 | 11682.1 | B | 0.324 | 6.56E−02 | 46.9 | LYM138 | 12564.1 | M | 0.179 | 1.94E−01 | 19.2 |
| LYM17 | 11683.1 | B | 0.266 | 6.67E−02 | 20.3 | LYM90 | 12395.3 | M | 0.178 | 1.97E−01 | 18.6 |
| LYM130 | 12333.1 | B | 0.254 | 7.69E−02 | 15.2 | LYM152 | 12371.3 | M | 0.18 | 2.02E−01 | 19.8 |
| LYM9 | 11633.7 | B | 0.301 | 9.51E−02 | 36.4 | LYM212 | 13032.8 | M | 0.176 | 2.12E−01 | 17.3 |
| LYM148 | 12171.2 | B | 0.281 | 1.01E−01 | 27.4 | LYM288 | 12743.8 | M | 0.176 | 2.21E−01 | 17.4 |
| LYM4 | 11706.3 | B | 0.316 | 1.05E−01 | 43.2 | LYM111 | 12254.4 | M | 0.175 | 2.43E−01 | 16.2 |
| LYM4 | 11705.3 | B | 0.316 | 1.25E−01 | 43.1 | LYM197 | 12821.6 | M | 0.173 | 2.76E−01 | 15.1 |
| LYM9 | 11632.2 | B | 0.339 | 1.56E−01 | 53.4 | LYM242 | 13051.8 | M | 0.172 | 3.06E−01 | 14.6 |
| LYM2 | 11691.2 | B | 0.244 | 1.73E−01 | 10.4 | LYM242 | 13052.5 | M | 0.171 | 3.18E−01 | 14.1 |
| LYM162 | 12234.4 | B | 0.299 | 2.06E−01 | 35.3 | LYM106 | 12141.4 | M | 0.169 | 3.53E−01 | 12.8 |
| LYM148 | 12174.1 | B | 0.315 | 2.13E−01 | 42.7 | LYM152 | 12373.1 | M | 0.169 | 3.59E−01 | 12.7 |
| LYM289 | 12493.2 | B | 0.271 | 2.20E−01 | 22.9 | LYM107 | 12631.2 | M | 0.169 | 3.69E−01 | 12.9 |
| LYM9 | 11634.5 | B | 0.26 | 2.39E−01 | 17.8 | LYM107 | 12631.1 | M | 0.169 | 3.80E−01 | 12.7 |
| LYM129 | 12571.3 | B | 0.249 | 2.41E−01 | 12.7 | LYM102 | 12221.1 | M | 0.169 | 3.82E−01 | 12.4 |
| LYM153 | 12323.2 | B | 0.259 | 2.51E−01 | 17.2 | LYM183 | 12994.8 | M | 0.173 | 3.83E−01 | 15.3 |
| LYM119 | 12463.2 | B | 0.433 | 2.58E−01 | 95.9 | LYM105 | 12294.3 | M | 0.165 | 4.64E−01 | 10 |
| LYM130 | 12331.3 | B | 0.239 | 2.71E−01 | 8.1 | LYM173 | 12981.5 | M | 0.165 | 4.93E−01 | 9.9 |
| LYM19 | 11751.5 | B | 0.243 | 2.73E−01 | 9.8 | LYM289 | 12491.4 | M | 0.164 | 5.04E−01 | 9.2 |
| LYM15 | 11612.3 | B | 0.289 | 2.83E−01 | 31.1 | LYM102 | 12222.1 | M | 0.164 | 5.15E−01 | 9.1 |
| LYM21 | 11672.4 | B | 0.252 | 2.88E−01 | 14.1 | LYM255 | 13082.9 | M | 0.164 | 5.16E−01 | 9.4 |
| LYM16 | 11624.4 | B | 0.251 | 3.28E−01 | 13.5 | LYM143 | 12524.5 | M | 0.167 | 5.26E−01 | 11.1 |
| LYM129 | 12572.4 | B | 0.316 | 3.30E−01 | 43 | LYM289 | 12491.1 | M | 0.163 | 5.32E−01 | 8.6 |
| LYM113 | 12442.1 | B | 0.326 | 3.53E−01 | 47.8 | LYM142 | 12802.9 | M | 0.164 | 5.37E−01 | 9.5 |
| LYM4 | 11706.5 | B | 0.296 | 3.55E−01 | 33.9 | LYM100 | 12131.3 | M | 0.162 | 5.51E−01 | 8.2 |
| LYM132 | 12275.1 | B | 0.289 | 3.63E−01 | 30.8 | LYM102 | 12222.6 | M | 0.163 | 5.63E−01 | 8.5 |
| LYM129 | 12572.2 | B | 0.303 | 3.87E−01 | 37.3 | LYM287 | 12774.6 | M | 0.16 | 6.30E−01 | 6.7 |
| LYM13 | 11773.2 | B | 0.314 | 3.98E−01 | 42.1 | LYM130 | 12333.1 | M | 0.159 | 6.78E−01 | 6 |
| LYM143 | 12521.2 | B | 0.264 | 4.18E−01 | 19.7 | LYM198 | 13005.8 | M | 0.158 | 6.94E−01 | 5.4 |
| LYM143 | 12523.4 | B | 0.274 | 4.27E−01 | 24.3 | LYM183 | 12993.7 | M | 0.159 | 7.00E−01 | 5.7 |
| LYM113 | 12441.4 | B | 0.278 | 4.50E−01 | 25.7 | LYM106 | 12142.3 | M | 0.158 | 7.00E−01 | 5.3 |
| LYM106 | 12141.4 | B | 0.254 | 4.54E−01 | 15.1 | LYM183 | 12994.7 | M | 0.158 | 7.06E−01 | 5.3 |
| LYM13 | 11772.1 | B | 0.27 | 4.61E−01 | 22.3 | LYM201 | 12834.6 | M | 0.158 | 7.14E−01 | 5 |
| LYM9 | 11632.1 | B | 0.319 | 4.74E−01 | 44.4 | LYM291 | 12753.6 | M | 0.158 | 7.29E−01 | 5.1 |
| LYM111 | 12254.3 | B | 0.335 | 4.82E−01 | 51.7 | LYM287 | 12771.6 | M | 0.157 | 7.30E−01 | 4.7 |
| LYM153 | 12324.2 | B | 0.304 | 4.85E−01 | 37.6 | LYM287 | 12773.7 | M | 0.158 | 7.39E−01 | 5.1 |
| LYM106 | 12144.4 | B | 0.233 | 4.92E−01 | 5.6 | LYM212 | 13031.6 | M | 0.157 | 7.40E−01 | 4.4 |
| LYM1 | 11602.1 | B | 0.236 | 4.95E−01 | 6.7 | LYM270 | 12871.5 | M | 0.159 | 7.48E−01 | 5.7 |
| LYM130 | 12332.2 | B | 0.232 | 4.98E−01 | 5 | LYM44 | 11885.4 | M | 0.157 | 7.56E−01 | 4.4 |
| LYM2 | 11695.3 | B | 0.251 | 5.12E−01 | 13.5 | LYM212 | 13034.9 | M | 0.158 | 7.63E−01 | 5.5 |
| LYM141 | 12404.1 | B | 0.278 | 5.13E−01 | 25.7 | LYM107 | 12632.1 | M | 0.156 | 7.80E−01 | 4 |
| LYM141 | 12402.4 | B | 0.243 | 5.22E−01 | 10.1 | LYM173 | 12982.6 | M | 0.154 | 8.61E−01 | 2.4 |
| LYM16 | 11624.6 | B | 0.291 | 5.38E−01 | 31.9 | LYM201 | 12833.7 | M | 0.153 | 8.72E−01 | 2.2 |
| LYM134 | 12311.2 | B | 0.289 | 5.54E−01 | 31.1 | LYM44 | 11882.1 | M | 0.151 | 9.64E−01 | 0.7 |
| LYM111 | 12251.1 | B | 0.338 | 5.57E−01 | 53.1 | LYM208 | 13012.5 | M | 0.151 | 9.83E−01 | 0.4 |
| LYM141 | 12404.4 | B | 0.261 | 5.64E−01 | 18 | CONTROL | — | M | 0.15 | — | 0 |
| LYM17 | 11684.4 | B | 0.23 | 5.76E−01 | 4.2 | LYM138 | 12561.1 | N | 0.261 | 1.30E−05 | 49 |
| LYM106 | 12142.1 | B | 0.293 | 5.87E−01 | 32.8 | LYM289 | 12493.1 | N | 0.234 | 7.05E−04 | 33.6 |
| LYM134 | 12314.2 | B | 0.241 | 6.43E−01 | 9.3 | LYM174 | 12414.3 | N | 0.229 | 2.54E−03 | 30.8 |
| LYM100 | 12131.3 | B | 0.251 | 6.43E−01 | 13.8 | LYM119 | 12461.1 | N | 0.227 | 3.16E−03 | 29.7 |
| LYM10 | 11742.1 | B | 0.267 | 6.69E−01 | 20.9 | LYM138 | 12561.3 | N | 0.225 | 3.66E−03 | 28.5 |
| LYM111 | 12251.3 | B | 0.239 | 6.76E−01 | 8.4 | LYM119 | 12461.4 | N | 0.224 | 5.01E−03 | 27.8 |
| LYM111 | 12252.2 | B | 0.229 | 6.87E−01 | 3.9 | LYM174 | 12411.3 | N | 0.225 | 7.02E−03 | 28.9 |
| LYM16 | 11623.5 | B | 0.259 | 6.97E−01 | 17.2 | LYM106 | 12142.1 | N | 0.226 | 8.45E−03 | 29.3 |
| LYM106 | 12142.2 | B | 0.233 | 6.99E−01 | 5.6 | LYM153 | 12323.2 | N | 0.216 | 1.61E−02 | 23.5 |
| LYM148 | 12173.1 | B | 0.229 | 7.02E−01 | 3.6 | LYM153 | 12324.1 | N | 0.217 | 1.92E−02 | 23.8 |
| LYM152 | 12373.1 | B | 0.229 | 7.02E−01 | 3.9 | LYM119 | 12463.2 | N | 0.212 | 3.04E−02 | 21 |
| LYM134 | 12312.3 | B | 0.245 | 7.07E−01 | 11 | LYM220 | 12851.8 | N | 0.212 | 3.13E−02 | 21.2 |
| LYM290 | 12504.1 | B | 0.283 | 7.08E−01 | 28 | LYM289 | 12493.2 | N | 0.217 | 3.21E−02 | 24.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM16 | 11623.2 | B | 0.25 | 7.31E−01 | 13.2 | LYM174 | 12412.1 | N | 0.214 | 3.22E−02 | 22.5 |
| LYM2 | 11695.1 | B | 0.277 | 7.60E−01 | 25.4 | LYM137 | 12151.4 | N | 0.208 | 4.03E−02 | 19.1 |
| LYM162 | 12231.1 | B | 0.235 | 7.79E−01 | 6.4 | LYM288 | 12743.5 | N | 0.213 | 4.24E−02 | 21.5 |
| LYM2 | 11692.3 | B | 0.251 | 7.87E−01 | 13.5 | LYM105 | 12295.2 | N | 0.21 | 4.60E−02 | 19.9 |
| LYM113 | 12443.1 | B | 0.261 | 7.97E−01 | 18 | LYM255 | 13082.8 | N | 0.21 | 5.20E−02 | 20.1 |
| LYM152 | 12372.2 | B | 0.235 | 8.07E−01 | 6.4 | LYM119 | 12462.1 | N | 0.211 | 5.82E−02 | 20.8 |
| LYM143 | 12521.1 | B | 0.226 | 8.11E−01 | 2.5 | LYM130 | 12332.1 | N | 0.207 | 5.93E−02 | 18.4 |
| LYM130 | 12334.1 | B | 0.259 | 8.16E−01 | 17.2 | LYM107 | 12632.3 | N | 0.207 | 6.68E−02 | 18.4 |
| LYM153 | 12324.1 | B | 0.244 | 8.17E−01 | 10.7 | LYM153 | 12324.2 | N | 0.204 | 7.50E−02 | 16.6 |
| LYM137 | 12154.5 | B | 0.226 | 8.28E−01 | 2.2 | LYM119 | 12462.2 | N | 0.208 | 7.54E−02 | 19 |
| LYM15 | 11614.4 | B | 0.233 | 8.31E−01 | 5.3 | LYM105 | 12293.1 | N | 0.205 | 7.59E−02 | 17.3 |
| LYM16 | 11622.2 | B | 0.233 | 8.34E−01 | 5.6 | LYM152 | 12371.3 | N | 0.205 | 7.65E−02 | 17.4 |
| LYM289 | 12493.6 | B | 0.249 | 8.38E−01 | 12.7 | LYM255 | 13082.7 | N | 0.207 | 8.60E−02 | 18.1 |
| LYM1 | 11604.4 | B | 0.234 | 8.63E−01 | 6.2 | LYM111 | 12252.2 | N | 0.203 | 9.29E−02 | 16.2 |
| LYM289 | 12491.1 | B | 0.235 | 8.75E−01 | 6.4 | LYM102 | 12222.2 | N | 0.202 | 1.09E−01 | 15.6 |
| LYM21 | 11673.1 | B | 0.226 | 8.75E−01 | 2.5 | LYM255 | 13082.5 | N | 0.207 | 1.17E−01 | 18.2 |
| LYM132 | 12271.4 | B | 0.229 | 9.38E−01 | 3.6 | LYM137 | 12151.2 | N | 0.204 | 1.18E−01 | 16.5 |
| LYM1 | 11603.2 | B | 0.222 | 9.68E−01 | 0.5 | LYM106 | 12144.4 | N | 0.199 | 1.21E−01 | 14 |
| LYM138 | 12561.3 | B | 0.223 | 9.70E−01 | 0.8 | LYM143 | 12524.7 | N | 0.204 | 1.42E−01 | 16.6 |
| LYM152 | 12371.2 | B | 0.221 | 9.92E−01 | 0.2 | LYM288 | 12743.9 | N | 0.198 | 1.48E−01 | 13.3 |
| CONTROL | — | B | 0.221 | — | 0 | LYM153 | 12321.2 | N | 0.198 | 1.63E−01 | 13.4 |
| LYM9 | 11632.2 | C | 3.269 | 4.30E−05 | 64 | LYM152 | 12371.2 | N | 0.204 | 1.67E−01 | 16.5 |
| LYM4 | 11705.2 | C | 2.993 | 1.48E−04 | 50.1 | LYM105 | 12294.2 | N | 0.196 | 1.85E−01 | 11.8 |
| LYM17 | 11682.1 | C | 2.731 | 8.43E−04 | 37 | LYM153 | 12322.1 | N | 0.196 | 1.90E−01 | 11.8 |
| LYM4 | 11706.3 | C | 3.394 | 2.46E−03 | 70.2 | LYM105 | 12297.2 | N | 0.196 | 1.90E−01 | 11.9 |
| LYM129 | 12573.3 | C | 3.106 | 2.83E−03 | 55.8 | LYM137 | 12151.1 | N | 0.196 | 2.05E−01 | 11.8 |
| LYM130 | 12333.1 | C | 2.681 | 3.58E−03 | 34.5 | LYM142 | 12804.1 | N | 0.198 | 2.08E−01 | 13.3 |
| LYM4 | 11702.3 | C | 3.1 | 4.05E−03 | 55.5 | LYM152 | 12373.1 | N | 0.196 | 2.17E−01 | 11.8 |
| LYM138 | 12561.1 | C | 2.531 | 5.20E−03 | 27 | LYM174 | 12411.2 | N | 0.196 | 2.21E−01 | 12.1 |
| LYM13 | 11771.6 | C | 2.756 | 6.82E−03 | 38.3 | LYM197 | 12821.6 | N | 0.194 | 2.27E−01 | 10.6 |
| LYM15 | 11612.3 | C | 2.494 | 7.56E−03 | 25.1 | LYM130 | 12334.1 | N | 0.193 | 2.39E−01 | 10.3 |
| LYM9 | 11634.5 | C | 2.631 | 1.39E−02 | 32 | LYM102 | 12222.3 | N | 0.193 | 2.51E−01 | 10.3 |
| LYM129 | 12573.5 | C | 3.519 | 1.43E−02 | 76.5 | LYM130 | 12332.2 | N | 0.191 | 3.09E−01 | 9.2 |
| LYM17 | 11683.1 | C | 2.394 | 2.12E−02 | 20.1 | LYM291 | 12754.9 | N | 0.194 | 3.10E−01 | 10.7 |
| LYM129 | 12571.3 | C | 2.763 | 2.21E−02 | 38.6 | LYM106 | 12144.3 | N | 0.192 | 3.17E−01 | 9.9 |
| LYM106 | 12144.4 | C | 2.406 | 2.27E−02 | 20.7 | LYM270 | 12873.6 | N | 0.19 | 3.42E−01 | 8.7 |
| LYM19 | 11751.5 | C | 2.356 | 3.15E−02 | 18.2 | LYM102 | 12222.1 | N | 0.19 | 3.58E−01 | 8.6 |
| LYM4 | 11701.1 | C | 2.844 | 3.92E−02 | 42.6 | LYM102 | 12221.1 | N | 0.188 | 3.97E−01 | 7.6 |
| LYM113 | 12441.4 | C | 2.644 | 4.19E−02 | 32.6 | LYM137 | 12153.1 | N | 0.188 | 3.97E−01 | 7.7 |
| LYM17 | 11684.4 | C | 2.356 | 5.63E−02 | 18.2 | LYM173 | 12981.6 | N | 0.188 | 3.98E−01 | 7.7 |
| LYM129 | 12572.4 | C | 3.038 | 5.70E−02 | 52.4 | LYM90 | 12395.3 | N | 0.189 | 4.04E−01 | 8.2 |
| LYM15 | 11611.3 | C | 2.3 | 5.79E−02 | 15.4 | LYM107 | 12631.2 | N | 0.189 | 4.08E−01 | 8.1 |
| LYM119 | 12463.2 | C | 3.419 | 8.18E−02 | 71.5 | LYM44 | 11882.1 | N | 0.188 | 4.49E−01 | 7.4 |
| LYM1 | 11602.1 | C | 2.281 | 8.53E−02 | 14.4 | LYM173 | 12981.5 | N | 0.187 | 4.84E−01 | 6.6 |
| LYM148 | 12171.2 | C | 2.375 | 1.08E−01 | 19.1 | LYM143 | 12524.5 | N | 0.189 | 5.07E−01 | 7.9 |
| LYM152 | 12373.2 | C | 2.775 | 1.08E−01 | 39.2 | LYM242 | 13052.5 | N | 0.186 | 5.08E−01 | 6.2 |
| LYM4 | 11706.5 | C | 3.069 | 1.20E−01 | 53.9 | LYM130 | 12331.3 | N | 0.189 | 5.20E−01 | 8.2 |
| LYM9 | 11633.7 | C | 3.063 | 1.26E−01 | 53.6 | LYM288 | 12743.8 | N | 0.185 | 5.30E−01 | 6 |
| LYM106 | 12144.3 | C | 2.244 | 1.58E−01 | 12.6 | LYM138 | 12564.1 | N | 0.185 | 5.54E−01 | 5.8 |
| LYM141 | 12402.4 | C | 2.381 | 1.63E−01 | 19.4 | LYM289 | 12492.2 | N | 0.184 | 5.60E−01 | 5.3 |
| LYM16 | 11624.4 | C | 2.425 | 1.90E−01 | 21.6 | LYM137 | 12154.5 | N | 0.186 | 5.68E−01 | 6.4 |
| LYM13 | 11773.2 | C | 2.619 | 1.93E−01 | 31.4 | LYM138 | 12562.2 | N | 0.183 | 6.21E−01 | 4.8 |
| LYM106 | 12142.2 | C | 2.3 | 1.99E−01 | 15.4 | LYM289 | 12491.4 | N | 0.182 | 6.68E−01 | 3.8 |
| LYM137 | 12154.5 | C | 2.3 | 1.99E−01 | 15.4 | LYM106 | 12141.4 | N | 0.181 | 6.80E−01 | 3.6 |
| LYM132 | 12275.1 | C | 2.275 | 2.02E−01 | 14.1 | LYM183 | 12994.7 | N | 0.181 | 6.90E−01 | 3.7 |
| LYM153 | 12323.2 | C | 2.481 | 2.07E−01 | 24.5 | LYM107 | 12631.4 | N | 0.181 | 6.97E−01 | 3.5 |
| LYM9 | 11633.2 | C | 2.356 | 2.33E−01 | 18.2 | LYM289 | 12491.1 | N | 0.18 | 7.34E−01 | 3 |
| LYM134 | 12314.2 | C | 2.288 | 2.41E−01 | 14.7 | LYM270 | 12871.8 | N | 0.181 | 7.36E−01 | 3.7 |
| LYM129 | 12572.2 | C | 3 | 2.69E−01 | 50.5 | LYM142 | 12804.3 | N | 0.181 | 7.40E−01 | 3.7 |
| LYM134 | 12312.3 | C | 2.2 | 2.70E−01 | 10.4 | LYM242 | 13051.8 | N | 0.18 | 7.41E−01 | 3 |
| LYM113 | 12442.1 | C | 2.681 | 2.75E−01 | 34.5 | LYM44 | 11885.3 | N | 0.181 | 7.62E−01 | 3.2 |
| LYM13 | 11772.1 | C | 2.481 | 2.80E−01 | 24.5 | LYM183 | 12994.8 | N | 0.181 | 7.66E−01 | 3.7 |
| LYM148 | 12173.1 | C | 2.15 | 2.91E−01 | 7.8 | LYM106 | 12142.3 | N | 0.179 | 7.88E−01 | 2.4 |
| LYM119 | 12461.1 | C | 2.288 | 2.95E−01 | 14.7 | LYM111 | 12254.4 | N | 0.179 | 7.89E−01 | 2.4 |
| LYM13 | 11771.9 | C | 2.194 | 2.97E−01 | 10 | LYM107 | 12631.1 | N | 0.179 | 7.99E−01 | 2.4 |
| LYM141 | 12404.1 | C | 2.444 | 3.06E−01 | 22.6 | LYM201 | 12834.6 | N | 0.179 | 8.18E−01 | 2.2 |
| LYM16 | 11624.6 | C | 2.688 | 3.41E−01 | 34.8 | LYM100 | 12131.3 | N | 0.178 | 8.46E−01 | 1.7 |
| LYM148 | 12174.1 | C | 2.425 | 3.45E−01 | 21.6 | LYM212 | 13032.8 | N | 0.178 | 8.59E−01 | 1.6 |
| LYM16 | 11622.2 | C | 2.194 | 3.53E−01 | 10 | LYM201 | 12833.9 | N | 0.177 | 8.96E−01 | 1.1 |
| LYM9 | 11632.1 | C | 3.006 | 3.58E−01 | 50.8 | LYM270 | 12871.5 | N | 0.178 | 9.11E−01 | 1.5 |
| LYM130 | 12331.3 | C | 2.219 | 3.60E−01 | 11.3 | LYM105 | 12294.3 | N | 0.177 | 9.14E−01 | 1 |
| LYM153 | 12324.2 | C | 2.469 | 3.65E−01 | 23.8 | LYM107 | 12632.1 | N | 0.177 | 9.15E−01 | 1 |
| LYM16 | 11623.2 | C | 2.413 | 3.71E−01 | 21 | LYM201 | 12833.7 | N | 0.176 | 9.24E−01 | 0.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM162 | 12234.4 | C | 2.5 | 3.76E−01 | 25.4 | LYM137 | 12152.1 | N | 0.176 | 9.43E−01 | 0.7 |
| LYM111 | 12254.3 | C | 2.581 | 4.18E−01 | 29.5 | LYM208 | 13012.5 | N | 0.176 | 9.69E−01 | 0.5 |
| LYM111 | 12251.1 | C | 2.688 | 4.40E−01 | 34.8 | LYM197 | 12824.4 | N | 0.176 | 9.72E−01 | 0.3 |
| LYM17 | 11681.4 | C | 2.115 | 4.53E−01 | 6.1 | LYM288 | 12744.6 | N | 0.176 | 9.74E−01 | 0.4 |
| LYM15 | 11614.4 | C | 2.125 | 4.67E−01 | 6.6 | CONTROL | — | N | 0.175 | — | 0 |
| LYM106 | 12142.1 | C | 2.531 | 4.74E−01 | 27 | LYM174 | 12414.3 | O | 2.094 | 1.00E−06 | 72.1 |
| LYM106 | 12141.4 | C | 2.358 | 4.96E−01 | 18.3 | LYM288 | 12743.9 | O | 1.73 | 3.30E−05 | 42.2 |
| LYM143 | 12521.2 | C | 2.181 | 5.05E−01 | 9.4 | LYM255 | 13082.8 | O | 1.712 | 4.70E−05 | 40.7 |
| LYM19 | 11752.2 | C | 2.081 | 5.38E−01 | 4.4 | LYM106 | 12144.4 | O | 1.624 | 2.04E−04 | 33.5 |
| LYM162 | 12231.1 | C | 2.106 | 5.41E−01 | 5.7 | LYM270 | 12873.6 | O | 1.587 | 4.90E−04 | 30.4 |
| LYM111 | 12251.3 | C | 2.35 | 5.87E−01 | 17.9 | LYM289 | 12492.2 | O | 1.518 | 1.30E−03 | 24.7 |
| LYM141 | 12404.4 | C | 2.169 | 6.33E−01 | 8.8 | LYM105 | 12294.2 | O | 1.496 | 1.87E−03 | 22.9 |
| LYM137 | 12151.2 | C | 2.058 | 6.54E−01 | 3.2 | LYM107 | 12631.4 | O | 1.487 | 2.26E−03 | 22.2 |
| LYM111 | 12254.4 | C | 2.181 | 6.62E−01 | 9.4 | LYM130 | 12332.1 | O | 1.928 | 3.71E−03 | 58.5 |
| LYM16 | 11623.5 | C | 2.281 | 6.77E−01 | 14.4 | LYM153 | 12323.2 | O | 1.828 | 4.86E−03 | 50.3 |
| LYM153 | 12324.1 | C | 2.181 | 6.83E−01 | 9.4 | LYM130 | 12334.1 | O | 1.578 | 5.52E−03 | 29.7 |
| LYM138 | 12561.3 | C | 2.175 | 6.87E−01 | 9.1 | LYM137 | 12153.1 | O | 1.435 | 7.32E−03 | 17.9 |
| LYM2 | 11695.3 | C | 2.05 | 6.93E−01 | 2.8 | LYM153 | 12324.2 | O | 1.689 | 7.63E−03 | 38.9 |
| LYM137 | 12151.1 | C | 2.05 | 7.06E−01 | 2.8 | LYM173 | 12981.6 | O | 1.463 | 8.10E−03 | 20.2 |
| LYM143 | 12523.4 | C | 2.156 | 7.37E−01 | 8.2 | LYM138 | 12561.1 | O | 2.726 | 8.93E−03 | 124.1 |
| LYM2 | 11695.1 | C | 2.5 | 7.66E−01 | 25.4 | LYM153 | 12322.1 | O | 1.432 | 9.89E−03 | 17.7 |
| LYM2 | 11691.2 | C | 2.075 | 7.88E−01 | 4.1 | LYM289 | 12493.1 | O | 1.818 | 1.07E−02 | 49.5 |
| LYM21 | 11672.4 | C | 2.031 | 7.89E−01 | 1.9 | LYM119 | 12461.4 | O | 2.03 | 1.16E−02 | 66.9 |
| LYM137 | 12152.1 | C | 2.063 | 7.91E−01 | 3.5 | LYM102 | 12222.2 | O | 1.676 | 1.46E−02 | 37.7 |
| LYM130 | 12332.2 | C | 2.031 | 8.44E−01 | 1.9 | LYM102 | 12222.3 | O | 1.455 | 1.94E−02 | 19.6 |
| LYM162 | 12231.1 | C | 2.125 | 8.45E−01 | 6.6 | LYM105 | 12297.2 | O | 1.598 | 2.07E−02 | 31.3 |
| LYM134 | 12311.2 | C | 2.081 | 8.49E−01 | 4.4 | LYM107 | 12631.2 | O | 1.386 | 2.27E−02 | 14 |
| LYM290 | 12504.1 | C | 2.15 | 8.69E−01 | 7.8 | LYM138 | 12561.3 | O | 2.066 | 3.41E−02 | 69.8 |
| LYM162 | 12234.3 | C | 2.031 | 9.11E−01 | 1.9 | LYM119 | 12461.1 | O | 1.948 | 6.22E−02 | 60.1 |
| LYM137 | 12153.1 | C | 2.013 | 9.23E−01 | 1 | LYM105 | 12293.1 | O | 1.695 | 6.63E−02 | 39.3 |
| LYM152 | 12373.1 | C | 2.006 | 9.33E−01 | 0.6 | LYM106 | 12141.4 | O | 1.388 | 7.61E−02 | 14.1 |
| LYM152 | 12371.2 | C | 2 | 9.69E−01 | 0.3 | LYM212 | 13032.8 | O | 1.449 | 7.79E−02 | 19.1 |
| LYM10 | 11742.1 | C | 2.013 | 9.70E−01 | 1 | LYM119 | 12463.2 | O | 1.917 | 8.15E−02 | 57.6 |
| LYM17 | 11684.5 | C | 2.006 | 9.72E−01 | 0.6 | LYM105 | 12295.2 | O | 1.607 | 8.74E−02 | 32.1 |
| LYM289 | 12491.1 | C | 2 | 9.93E−01 | 0.3 | LYM173 | 12982.6 | O | 1.332 | 8.92E−02 | 9.5 |
| CONTROL | — | C | 1.994 | — | 0 | LYM111 | 12254.4 | O | 1.43 | 9.17E−02 | 17.6 |
| LYM148 | 12171.2 | D | 0.362 | 3.00E−06 | 59.2 | LYM174 | 12411.2 | O | 1.724 | 1.04E−01 | 41.7 |
| LYM143 | 12524.7 | D | 0.344 | 1.40E−05 | 51.3 | LYM220 | 12851.8 | O | 1.886 | 1.22E−01 | 55 |
| LYM1 | 11602.1 | D | 0.313 | 8.90E−05 | 37.7 | LYM105 | 12294.3 | O | 1.356 | 1.28E−01 | 11.4 |
| LYM130 | 12333.1 | D | 0.309 | 1.24E−04 | 36 | LYM137 | 12151.4 | O | 1.633 | 1.38E−01 | 34.2 |
| LYM10 | 11744.1 | D | 0.301 | 2.98E−04 | 32.6 | LYM174 | 12412.1 | O | 1.847 | 1.64E−01 | 51.8 |
| LYM10 | 11741.2 | D | 0.382 | 3.43E−04 | 67.9 | LYM106 | 12142.2 | O | 1.984 | 1.65E−01 | 63.1 |
| LYM162 | 12234.3 | D | 0.299 | 4.64E−04 | 31.4 | LYM130 | 12332.2 | O | 1.615 | 1.74E−01 | 32.8 |
| LYM102 | 12222.2 | D | 0.292 | 6.30E−04 | 28.6 | LYM242 | 13051.8 | O | 1.415 | 1.75E−01 | 16.3 |
| LYM15 | 11614.3 | D | 0.291 | 7.21E−04 | 28 | LYM107 | 12632.3 | O | 1.846 | 1.82E−01 | 51.7 |
| LYM140 | 12262.3 | D | 0.29 | 7.39E−04 | 27.5 | LYM152 | 12373.1 | O | 1.378 | 2.05E−01 | 13.2 |
| LYM4 | 11706.5 | D | 0.289 | 8.21E−04 | 27 | LYM137 | 12151.1 | O | 1.582 | 2.07E−01 | 30 |
| LYM105 | 12293.1 | D | 0.298 | 8.36E−04 | 31 | LYM153 | 12324.1 | O | 1.775 | 2.09E−01 | 45.9 |
| LYM1 | 11602.6 | D | 0.406 | 1.24E−03 | 78.7 | LYM119 | 12462.1 | O | 1.851 | 2.26E−01 | 52.1 |
| LYM152 | 12372.2 | D | 0.286 | 1.76E−03 | 26 | LYM138 | 12562.2 | O | 1.512 | 2.27E−01 | 24.3 |
| LYM132 | 12273.2 | D | 0.283 | 1.88E−03 | 24.6 | LYM289 | 12491.1 | O | 1.328 | 2.38E−01 | 9.1 |
| LYM132 | 12271.4 | D | 0.275 | 3.78E−03 | 20.8 | LYM174 | 12411.3 | O | 1.942 | 2.45E−01 | 59.6 |
| LYM17 | 11684.4 | D | 0.271 | 1.10E−02 | 19.2 | LYM137 | 12151.2 | O | 1.587 | 2.45E−01 | 30.4 |
| LYM119 | 12461.4 | D | 0.273 | 1.11E−02 | 20 | LYM111 | 12252.2 | O | 1.546 | 2.55E−01 | 27.1 |
| LYM162 | 12231.3 | D | 0.278 | 1.15E−02 | 22.4 | LYM288 | 12743.8 | O | 1.464 | 2.62E−01 | 20.4 |
| LYM13 | 11771.6 | D | 0.262 | 2.00E−02 | 15.2 | LYM287 | 12774.6 | O | 1.303 | 2.70E−01 | 7.1 |
| LYM9 | 11632.2 | D | 0.261 | 2.89E−02 | 15 | LYM288 | 12743.5 | O | 1.78 | 2.75E−01 | 46.3 |
| LYM119 | 12463.2 | D | 0.285 | 4.01E−02 | 25.5 | LYM242 | 13052.5 | O | 1.365 | 2.99E−01 | 12.2 |
| LYM141 | 12404.2 | D | 0.255 | 4.81E−02 | 12.1 | LYM107 | 12631.1 | O | 1.407 | 3.08E−01 | 15.7 |
| LYM138 | 12561.1 | D | 0.328 | 5.35E−02 | 44.5 | LYM100 | 12131.1 | O | 1.36 | 3.20E−01 | 11.7 |
| LYM19 | 11751.5 | D | 0.291 | 5.76E−02 | 28 | LYM289 | 12491.4 | O | 1.322 | 3.20E−01 | 8.7 |
| LYM19 | 11753.1 | D | 0.274 | 6.46E−02 | 20.5 | LYM90 | 12395.3 | O | 1.443 | 3.34E−01 | 18.6 |
| LYM289 | 12493.6 | D | 0.253 | 7.62E−02 | 11.2 | LYM102 | 12222.1 | O | 1.339 | 3.34E−01 | 10.1 |
| LYM268 | 12483.2 | D | 0.256 | 7.90E−02 | 12.7 | LYM197 | 12821.6 | O | 1.385 | 3.37E−01 | 13.8 |
| LYM129 | 12573.5 | D | 0.251 | 8.16E−02 | 10.4 | LYM255 | 13082.7 | O | 1.711 | 3.37E−01 | 40.7 |
| LYM148 | 12174.1 | D | 0.303 | 8.57E−02 | 33.3 | LYM119 | 12462.2 | O | 1.688 | 3.41E−01 | 38.8 |
| LYM289 | 12493.2 | D | 0.31 | 1.00E−01 | 36.3 | LYM152 | 12371.2 | O | 1.791 | 3.57E−01 | 47.2 |
| LYM9 | 11632.1 | D | 0.344 | 1.06E−01 | 51.2 | LYM153 | 12321.2 | O | 1.545 | 3.58E−01 | 27 |
| LYM1 | 11604.4 | D | 0.321 | 1.12E−01 | 41.4 | LYM287 | 12771.6 | O | 1.284 | 3.68E−01 | 5.5 |
| LYM10 | 11742.2 | D | 0.303 | 1.26E−01 | 33.2 | LYM289 | 12493.2 | O | 1.752 | 3.69E−01 | 44 |
| LYM1 | 11603.2 | D | 0.28 | 1.48E−01 | 23 | LYM106 | 12144.3 | O | 1.544 | 3.75E−01 | 26.9 |
| LYM119 | 12462.2 | D | 0.361 | 1.51E−01 | 58.8 | LYM255 | 13082.5 | O | 1.81 | 3.83E−01 | 48.8 |
| LYM143 | 12521.1 | D | 0.259 | 1.56E−01 | 14.1 | LYM288 | 12741.9 | O | 1.479 | 4.12E−01 | 21.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM17 | 11681.4 | D | 0.249 | 1.61E−01 | 9.6 | LYM138 | 12564.1 | O | 1.452 | 4.26E−01 | 19.3 |
| LYM13 | 11772.1 | D | 0.248 | 1.66E−01 | 9.1 | LYM291 | 12754.9 | O | 1.538 | 4.35E−01 | 26.4 |
| LYM119 | 12462.1 | D | 0.298 | 1.76E−01 | 31.1 | LYM102 | 12221.1 | O | 1.353 | 4.81E−01 | 11.2 |
| LYM15 | 11612.2 | D | 0.263 | 1.80E−01 | 15.8 | LYM152 | 12371.3 | O | 1.448 | 4.88E−01 | 19 |
| LYM102 | 12221.1 | D | 0.244 | 1.81E−01 | 7.3 | LYM255 | 13082.9 | O | 1.356 | 5.04E−01 | 11.5 |
| LYM174 | 12411.2 | D | 0.304 | 1.83E−01 | 33.9 | LYM130 | 12331.3 | O | 1.589 | 5.44E−01 | 30.6 |
| LYM16 | 11624.4 | D | 0.244 | 1.94E−01 | 7.2 | LYM212 | 13031.6 | O | 1.272 | 5.47E−01 | 4.5 |
| LYM21 | 11673.1 | D | 0.26 | 1.96E−01 | 14.4 | LYM143 | 12524.7 | O | 1.492 | 5.72E−01 | 22.7 |
| LYM17 | 11684.5 | D | 0.242 | 2.39E−01 | 6.4 | LYM173 | 12981.5 | O | 1.331 | 5.74E−01 | 9.4 |
| LYM138 | 12561.3 | D | 0.321 | 2.41E−01 | 41.1 | LYM106 | 12142.3 | O | 1.267 | 5.74E−01 | 4.2 |
| LYM4 | 11705.2 | D | 0.273 | 2.47E−01 | 20.2 | LYM142 | 12802.9 | O | 1.38 | 5.91E−01 | 13.4 |
| LYM138 | 12562.1 | D | 0.242 | 2.58E−01 | 6.5 | LYM198 | 13005.8 | O | 1.273 | 5.92E−01 | 4.6 |
| LYM141 | 12404.3 | D | 0.274 | 2.69E−01 | 20.7 | LYM102 | 12222.6 | O | 1.345 | 6.01E−01 | 10.5 |
| LYM17 | 11683.1 | D | 0.242 | 2.69E−01 | 6.3 | LYM137 | 12154.5 | O | 1.544 | 6.05E−01 | 26.9 |
| LYM19 | 11754.1 | D | 0.261 | 2.73E−01 | 15 | LYM201 | 12834.6 | O | 1.287 | 7.03E−01 | 5.8 |
| LYM152 | 12371.2 | D | 0.271 | 2.75E−01 | 19.3 | LYM183 | 12994.8 | O | 1.414 | 7.10E−01 | 16.2 |
| LYM130 | 12334.1 | D | 0.245 | 2.83E−01 | 7.7 | LYM44 | 11885.4 | O | 1.282 | 7.27E−01 | 5.4 |
| LYM134 | 12311.2 | D | 0.284 | 3.00E−01 | 25 | LYM242 | 13053.7 | O | 1.262 | 7.36E−01 | 3.7 |
| LYM141 | 12402.4 | D | 0.296 | 3.09E−01 | 30.2 | LYM107 | 12632.1 | O | 1.289 | 7.44E−01 | 5.9 |
| LYM2 | 11692.3 | D | 0.242 | 3.13E−01 | 6.6 | LYM291 | 12753.6 | O | 1.292 | 7.51E−01 | 6.2 |
| LYM9 | 11633.7 | D | 0.277 | 3.20E−01 | 22 | LYM143 | 12524.5 | O | 1.366 | 7.58E−01 | 12.2 |
| LYM19 | 11751.4 | D | 0.292 | 3.24E−01 | 28.3 | LYM201 | 12833.7 | O | 1.241 | 7.73E−01 | 2 |
| LYM162 | 12231.1 | D | 0.279 | 3.32E−01 | 22.6 | LYM130 | 12333.1 | O | 1.294 | 7.92E−01 | 6.4 |
| LYM148 | 12173.1 | D | 0.289 | 3.33E−01 | 27.2 | LYM287 | 12773.7 | O | 1.293 | 8.02E−01 | 6.2 |
| LYM143 | 12524.2 | D | 0.263 | 3.48E−01 | 15.6 | LYM183 | 12993.7 | O | 1.278 | 8.25E−01 | 5 |
| LYM15 | 11612.3 | D | 0.285 | 3.59E−01 | 25.4 | LYM270 | 12871.5 | O | 1.292 | 8.85E−01 | 6.2 |
| LYM289 | 12491.1 | D | 0.281 | 3.79E−01 | 23.7 | LYM183 | 12994.7 | O | 1.24 | 8.96E−01 | 2 |
| LYM130 | 12332.2 | D | 0.274 | 3.79E−01 | 20.6 | LYM212 | 13034.9 | O | 1.27 | 9.25E−01 | 4.4 |
| LYM174 | 12414.3 | D | 0.313 | 3.80E−01 | 37.5 | LYM208 | 13012.5 | O | 1.249 | 9.35E−01 | 2.7 |
| LYM100 | 12133.1 | D | 0.252 | 3.84E−01 | 10.8 | CONTROL | — | O | 1.217 | — | 0 |
| LYM141 | 12404.4 | D | 0.27 | 3.96E−01 | 18.9 | LYM289 | 12493.1 | P | 2.457 | 6.00E−06 | 34.4 |
| LYM162 | 12234.4 | D | 0.307 | 4.01E−01 | 35 | LYM153 | 12323.2 | P | 2.348 | 3.90E−05 | 28.5 |
| LYM21 | 11671.2 | D | 0.252 | 4.34E−01 | 11.1 | LYM138 | 12561.1 | P | 2.896 | 4.80E−05 | 58.4 |
| LYM15 | 11611.3 | D | 0.286 | 4.64E−01 | 25.9 | LYM288 | 12743.9 | P | 2.278 | 1.08E−04 | 24.6 |
| LYM10 | 11744.5 | D | 0.263 | 4.65E−01 | 15.5 | LYM106 | 12144.4 | P | 2.162 | 1.09E−03 | 18.3 |
| LYM174 | 12412.1 | D | 0.283 | 4.68E−01 | 24.5 | LYM130 | 12334.1 | P | 2.123 | 1.12E−03 | 16.2 |
| LYM174 | 12411.3 | D | 0.259 | 4.73E−01 | 13.9 | LYM105 | 12297.2 | P | 2.123 | 1.13E−03 | 16.1 |
| LYM289 | 12491.4 | D | 0.25 | 4.85E−01 | 9.9 | LYM173 | 12981.6 | P | 2.088 | 2.27E−03 | 14.2 |
| LYM113 | 12442.1 | D | 0.235 | 5.12E−01 | 3.6 | LYM105 | 12293.1 | P | 2.252 | 3.65E−03 | 23.2 |
| LYM143 | 12521.2 | D | 0.244 | 5.14E−01 | 7.1 | LYM105 | 12294.2 | P | 2.061 | 3.93E−03 | 12.8 |
| LYM102 | 12222.3 | D | 0.274 | 5.18E−01 | 20.7 | LYM137 | 12153.1 | P | 2.057 | 4.42E−03 | 12.5 |
| LYM111 | 12251.1 | D | 0.264 | 5.22E−01 | 16.1 | LYM197 | 12821.6 | P | 2.058 | 4.44E−03 | 12.6 |
| LYM17 | 11682.1 | D | 0.272 | 5.33E−01 | 19.6 | LYM138 | 12561.3 | P | 2.487 | 6.03E−03 | 36.1 |
| LYM268 | 12483.4 | D | 0.258 | 5.50E−01 | 13.3 | LYM107 | 12631.4 | P | 2.034 | 7.95E−03 | 11.3 |
| LYM21 | 11672.4 | D | 0.265 | 5.55E−01 | 16.5 | LYM102 | 12222.3 | P | 2.079 | 9.12E−03 | 13.8 |
| LYM290 | 12502.4 | D | 0.255 | 6.03E−01 | 12.4 | LYM111 | 12254.4 | P | 2.013 | 1.74E−02 | 10.1 |
| LYM268 | 12482.3 | D | 0.239 | 6.08E−01 | 5.1 | LYM102 | 12222.1 | P | 2.019 | 1.77E−02 | 10.5 |
| LYM290 | 12501.3 | D | 0.242 | 6.70E−01 | 6.6 | LYM106 | 12141.4 | P | 1.999 | 1.86E−02 | 9.4 |
| LYM105 | 12294.2 | D | 0.263 | 7.15E−01 | 15.6 | LYM119 | 12463.2 | P | 2.427 | 2.00E−02 | 32.8 |
| LYM100 | 12131.3 | D | 0.246 | 7.22E−01 | 8.2 | LYM153 | 12322.1 | P | 2.025 | 2.34E−02 | 10.8 |
| LYM111 | 12252.2 | D | 0.252 | 7.44E−01 | 10.7 | LYM270 | 12873.6 | P | 2.19 | 2.39E−02 | 19.8 |
| LYM1 | 11601.1 | D | 0.241 | 7.48E−01 | 6.1 | LYM102 | 12222.2 | P | 2.26 | 2.62E−02 | 23.6 |
| LYM22 | 11762.1 | D | 0.236 | 7.59E−01 | 3.6 | LYM137 | 12151.4 | P | 2.247 | 2.89E−02 | 22.9 |
| LYM148 | 12172.1 | D | 0.251 | 7.85E−01 | 10.2 | LYM174 | 12414.3 | P | 2.533 | 2.94E−02 | 38.6 |
| LYM268 | 12482.1 | D | 0.243 | 8.20E−01 | 6.9 | LYM212 | 13032.8 | P | 2.004 | 3.00E−02 | 9.6 |
| LYM137 | 12153.1 | D | 0.24 | 8.22E−01 | 5.4 | LYM152 | 12373.1 | P | 2.094 | 4.88E−02 | 14.6 |
| LYM10 | 11742.1 | D | 0.243 | 8.33E−01 | 7.1 | LYM102 | 12221.1 | P | 1.969 | 5.91E−02 | 7.7 |
| LYM162 | 12233.2 | D | 0.236 | 8.50E−01 | 3.7 | LYM119 | 12461.4 | P | 2.483 | 6.35E−02 | 35.8 |
| LYM140 | 12261.4 | D | 0.234 | 8.56E−01 | 2.9 | LYM130 | 12332.2 | P | 2.183 | 6.35E−02 | 19.5 |
| LYM290 | 12502.1 | D | 0.234 | 8.96E−01 | 3.1 | LYM153 | 12324.2 | P | 2.207 | 6.58E−02 | 20.7 |
| LYM143 | 12523.4 | D | 0.232 | 9.21E−01 | 1.9 | LYM289 | 12492.2 | P | 2.063 | 6.71E−02 | 12.8 |
| LYM9 | 11633.2 | D | 0.23 | 9.45E−01 | 1.4 | LYM173 | 12982.6 | P | 1.944 | 7.81E−02 | 6.4 |
| LYM111 | 12254.4 | D | 0.228 | 9.48E−01 | 0.3 | LYM289 | 12493.2 | P | 2.307 | 8.42E−02 | 26.2 |
| LYM152 | 12373.2 | D | 0.227 | 9.98E−01 | 0 | LYM137 | 12151.1 | P | 2.145 | 9.13E−02 | 17.3 |
| CONTROL | — | D | 0.227 | — | 0 | LYM220 | 12851.8 | P | 2.294 | 9.18E−02 | 25.5 |
| LYM4 | 11706.5 | E | 8.938 | 2.20E−05 | 18.6 | LYM100 | 12131.3 | P | 2.001 | 1.04E−01 | 9.5 |
| LYM102 | 12222.2 | E | 8.875 | 3.70E−05 | 17.8 | LYM130 | 12332.1 | P | 2.437 | 1.12E−01 | 33.4 |
| LYM119 | 12462.2 | E | 8.866 | 3.80E−05 | 17.7 | LYM119 | 12461.1 | P | 2.383 | 1.15E−01 | 30.4 |
| LYM138 | 12561.1 | E | 8.813 | 4.40E−05 | 16.9 | LYM242 | 13051.8 | P | 2.011 | 1.19E−01 | 10 |
| LYM10 | 11742.2 | E | 8.688 | 9.10E−05 | 15.3 | LYM288 | 12743.5 | P | 2.299 | 1.24E−01 | 25.8 |
| LYM105 | 12293.1 | E | 8.563 | 2.01E−04 | 13.6 | LYM106 | 12142.2 | P | 2.411 | 1.25E−01 | 31.9 |
| LYM152 | 12372.2 | E | 8.563 | 2.01E−04 | 13.6 | LYM105 | 12295.2 | P | 2.243 | 1.29E−01 | 22.7 |
| LYM1 | 11602.6 | E | 9.125 | 7.59E−04 | 21.1 | LYM105 | 12294.3 | P | 1.953 | 1.30E−01 | 6.9 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM19 | 11753.1 | E | 8.313 | 1.23E−03 | 10.3 | LYM107 | 12631.2 | P | 2.022 | 1.32E−01 | 10.7 |
| LYM1 | 11603.2 | E | 8.25 | 1.75E−03 | 9.5 | LYM153 | 12324.1 | P | 2.309 | 1.37E−01 | 26.3 |
| LYM10 | 11744.1 | E | 8.125 | 4.92E−03 | 7.8 | LYM174 | 12412.1 | P | 2.359 | 1.38E−01 | 29.1 |
| LYM130 | 12333.1 | E | 8.375 | 9.64E−03 | 11.1 | LYM174 | 12411.2 | P | 2.258 | 1.41E−01 | 23.5 |
| LYM132 | 12271.4 | E | 8.375 | 9.64E−03 | 11.1 | LYM242 | 13052.5 | P | 2.002 | 1.43E−01 | 9.5 |
| LYM174 | 12414.3 | E | 8.375 | 9.64E−03 | 11.1 | LYM107 | 12632.3 | P | 2.326 | 1.47E−01 | 27.2 |
| LYM10 | 11741.2 | E | 9.063 | 1.38E−02 | 20.3 | LYM106 | 12144.3 | P | 2.131 | 1.69E−01 | 16.6 |
| LYM130 | 12332.2 | E | 8.688 | 2.64E−02 | 15.3 | LYM174 | 12411.3 | P | 2.458 | 1.72E−01 | 34.5 |
| LYM130 | 12334.1 | E | 8.688 | 2.64E−02 | 15.3 | LYM212 | 13031.6 | P | 1.969 | 1.78E−01 | 7.7 |
| LYM141 | 12402.4 | E | 8.688 | 2.64E−02 | 15.3 | LYM152 | 12371.3 | P | 2.06 | 1.86E−01 | 12.7 |
| LYM113 | 12442.1 | E | 7.938 | 3.53E−02 | 5.3 | LYM255 | 13082.8 | P | 2.312 | 2.00E−01 | 26.5 |
| LYM9 | 11632.1 | E | 8.438 | 4.54E−02 | 12 | LYM153 | 12321.2 | P | 2.11 | 2.02E−01 | 15.4 |
| LYM143 | 12524.7 | E | 9 | 4.73E−02 | 19.4 | LYM119 | 12462.1 | P | 2.418 | 2.08E−01 | 32.3 |
| LYM132 | 12275.1 | E | 7.875 | 5.28E−02 | 4.5 | LYM242 | 13053.7 | P | 1.914 | 2.14E−01 | 4.7 |
| LYM9 | 11633.7 | E | 7.875 | 5.28E−02 | 4.5 | LYM288 | 12743.8 | P | 2.072 | 2.20E−01 | 13.4 |
| LYM17 | 11681.4 | E | 7.917 | 5.73E−02 | 5.1 | LYM289 | 12491.1 | P | 1.959 | 2.38E−01 | 7.2 |
| LYM100 | 12133.1 | E | 8.313 | 6.24E−02 | 10.3 | LYM111 | 12252.2 | P | 2.148 | 2.40E−01 | 17.5 |
| LYM119 | 12461.4 | E | 8.313 | 6.24E−02 | 10.3 | LYM255 | 13082.9 | P | 1.998 | 2.41E−01 | 9.3 |
| LYM21 | 11672.4 | E | 8 | 6.71E−02 | 6.2 | LYM119 | 12462.2 | P | 2.218 | 2.61E−01 | 21.3 |
| LYM17 | 11684.4 | E | 8.188 | 8.91E−02 | 8.6 | LYM137 | 12151.2 | P | 2.212 | 2.66E−01 | 21 |
| LYM19 | 11751.5 | E | 8.188 | 8.91E−02 | 8.6 | LYM289 | 12491.4 | P | 1.925 | 2.70E−01 | 5.3 |
| LYM143 | 12524.2 | E | 7.813 | 1.19E−01 | 3.7 | LYM107 | 12631.1 | P | 1.998 | 2.73E−01 | 9.3 |
| LYM15 | 11614.3 | E | 7.813 | 1.19E−01 | 3.7 | LYM106 | 12142.3 | P | 1.931 | 2.87E−01 | 5.6 |
| LYM148 | 12171.2 | E | 8.063 | 1.33E−01 | 7 | LYM138 | 12562.2 | P | 2.044 | 3.08E−01 | 11.8 |
| LYM162 | 12231.3 | E | 8.063 | 1.33E−01 | 7 | LYM255 | 13082.5 | P | 2.27 | 3.12E−01 | 24.2 |
| LYM19 | 11754.1 | E | 8.063 | 1.33E−01 | 7 | LYM255 | 13082.7 | P | 2.209 | 3.30E−01 | 20.9 |
| LYM141 | 12404.2 | E | 7.875 | 1.45E−01 | 4.5 | LYM152 | 12371.2 | P | 2.283 | 3.57E−01 | 24.9 |
| LYM289 | 12491.4 | E | 7.875 | 1.45E−01 | 4.5 | LYM90 | 12395.3 | P | 2.041 | 3.80E−01 | 11.7 |
| LYM119 | 12463.2 | E | 8.25 | 1.49E−01 | 9.5 | LYM287 | 12771.6 | P | 1.878 | 3.99E−01 | 2.8 |
| LYM289 | 12493.2 | E | 8.25 | 1.49E−01 | 9.5 | LYM107 | 12632.1 | P | 1.944 | 4.04E−01 | 6.4 |
| LYM162 | 12234.3 | E | 8.438 | 1.63E−01 | 12 | LYM102 | 12222.6 | P | 1.942 | 4.04E−01 | 6.2 |
| LYM148 | 12174.1 | E | 8.625 | 1.74E−01 | 14.5 | LYM288 | 12741.9 | P | 2.04 | 4.14E−01 | 11.6 |
| LYM140 | 12262.3 | E | 7.75 | 1.85E−01 | 2.8 | LYM138 | 12564.1 | P | 2.049 | 4.46E−01 | 12.1 |
| LYM3 | 12042.1 | E | 7.75 | 1.85E−01 | 2.8 | LYM291 | 12754.9 | P | 2.077 | 4.54E−01 | 13.7 |
| LYM15 | 11611.3 | E | 8.479 | 1.89E−01 | 12.5 | LYM287 | 12774.6 | P | 1.899 | 4.58E−01 | 3.9 |
| LYM141 | 12404.4 | E | 8.313 | 1.97E−01 | 10.3 | LYM173 | 12981.5 | P | 1.959 | 4.85E−01 | 7.2 |
| LYM162 | 12234.4 | E | 8.438 | 2.63E−01 | 12 | LYM130 | 12331.3 | P | 2.133 | 4.95E−01 | 16.7 |
| LYM289 | 12493.6 | E | 8 | 2.66E−01 | 6.2 | LYM137 | 12154.5 | P | 2.095 | 5.07E−01 | 14.6 |
| LYM290 | 12502.4 | E | 8 | 2.66E−01 | 6.2 | LYM201 | 12834.6 | P | 1.97 | 5.14E−01 | 7.8 |
| LYM174 | 12411.2 | E | 8.688 | 2.73E−01 | 15.3 | LYM143 | 12524.7 | P | 2.088 | 5.44E−01 | 14.2 |
| LYM290 | 12501.3 | E | 8.25 | 2.78E−01 | 9.5 | LYM201 | 12833.9 | P | 1.864 | 5.52E−01 | 2 |
| LYM1 | 11604.4 | E | 8.063 | 3.07E−01 | 7 | LYM142 | 12802.9 | P | 1.931 | 5.89E−01 | 5.7 |
| LYM21 | 11673.1 | E | 8.063 | 3.07E−01 | 7 | LYM201 | 12833.7 | P | 1.883 | 6.03E−01 | 3 |
| LYM17 | 11683.1 | E | 7.75 | 3.22E−01 | 2.8 | LYM183 | 12994.8 | P | 2.006 | 6.56E−01 | 9.7 |
| LYM2 | 11692.3 | E | 7.75 | 3.22E−01 | 2.8 | LYM100 | 12133.3 | P | 1.853 | 6.64E−01 | 1.4 |
| LYM119 | 12462.1 | E | 8.688 | 3.33E−01 | 15.3 | LYM130 | 12333.1 | P | 1.913 | 6.70E−01 | 4.7 |
| LYM141 | 12404.3 | E | 8.125 | 3.36E−01 | 7.8 | LYM143 | 12524.5 | P | 1.99 | 6.99E−01 | 8.9 |
| LYM102 | 12222.3 | E | 8.438 | 3.42E−01 | 12 | LYM291 | 12753.6 | P | 1.893 | 7.11E−01 | 3.6 |
| LYM289 | 12491.1 | E | 8.75 | 3.45E−01 | 16.1 | LYM142 | 12804.1 | P | 1.901 | 7.24E−01 | 4 |
| LYM137 | 12153.1 | E | 7.813 | 3.45E−01 | 3.7 | LYM143 | 12521.1 | P | 1.848 | 7.39E−01 | 1.1 |
| LYM143 | 12521.1 | E | 7.813 | 3.45E−01 | 3.7 | LYM44 | 11885.4 | P | 1.864 | 7.91E−01 | 2 |
| LYM21 | 11671.2 | E | 8.188 | 3.58E−01 | 8.6 | LYM270 | 12871.8 | P | 1.906 | 8.00E−01 | 4.3 |
| LYM17 | 11682.1 | E | 7.938 | 3.99E−01 | 5.3 | LYM270 | 12871.5 | P | 1.94 | 8.20E−01 | 6.1 |
| LYM1 | 11602.1 | E | 8 | 4.16E−01 | 6.2 | LYM208 | 13012.5 | P | 1.901 | 8.47E−01 | 4 |
| LYM152 | 12371.2 | E | 8 | 4.16E−01 | 6.2 | LYM183 | 12994.7 | P | 1.857 | 8.51E−01 | 1.6 |
| LYM268 | 12483.2 | E | 8 | 4.16E−01 | 6.2 | LYM198 | 13005.8 | P | 1.842 | 8.74E−01 | 0.8 |
| LYM19 | 11751.4 | E | 8.188 | 4.45E−01 | 8.6 | LYM183 | 12993.7 | P | 1.865 | 8.86E−01 | 2.1 |
| LYM15 | 11612.3 | E | 8.25 | 4.51E−01 | 9.5 | LYM152 | 12372.2 | P | 1.861 | 8.88E−01 | 1.8 |
| LYM268 | 12482.3 | E | 8.063 | 5.16E−01 | 7 | LYM287 | 12773.7 | P | 1.86 | 8.96E−01 | 1.8 |
| LYM132 | 12273.1 | E | 7.813 | 5.31E−01 | 3.7 | LYM142 | 12804.3 | P | 1.869 | 9.02E−01 | 2.3 |
| LYM138 | 12562.1 | E | 7.75 | 5.45E−01 | 2.8 | LYM212 | 13034.9 | P | 1.87 | 9.29E−01 | 2.3 |
| LYM138 | 12564.1 | E | 7.75 | 5.45E−01 | 2.8 | LYM44 | 11882.1 | P | 1.849 | 9.29E−01 | 1.2 |
| LYM3 | 12041.1 | E | 7.75 | 5.45E−01 | 2.8 | LYM255 | 13081.5 | P | 1.848 | 9.43E−01 | 1.1 |
| LYM148 | 12173.1 | E | 8.313 | 5.58E−01 | 10.3 | LYM137 | 12152.1 | P | 1.834 | 9.58E−01 | 0.3 |
| LYM268 | 12483.4 | E | 7.625 | 5.60E−01 | 1.2 | LYM174 | 12414.2 | P | 1.832 | 9.58E−01 | 0.2 |
| LYM106 | 12141.4 | E | 7.688 | 5.77E−01 | 2 | LYM183 | 12993.5 | P | 1.839 | 9.59E−01 | 0.6 |
| LYM2 | 11693.3 | E | 7.688 | 5.77E−01 | 2 | LYM270 | 12872.7 | P | 1.836 | 9.62E−01 | 0.4 |
| LYM9 | 11633.2 | E | 7.688 | 5.77E−01 | 2 | LYM173 | 12982.7 | P | 1.836 | 9.78E−01 | 0.4 |
| LYM162 | 12231.1 | E | 8 | 5.91E−01 | 6.2 | LYM173 | 12981.8 | P | 1.832 | 9.86E−01 | 0.3 |
| LYM105 | 12294.2 | E | 7.875 | 6.19E−01 | 4.5 | CONTROL | — | P | 1.828 | — | 0 |
| LYM138 | 12561.3 | E | 7.875 | 6.19E−01 | 4.5 | LYM57 | 12012.2 | A | 93.32 | 8.80E−03 | 2.5 |
| LYM174 | 12412.1 | E | 7.854 | 6.25E−01 | 4.2 | LYM14 | 12054.2 | A | 93.018 | 1.70E−02 | 2.2 |
| LYM3 | 12041.2 | E | 8.063 | 6.33E−01 | 7 | LYM148 | 12171.2 | A | 93.029 | 1.75E−02 | 2.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM10 | 11742.1 | E | 7.813 | 6.40E−01 | 3.7 | LYM152 | 12373.1 | A | 92.621 | 4.54E−02 | 1.8 |
| LYM174 | 12411.3 | E | 8.125 | 6.61E−01 | 7.8 | LYM43 | 11791.2 | A | 93.704 | 4.64E−02 | 2.9 |
| LYM129 | 12573.5 | E | 7.625 | 6.64E−01 | 1.2 | LYM140 | 12262.3 | A | 92.865 | 5.07E−02 | 2 |
| LYM102 | 12221.1 | E | 7.75 | 6.70E−01 | 2.8 | LYM132 | 12273.2 | A | 93.098 | 5.40E−02 | 2.3 |
| LYM134 | 12311.2 | E | 7.75 | 6.70E−01 | 2.8 | LYM130 | 12331.3 | A | 92.487 | 5.67E−02 | 1.6 |
| LYM15 | 11612.2 | E | 7.75 | 6.70E−01 | 2.8 | LYM66 | 11954.5 | A | 93.427 | 5.73E−02 | 2.6 |
| LYM3 | 12043.1 | E | 7.75 | 6.70E−01 | 2.8 | LYM119 | 12461.4 | A | 93.297 | 6.70E−02 | 2.5 |
| LYM111 | 12251.1 | E | 7.875 | 6.83E−01 | 4.5 | LYM43 | 11791.4 | A | 92.385 | 7.11E−02 | 1.5 |
| LYM13 | 11771.6 | E | 7.875 | 6.83E−01 | 4.5 | LYM24 | 12063.3 | A | 93.233 | 7.13E−02 | 2.4 |
| LYM9 | 11632.2 | E | 7.607 | 7.08E−01 | 0.9 | LYM290 | 12504.1 | A | 93.35 | 8.10E−02 | 2.6 |
| LYM102 | 12222.6 | E | 7.875 | 7.30E−01 | 4.5 | LYM51 | 11891.1 | A | 92.507 | 8.56E−02 | 1.6 |
| LYM174 | 12414.2 | E | 7.75 | 7.43E−01 | 2.8 | LYM119 | 12462.1 | A | 92.346 | 8.64E−02 | 1.5 |
| LYM100 | 12131.3 | E | 7.813 | 7.57E−01 | 3.7 | LYM14 | 12051.1 | A | 93.318 | 9.94E−02 | 2.5 |
| LYM140 | 12261.1 | E | 7.625 | 7.90E−01 | 1.2 | LYM140 | 12264.1 | A | 92.45 | 1.09E−01 | 1.6 |
| LYM289 | 12492.2 | E | 7.643 | 8.18E−01 | 1.4 | LYM140 | 12261.4 | A | 93.706 | 1.36E−01 | 2.9 |
| LYM10 | 11744.5 | E | 7.625 | 8.54E−01 | 1.2 | LYM100 | 12131.2 | A | 92.899 | 1.46E−01 | 2.1 |
| LYM2 | 11695.3 | E | 7.625 | 8.54E−01 | 1.2 | LYM66 | 11955.2 | A | 93.905 | 1.53E−01 | 3.2 |
| LYM19 | 11752.2 | E | 7.688 | 8.62E−01 | 2 | LYM174 | 12411.2 | A | 91.981 | 1.83E−01 | 1.1 |
| LYM106 | 12142.2 | E | 7.563 | 8.70E−01 | 0.4 | LYM67 | 11781.5 | A | 92.297 | 1.95E−01 | 1.4 |
| LYM143 | 12523.4 | E | 7.563 | 8.70E−01 | 0.4 | LYM57 | 12012.6 | A | 92.094 | 1.96E−01 | 1.2 |
| LYM153 | 12321.2 | E | 7.625 | 8.89E−01 | 1.2 | LYM95 | 12124.4 | A | 92.049 | 2.11E−01 | 1.1 |
| LYM148 | 12172.1 | E | 7.563 | 9.62E−01 | 0.4 | LYM152 | 12372.2 | A | 93.098 | 2.28E−01 | 2.3 |
| LYM148 | 12174.2 | E | 7.563 | 9.62E−01 | 0.4 | LYM172 | 12302.2 | A | 91.937 | 2.30E−01 | 1 |
| LYM4 | 11705.2 | E | 7.542 | 9.88E−01 | 0.1 | LYM119 | 12462.2 | A | 92.969 | 2.34E−01 | 2.1 |
| CONTROL | — | E | 7.536 | — | 0 | LYM95 | 12124.6 | A | 93.693 | 2.49E−01 | 2.9 |
| LYM143 | 12524.7 | F | 0.512 | 4.90E−05 | 57.7 | LYM68 | 11942.2 | A | 91.902 | 2.57E−01 | 1 |
| LYM138 | 12561.1 | F | 0.508 | 5.30E−05 | 56.2 | LYM290 | 12502.4 | A | 92.194 | 3.14E−01 | 1.3 |
| LYM289 | 12493.2 | F | 0.485 | 1.47E−04 | 49.2 | LYM51 | 11894.2 | A | 93.154 | 3.27E−01 | 2.3 |
| LYM10 | 11742.2 | F | 0.469 | 2.28E−04 | 44.2 | LYM53 | 11844.2 | A | 92.758 | 3.35E−01 | 1.9 |
| LYM102 | 12222.2 | F | 0.475 | 3.63E−04 | 46.1 | LYM100 | 12131.3 | A | 92.172 | 3.40E−01 | 1.3 |
| LYM148 | 12174.1 | F | 0.455 | 4.47E−04 | 40 | LYM31 | 11923.1 | A | 92.407 | 3.77E−01 | 1.5 |
| LYM132 | 12271.4 | F | 0.454 | 4.55E−04 | 39.8 | LYM67 | 11782.6 | A | 92.138 | 3.82E−01 | 1.2 |
| LYM119 | 12463.2 | F | 0.44 | 9.36E−04 | 35.6 | LYM3 | 12043.1 | A | 91.872 | 4.24E−01 | 0.9 |
| LYM19 | 11754.1 | F | 0.44 | 9.71E−04 | 35.6 | LYM24 | 12061.4 | A | 94.35 | 4.31E−01 | 3.7 |
| LYM132 | 12273.2 | F | 0.455 | 1.09E−03 | 40.1 | LYM143 | 12523.4 | A | 92.469 | 4.55E−01 | 1.6 |
| LYM10 | 11741.2 | F | 0.525 | 1.40E−03 | 61.5 | LYM14 | 12051.4 | A | 92.827 | 4.66E−01 | 2 |
| LYM105 | 12293.1 | F | 0.425 | 2.11E−03 | 30.8 | LYM170 | 12453.2 | A | 91.512 | 4.71E−01 | 0.5 |
| LYM19 | 11753.1 | F | 0.439 | 2.71E−03 | 35 | LYM138 | 12566.1 | A | 91.508 | 4.74E−01 | 0.5 |
| LYM4 | 11705.2 | F | 0.42 | 2.85E−03 | 29.4 | LYM254 | 12472.3 | A | 92.469 | 5.07E−01 | 1.6 |
| LYM119 | 12461.4 | F | 0.416 | 3.48E−03 | 28.2 | LYM254 | 12474.4 | A | 93.013 | 5.16E−01 | 2.2 |
| LYM10 | 11744.1 | F | 0.459 | 7.24E−03 | 41.1 | LYM152 | 12371.2 | A | 91.463 | 5.20E−01 | 0.5 |
| LYM152 | 12371.2 | F | 0.399 | 1.05E−02 | 22.8 | LYM137 | 12152.1 | A | 92.231 | 5.23E−01 | 1.3 |
| LYM19 | 11751.4 | F | 0.397 | 1.36E−02 | 22.1 | LYM14 | 12052.5 | A | 91.587 | 5.37E−01 | 0.6 |
| LYM130 | 12334.1 | F | 0.482 | 1.68E−02 | 48.5 | LYM69 | 11852.2 | A | 92.89 | 5.41E−01 | 2 |
| LYM137 | 12153.1 | F | 0.396 | 1.72E−02 | 22 | LYM68 | 11942.3 | A | 91.429 | 5.48E−01 | 0.4 |
| LYM4 | 11706.5 | F | 0.473 | 1.86E−02 | 45.6 | LYM43 | 11792.2 | A | 93.065 | 5.58E−01 | 2.2 |
| LYM174 | 12414.3 | F | 0.515 | 1.92E−02 | 58.5 | LYM69 | 11853.5 | A | 91.52 | 5.63E−01 | 0.5 |
| LYM289 | 12491.4 | F | 0.399 | 1.98E−02 | 22.7 | LYM69 | 11853.4 | A | 91.48 | 5.87E−01 | 0.5 |
| LYM141 | 12402.4 | F | 0.451 | 2.34E−02 | 38.9 | LYM67 | 11782.4 | A | 92.568 | 6.01E−01 | 1.7 |
| LYM9 | 11632.1 | F | 0.557 | 2.82E−02 | 71.3 | LYM162 | 12234.3 | A | 92.261 | 6.30E−01 | 1.4 |
| LYM140 | 12262.3 | F | 0.431 | 3.06E−02 | 32.7 | LYM132 | 12275.1 | A | 91.468 | 6.30E−01 | 0.5 |
| LYM130 | 12333.1 | F | 0.439 | 3.87E−02 | 35 | LYM67 | 11782.5 | A | 91.378 | 6.44E−01 | 0.4 |
| LYM152 | 12372.2 | F | 0.412 | 3.93E−02 | 26.7 | LYM268 | 12481.1 | A | 91.441 | 6.58E−01 | 0.5 |
| LYM1 | 11604.4 | F | 0.439 | 4.25E−02 | 35.1 | LYM31 | 11921.3 | A | 91.536 | 6.83E−01 | 0.6 |
| LYM1 | 11603.2 | F | 0.377 | 4.78E−02 | 16 | LYM95 | 12121.4 | A | 91.62 | 6.87E−01 | 0.7 |
| LYM141 | 12404.3 | F | 0.371 | 6.69E−02 | 14.3 | LYM143 | 12524.2 | A | 91.662 | 7.07E−01 | 0.7 |
| LYM162 | 12231.1 | F | 0.433 | 7.48E−02 | 33.4 | LYM57 | 12013.3 | A | 92.476 | 7.11E−01 | 1.6 |
| LYM13 | 11772.1 | F | 0.369 | 7.58E−02 | 13.7 | LYM62 | 12022.4 | A | 91.95 | 7.18E−01 | 1 |
| LYM1 | 11602.1 | F | 0.379 | 7.70E−02 | 16.7 | LYM26 | 11824.1 | A | 91.683 | 7.41E−01 | 0.7 |
| LYM162 | 12231.3 | F | 0.399 | 8.40E−02 | 22.7 | LYM174 | 12412.1 | A | 91.387 | 7.62E−01 | 0.4 |
| LYM16 | 11624.4 | F | 0.395 | 8.75E−02 | 21.6 | LYM67 | 11783.5 | A | 91.709 | 7.63E−01 | 0.8 |
| LYM138 | 12561.3 | F | 0.468 | 8.78E−02 | 44 | LYM105 | 12293.1 | A | 91.757 | 7.81E−01 | 0.8 |
| LYM9 | 11632.2 | F | 0.385 | 9.44E−02 | 18.5 | LYM30 | 11913.5 | A | 91.617 | 7.83E−01 | 0.7 |
| LYM140 | 12261.1 | F | 0.369 | 9.78E−02 | 13.6 | LYM95 | 12124.5 | A | 91.305 | 7.91E−01 | 0.3 |
| LYM17 | 11681.4 | F | 0.408 | 9.89E−02 | 25.5 | LYM172 | 12301.2 | A | 91.351 | 7.92E−01 | 0.4 |
| LYM100 | 12133.1 | F | 0.432 | 1.18E−01 | 33 | LYM43 | 11791.5 | A | 91.202 | 7.93E−01 | 0.2 |
| LYM1 | 11602.6 | F | 0.554 | 1.25E−01 | 70.6 | LYM53 | 11843.2 | A | 94.942 | 7.95E−01 | 4.3 |
| LYM174 | 12411.3 | F | 0.444 | 1.29E−01 | 36.6 | LYM170 | 12454.2 | A | 91.469 | 7.97E−01 | 0.5 |
| LYM289 | 12492.2 | F | 0.369 | 1.39E−01 | 13.6 | LYM119 | 12463.2 | A | 91.489 | 8.08E−01 | 0.5 |
| LYM162 | 12234.4 | F | 0.427 | 1.55E−01 | 31.5 | LYM111 | 12254.4 | A | 91.509 | 8.21E−01 | 0.5 |
| LYM140 | 12264.1 | F | 0.36 | 1.58E−01 | 10.7 | LYM31 | 11922.3 | A | 91.575 | 8.21E−01 | 0.6 |
| LYM129 | 12573.5 | F | 0.359 | 1.61E−01 | 10.5 | LYM138 | 12562.1 | A | 91.448 | 8.41E−01 | 0.5 |
| LYM132 | 12275.1 | F | 0.399 | 1.64E−01 | 22.9 | LYM174 | 12411.3 | A | 91.386 | 8.43E−01 | 0.4 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM153 | 12323.2 | F | 0.358 | 1.76E−01 | 10.2 | LYM51 | 11893.2 | A | 91.333 | 8.55E−01 | 0.3 |
| LYM21 | 11673.1 | F | 0.413 | 1.80E−01 | 27.1 | LYM170 | 12453.3 | A | 91.321 | 8.70E−01 | 0.3 |
| LYM15 | 11612.2 | F | 0.378 | 1.96E−01 | 16.3 | LYM62 | 12021.1 | A | 91.17 | 8.74E−01 | 0.2 |
| LYM162 | 12234.3 | F | 0.424 | 1.97E−01 | 30.6 | LYM140 | 12261.2 | A | 91.321 | 8.80E−01 | 0.3 |
| LYM141 | 12404.4 | F | 0.418 | 1.98E−01 | 28.7 | LYM134 | 12312.4 | A | 91.24 | 8.83E−01 | 0.2 |
| LYM148 | 12171.2 | F | 0.452 | 2.19E−01 | 39 | LYM172 | 12301.3 | A | 91.364 | 8.86E−01 | 0.4 |
| LYM19 | 11752.2 | F | 0.408 | 2.21E−01 | 25.5 | LYM152 | 12372.1 | A | 91.144 | 8.89E−01 | 0.1 |
| LYM119 | 12462.2 | F | 0.457 | 2.36E−01 | 40.7 | LYM143 | 12521.1 | A | 91.389 | 8.93E−01 | 0.4 |
| LYM15 | 11611.3 | F | 0.446 | 2.37E−01 | 37.3 | LYM30 | 11913.3 | A | 91.204 | 8.94E−01 | 0.2 |
| LYM13 | 11771.6 | F | 0.355 | 2.37E−01 | 9.2 | LYM119 | 12461.1 | A | 91.151 | 9.05E−01 | 0.1 |
| LYM19 | 11751.5 | F | 0.396 | 2.37E−01 | 21.9 | LYM57 | 12012.4 | A | 91.474 | 9.22E−01 | 0.5 |
| LYM113 | 12442.1 | F | 0.407 | 2.56E−01 | 25.4 | LYM254 | 12474.3 | A | 91.298 | 9.38E−01 | 0.3 |
| LYM138 | 12564.1 | F | 0.355 | 2.62E−01 | 9.4 | LYM14 | 12052.4 | A | 91.121 | 9.52E−01 | 0.1 |
| LYM15 | 11614.4 | F | 0.358 | 2.72E−01 | 10.1 | LYM62 | 12023.4 | A | 91.112 | 9.60E−01 | 0.1 |
| LYM130 | 12332.2 | F | 0.481 | 2.74E−01 | 48 | LYM66 | 11952.1 | A | 91.069 | 9.64E−01 | 0 |
| LYM1 | 11601.1 | F | 0.403 | 2.92E−01 | 24.1 | LYM43 | 11793.2 | A | 91.06 | 9.73E−01 | 0 |
| LYM140 | 12261.4 | F | 0.359 | 2.93E−01 | 10.6 | LYM111 | 12254.3 | A | 91.041 | 9.81E−01 | 0 |
| LYM102 | 12222.3 | F | 0.451 | 2.97E−01 | 38.8 | LYM130 | 12332.2 | A | 91.095 | 9.83E−01 | 0.1 |
| LYM10 | 11742.1 | F | 0.394 | 3.00E−01 | 21.1 | LYM152 | 12376.1 | A | 91.052 | 9.90E−01 | 0 |
| LYM134 | 12311.2 | F | 0.401 | 3.03E−01 | 23.4 | CONTROL | — | A | 91.024 | — | 0 |
| LYM148 | 12174.2 | F | 0.349 | 3.05E−01 | 7.4 | LYM69 | 11853.5 | B | 0.382 | 7.33E−03 | 13.4 |
| LYM174 | 12414.2 | F | 0.393 | 3.10E−01 | 20.9 | LYM53 | 11841.2 | B | 0.407 | 1.01E−02 | 20.8 |
| LYM289 | 12493.6 | F | 0.38 | 3.17E−01 | 17.1 | LYM138 | 12561.1 | B | 0.418 | 1.55E−02 | 24 |
| LYM22 | 11762.1 | F | 0.361 | 3.24E−01 | 11.2 | LYM134 | 12314.2 | B | 0.366 | 5.15E−02 | 8.8 |
| LYM174 | 12412.1 | F | 0.425 | 3.25E−01 | 30.9 | LYM140 | 12264.1 | B | 0.362 | 7.22E−02 | 7.5 |
| LYM21 | 11671.2 | F | 0.393 | 3.28E−01 | 21 | LYM119 | 12461.1 | B | 0.397 | 1.11E−01 | 17.8 |
| LYM111 | 12251.1 | F | 0.395 | 3.31E−01 | 21.4 | LYM30 | 11913.5 | B | 0.356 | 1.56E−01 | 5.6 |
| LYM17 | 11684.5 | F | 0.347 | 3.33E−01 | 6.9 | LYM53 | 11844.2 | B | 0.377 | 1.57E−01 | 11.9 |
| LYM9 | 11633.7 | F | 0.406 | 3.55E−01 | 25 | LYM51 | 11894.2 | B | 0.358 | 1.63E−01 | 6.3 |
| LYM111 | 12254.4 | F | 0.346 | 3.64E−01 | 6.5 | LYM51 | 11891.1 | B | 0.358 | 1.64E−01 | 6.2 |
| LYM143 | 12524.2 | F | 0.352 | 3.68E−01 | 8.3 | LYM100 | 12131.2 | B | 0.361 | 1.82E−01 | 7.3 |
| LYM106 | 12142.2 | F | 0.351 | 3.69E−01 | 8.1 | LYM53 | 11841.1 | B | 0.361 | 1.82E−01 | 7.3 |
| LYM15 | 11614.3 | F | 0.427 | 3.69E−01 | 31.5 | LYM111 | 12251.3 | B | 0.398 | 2.06E−01 | 18.2 |
| LYM10 | 11744.5 | F | 0.353 | 3.79E−01 | 8.6 | LYM143 | 12524.2 | B | 0.446 | 2.56E−01 | 32.3 |
| LYM119 | 12462.1 | F | 0.49 | 3.83E−01 | 50.8 | LYM57 | 12013.5 | B | 0.383 | 2.62E−01 | 13.6 |
| LYM174 | 12411.2 | F | 0.393 | 3.90E−01 | 20.8 | LYM138 | 12561.3 | B | 0.381 | 2.70E−01 | 13.2 |
| LYM268 | 12483.2 | F | 0.427 | 3.97E−01 | 31.4 | LYM111 | 12252.2 | B | 0.368 | 2.79E−01 | 9.1 |
| LYM17 | 11684.4 | F | 0.379 | 4.02E−01 | 16.6 | LYM172 | 12301.2 | B | 0.35 | 3.03E−01 | 3.9 |
| LYM13 | 11771.9 | F | 0.392 | 4.05E−01 | 20.7 | LYM138 | 12562.1 | B | 0.357 | 3.98E−01 | 6 |
| LYM289 | 12491.1 | F | 0.43 | 4.12E−01 | 32.5 | LYM268 | 12482.3 | B | 0.359 | 4.07E−01 | 6.7 |
| LYM290 | 12502.4 | F | 0.345 | 4.15E−01 | 6.3 | LYM51 | 11893.2 | B | 0.348 | 4.13E−01 | 3.4 |
| LYM17 | 11682.1 | F | 0.41 | 4.20E−01 | 26.2 | LYM105 | 12295.2 | B | 0.367 | 4.31E−01 | 8.9 |
| LYM148 | 12172.1 | F | 0.369 | 4.31E−01 | 13.6 | LYM105 | 12293.1 | B | 0.36 | 4.56E−01 | 6.9 |
| LYM105 | 12294.2 | F | 0.389 | 4.33E−01 | 19.8 | LYM290 | 12502.4 | B | 0.351 | 4.58E−01 | 4.3 |
| LYM2 | 11695.3 | F | 0.351 | 4.55E−01 | 7.9 | LYM268 | 12483.2 | B | 0.373 | 4.72E−01 | 10.8 |
| LYM102 | 12222.6 | F | 0.371 | 4.65E−01 | 14.2 | LYM143 | 12521.2 | B | 0.378 | 5.08E−01 | 12.1 |
| LYM15 | 11612.3 | F | 0.385 | 4.85E−01 | 18.5 | LYM62 | 12021.1 | B | 0.368 | 5.10E−01 | 9.3 |
| LYM143 | 12521.1 | F | 0.353 | 4.93E−01 | 8.6 | LYM68 | 11941.4 | B | 0.408 | 5.11E−01 | 21.2 |
| LYM290 | 12501.3 | F | 0.399 | 5.13E−01 | 22.9 | LYM290 | 12501.3 | B | 0.361 | 5.13E−01 | 7.3 |
| LYM153 | 12321.2 | F | 0.388 | 5.47E−01 | 19.4 | LYM148 | 12174.2 | B | 0.347 | 5.34E−01 | 3 |
| LYM17 | 11683.7 | F | 0.338 | 5.62E−01 | 4 | LYM31 | 11923.4 | B | 0.351 | 5.39E−01 | 4.3 |
| LYM268 | 12483.4 | F | 0.361 | 5.88E−01 | 11.1 | LYM14 | 12052.5 | B | 0.346 | 5.46E−01 | 2.8 |
| LYM102 | 12221.1 | F | 0.348 | 5.96E−01 | 7.2 | LYM111 | 12254.4 | B | 0.346 | 5.71E−01 | 2.8 |
| LYM2 | 11693.3 | F | 0.368 | 6.14E−01 | 13.1 | LYM51 | 11893.4 | B | 0.349 | 5.77E−01 | 3.7 |
| LYM138 | 12562.1 | F | 0.361 | 6.15E−01 | 11.1 | LYM137 | 12153.1 | B | 0.378 | 5.84E−01 | 12.3 |
| LYM21 | 11672.2 | F | 0.347 | 6.16E−01 | 6.8 | LYM132 | 12271.4 | B | 0.346 | 5.95E−01 | 2.8 |
| LYM13 | 11773.2 | F | 0.338 | 6.25E−01 | 4 | LYM138 | 12564.1 | B | 0.346 | 6.18E−01 | 2.8 |
| LYM132 | 12275.3 | F | 0.37 | 6.32E−01 | 13.9 | LYM30 | 11913.3 | B | 0.388 | 6.38E−01 | 15.2 |
| LYM130 | 12331.3 | F | 0.358 | 6.50E−01 | 10.2 | LYM137 | 12152.1 | B | 0.344 | 6.57E−01 | 2.3 |
| LYM148 | 12173.1 | F | 0.378 | 6.57E−01 | 16.3 | LYM14 | 12052.4 | B | 0.346 | 6.71E−01 | 2.6 |
| LYM3 | 12041.2 | F | 0.343 | 6.88E−01 | 5.7 | LYM119 | 12462.2 | B | 0.343 | 6.92E−01 | 1.9 |
| LYM137 | 12151.1 | F | 0.342 | 6.98E−01 | 5.3 | LYM254 | 12474.4 | B | 0.35 | 6.93E−01 | 3.9 |
| LYM106 | 12141.4 | F | 0.349 | 7.07E−01 | 7.4 | LYM43 | 11791.5 | B | 0.341 | 7.48E−01 | 1.3 |
| LYM141 | 12404.2 | F | 0.346 | 7.13E−01 | 6.6 | LYM62 | 12022.1 | B | 0.357 | 7.54E−01 | 6 |
| LYM143 | 12521.2 | F | 0.337 | 7.26E−01 | 3.6 | LYM53 | 11842.4 | B | 0.358 | 7.57E−01 | 6.3 |
| LYM105 | 12294.3 | F | 0.353 | 7.73E−01 | 8.6 | LYM105 | 12297.1 | B | 0.359 | 7.60E−01 | 6.7 |
| LYM100 | 12131.3 | F | 0.345 | 8.18E−01 | 6 | LYM162 | 12231.3 | B | 0.361 | 7.67E−01 | 7.3 |
| LYM9 | 11633.2 | F | 0.34 | 8.64E−01 | 4.6 | LYM137 | 12151.1 | B | 0.341 | 7.73E−01 | 1.3 |
| LYM111 | 12252.2 | F | 0.34 | 8.78E−01 | 4.8 | LYM57 | 12013.3 | B | 0.362 | 7.76E−01 | 7.5 |
| LYM268 | 12482.1 | F | 0.33 | 8.79E−01 | 1.6 | LYM68 | 11941.3 | B | 0.357 | 7.84E−01 | 6 |
| LYM113 | 12444.4 | F | 0.328 | 9.04E−01 | 0.8 | LYM172 | 12301.3 | B | 0.349 | 8.04E−01 | 3.7 |
| LYM162 | 12233.2 | F | 0.327 | 9.42E−01 | 0.5 | LYM148 | 12174.1 | B | 0.347 | 8.07E−01 | 3 |
| LYM102 | 12222.1 | F | 0.328 | 9.74E−01 | 0.9 | LYM51 | 11892.1 | B | 0.344 | 8.21E−01 | 2.3 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM153 | 12324.1 | F | 0.327 | 9.76E−01 | 0.5 | LYM53 | 11843.2 | B | 0.352 | 8.35E−01 | 4.4 |
| LYM106 | 12144.4 | F | 0.326 | 9.76E−01 | 0.3 | LYM268 | 12481.1 | B | 0.339 | 8.37E−01 | 0.8 |
| CONTROL | — | F | 0.325 | — | 0 | LYM137 | 12151.2 | B | 0.341 | 8.42E−01 | 1.3 |
| LYM19 | 11752.2 | G | 9.402 | 2.33E−04 | 43.1 | LYM68 | 11942.3 | B | 0.343 | 8.62E−01 | 1.9 |
| LYM143 | 12524.7 | G | 8.849 | 3.23E−04 | 34.7 | LYM290 | 12502.1 | B | 0.339 | 8.75E−01 | 0.6 |
| LYM132 | 12275.3 | G | 8.767 | 4.00E−04 | 33.4 | LYM134 | 12313.2 | B | 0.339 | 8.82E−01 | 0.6 |
| LYM15 | 11614.4 | G | 8.729 | 4.28E−04 | 32.9 | LYM30 | 11913.4 | B | 0.355 | 8.85E−01 | 5.5 |
| LYM4 | 11705.2 | G | 8.616 | 5.60E−04 | 31.2 | LYM152 | 12373.2 | B | 0.345 | 8.86E−01 | 2.4 |
| LYM9 | 11632.1 | G | 8.605 | 6.15E−04 | 31 | LYM31 | 11922.3 | B | 0.344 | 9.08E−01 | 2.3 |
| LYM13 | 11772.2 | G | 8.531 | 7.47E−04 | 29.8 | LYM69 | 11852.2 | B | 0.343 | 9.23E−01 | 1.9 |
| LYM174 | 12414.3 | G | 8.465 | 9.60E−04 | 28.8 | LYM67 | 11781.5 | B | 0.34 | 9.46E−01 | 1 |
| LYM132 | 12273.2 | G | 8.481 | 1.28E−03 | 29.1 | LYM152 | 12372.1 | B | 0.339 | 9.51E−01 | 0.6 |
| LYM105 | 12294.3 | G | 8.32 | 1.52E−03 | 26.6 | LYM57 | 12012.6 | B | 0.338 | 9.53E−01 | 0.2 |
| LYM138 | 12561.1 | G | 8.225 | 2.11E−03 | 25.2 | LYM154.5 | 12154.5 | B | 0.338 | 9.64E−01 | 0.4 |
| LYM19 | 11754.1 | G | 8.143 | 2.69E−03 | 23.9 | LYM172 | 12304.2 | B | 0.341 | 9.64E−01 | 1.3 |
| LYM113 | 12444.5 | G | 8.015 | 4.33E−03 | 22 | LYM57 | 12012.2 | B | 0.338 | 9.71E−01 | 0.2 |
| LYM111 | 12252.2 | G | 7.972 | 5.09E−03 | 21.3 | LYM268 | 12482.1 | B | 0.338 | 9.86E−01 | 0.2 |
| LYM153 | 12324.1 | G | 8.022 | 6.24E−03 | 22.1 | LYM67 | 11783.5 | B | 0.337 | 9.93E−01 | 0.1 |
| LYM130 | 12334.1 | G | 8.046 | 6.78E−03 | 22.5 | CONTROL | — | B | 0.337 | — | 0 |
| LYM174 | 12411.3 | G | 8.772 | 1.45E−02 | 33.5 | LYM137 | 12152.1 | C | 4.388 | 2.02E−02 | 15.2 |
| LYM17 | 11683.1 | G | 7.679 | 1.61E−02 | 16.9 | LYM53 | 11844.2 | C | 4.375 | 2.89E−02 | 14.9 |
| LYM130 | 12331.1 | G | 7.684 | 1.97E−02 | 17 | LYM111 | 12251.3 | C | 4.3 | 4.04E−02 | 12.9 |
| LYM15 | 11611.3 | G | 7.85 | 2.01E−02 | 19.5 | LYM51 | 11894.2 | C | 4.275 | 4.70E−02 | 12.3 |
| LYM10 | 11742.1 | G | 8.127 | 2.10E−02 | 23.7 | LYM148 | 12174.2 | C | 4.325 | 5.44E−02 | 13.6 |
| LYM17 | 11682.1 | G | 7.604 | 2.15E−02 | 15.7 | LYM138 | 12561.1 | C | 4.3 | 6.41E−02 | 12.9 |
| LYM111 | 12254.4 | G | 7.601 | 2.17E−02 | 15.7 | LYM111 | 12252.2 | C | 4.225 | 6.83E−02 | 11 |
| LYM153 | 12321.2 | G | 8.374 | 2.39E−02 | 27.5 | LYM119 | 12461.1 | C | 4.215 | 8.43E−01 | 10.7 |
| LYM113 | 12443.1 | G | 7.574 | 2.47E−02 | 15.3 | LYM111 | 12254.4 | C | 4.181 | 1.22E−01 | 9.8 |
| LYM100 | 12134.1 | G | 7.562 | 2.55E−02 | 15.1 | LYM53 | 11841.1 | C | 4.25 | 1.46E−01 | 11.6 |
| LYM289 | 12493.2 | G | 8.63 | 3.01E−02 | 31.4 | LYM290 | 12501.3 | C | 4.169 | 1.58E−01 | 9.5 |
| LYM22 | 11764.7 | G | 7.566 | 3.04E−02 | 15.2 | LYM137 | 12153.1 | C | 4.641 | 1.63E−01 | 21.9 |
| LYM130 | 12332.1 | G | 7.505 | 3.23E−02 | 14.2 | LYM143 | 12524.2 | C | 4.313 | 1.76E−01 | 13.3 |
| LYM1 | 11601.1 | G | 9.445 | 3.25E−02 | 43.8 | LYM137 | 12154.5 | C | 4.106 | 1.78E−01 | 7.9 |
| LYM153 | 12322.1 | G | 7.462 | 3.90E−02 | 13.6 | LYM134 | 12314.2 | C | 4.344 | 1.83E−01 | 14.1 |
| LYM100 | 12133.1 | G | 7.948 | 4.23E−02 | 21 | LYM138 | 12564.1 | C | 4.194 | 2.80E−01 | 10.2 |
| LYM102 | 12221.1 | G | 7.444 | 4.24E−02 | 13.3 | LYM254 | 12474.4 | C | 4.138 | 2.93E−01 | 8.7 |
| LYM140 | 12261.4 | G | 7.46 | 4.52E−02 | 13.5 | LYM119 | 12462.2 | C | 4.131 | 3.11E−01 | 8.5 |
| LYM22 | 11761.3 | G | 7.418 | 4.69E−02 | 12.9 | LYM51 | 11893.2 | C | 4.169 | 3.79E−01 | 9.5 |
| LYM105 | 12293.1 | G | 7.404 | 5.03E−02 | 12.7 | LYM69 | 11853.5 | C | 3.988 | 3.90E−01 | 4.7 |
| LYM132 | 12271.4 | G | 8.778 | 5.13E−02 | 33.6 | LYM140 | 12264.1 | C | 4.113 | 4.20E−01 | 8 |
| LYM132 | 12275.1 | G | 7.737 | 5.17E−02 | 17.8 | LYM105 | 12297.1 | C | 3.981 | 4.86E−01 | 4.6 |
| LYM134 | 12312.3 | G | 8.646 | 5.27E−02 | 31.6 | LYM51 | 11893.4 | C | 4.244 | 5.14E−01 | 11.5 |
| LYM162 | 12234.4 | G | 7.461 | 5.37E−02 | 13.6 | LYM138 | 12561.3 | C | 4.281 | 5.21E−01 | 12.4 |
| LYM19 | 11753.1 | G | 7.793 | 6.24E−02 | 18.6 | LYM68 | 11941.4 | C | 4.123 | 5.24E−01 | 8.3 |
| LYM289 | 12493.6 | G | 8.218 | 6.32E−02 | 25.1 | LYM134 | 12312.4 | C | 3.956 | 6.33E−01 | 3.9 |
| LYM138 | 12566.1 | G | 7.349 | 8.04E−02 | 11.9 | LYM138 | 12562.1 | C | 3.913 | 6.53E−01 | 2.8 |
| LYM3 | 12042.1 | G | 8.328 | 8.35E−02 | 26.8 | LYM53 | 11843.2 | C | 3.975 | 6.64E−01 | 4.4 |
| LYM134 | 12314.2 | G | 8.442 | 8.52E−02 | 28.5 | LYM53 | 11841.2 | C | 4.02 | 6.89E−01 | 5.6 |
| LYM21 | 11674.5 | G | 7.261 | 9.00E−02 | 10.5 | LYM111 | 12251.1 | C | 3.994 | 7.37E−01 | 4.9 |
| LYM152 | 12371.3 | G | 7.554 | 9.80E−02 | 15 | LYM254 | 12472.3 | C | 3.988 | 7.61E−01 | 4.7 |
| LYM134 | 12311.2 | G | 7.539 | 1.05E−01 | 14.7 | LYM26 | 11824.1 | C | 3.969 | 7.64E−01 | 4.2 |
| LYM111 | 12251.1 | G | 7.512 | 1.05E−01 | 14.3 | LYM172 | 12304.1 | C | 3.864 | 7.87E−01 | 1.5 |
| LYM106 | 12144.4 | G | 7.54 | 1.07E−01 | 14.8 | LYM140 | 12261.1 | C | 3.856 | 8.15E−01 | 1.3 |
| LYM289 | 12491.4 | G | 7.442 | 1.10E−01 | 13.3 | LYM51 | 11891.1 | C | 3.85 | 8.33E−01 | 1.1 |
| LYM13 | 11773.2 | G | 7.78 | 1.11E−01 | 18.4 | LYM51 | 11892.1 | C | 3.856 | 8.47E−01 | 1.3 |
| LYM16 | 11624.4 | G | 7.504 | 1.12E−01 | 14.2 | LYM137 | 12151.1 | C | 3.881 | 8.63E−01 | 1.9 |
| LYM162 | 12233.2 | G | 7.205 | 1.15E−01 | 9.7 | LYM137 | 12151.1 | C | 3.894 | 8.70E−01 | 2.3 |
| LYM106 | 12144.3 | G | 8.298 | 1.25E−01 | 26.3 | LYM119 | 12462.1 | C | 3.831 | 9.06E−01 | 0.6 |
| LYM3 | 12041.2 | G | 7.351 | 1.34E−01 | 11.9 | LYM26 | 11824.5 | C | 3.831 | 9.06E−01 | 0.6 |
| LYM138 | 12562.1 | G | 7.156 | 1.44E−01 | 8.9 | LYM57 | 12013.3 | C | 3.88 | 9.10E−01 | 1.9 |
| LYM137 | 12153.1 | G | 8.565 | 1.46E−01 | 30.4 | LYM290 | 12504.1 | C | 3.856 | 9.32E−01 | 1.3 |
| LYM113 | 12442.2 | G | 7.703 | 1.48E−01 | 17.3 | LYM254 | 12474.3 | C | 3.825 | 9.39E−01 | 0.5 |
| LYM17 | 11681.4 | G | 7.506 | 1.49E−01 | 14.3 | LYM100 | 12131.2 | C | 3.819 | 9.68E−01 | 0.3 |
| LYM102 | 12222.2 | G | 7.661 | 1.59E−01 | 16.6 | LYM66 | 11954.5 | C | 3.813 | 9.80E−01 | 0.1 |
| LYM130 | 12333.1 | G | 7.538 | 1.65E−01 | 14.7 | LYM57 | 12012.6 | C | 3.813 | 9.80E−01 | 0.1 |
| LYM113 | 12442.1 | G | 8.277 | 1.67E−01 | 26 | CONTROL | — | C | 3.807 | — | 0 |
| LYM105 | 12294.2 | G | 7.504 | 1.68E−01 | 14.2 | LYM134 | 12314.2 | D | 0.474 | 2.43E−04 | 37.7 |
| LYM10 | 11742.2 | G | 8.764 | 1.69E−01 | 33.4 | LYM268 | 12482.3 | D | 0.452 | 7.22E−04 | 31.3 |
| LYM141 | 12404.4 | G | 8.028 | 1.72E−01 | 22.2 | LYM31 | 11923.4 | D | 0.442 | 1.43E−03 | 28.3 |
| LYM140 | 12261.1 | G | 8.77 | 1.78E−01 | 33.5 | LYM138 | 12561.1 | D | 0.49 | 4.94E−03 | 42.3 |
| LYM1 | 11602.1 | G | 7.474 | 1.80E−01 | 13.8 | LYM170 | 12453.2 | D | 0.43 | 7.39E−03 | 24.9 |
| LYM162 | 12231.3 | G | 7.512 | 1.84E−01 | 14.3 | LYM148 | 12171.2 | D | 0.435 | 8.04E−03 | 26.3 |
| LYM102 | 12222.3 | G | 7.906 | 1.85E−01 | 20.3 | LYM57 | 12013.5 | D | 0.414 | 1.08E−02 | 20.3 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM100 | 12131.2 | G | 7.783 | 1.88E−01 | 18.5 | LYM68 | 11942.3 | D | 0.431 | 1.45E−02 | 25.2 |
| LYM141 | 12404.1 | G | 7.443 | 1.92E−01 | 13.3 | LYM43 | 11791.5 | D | 0.471 | 1.54E−02 | 36.6 |
| LYM13 | 11772.1 | G | 7.643 | 1.99E−01 | 16.3 | LYM140 | 12264.1 | D | 0.408 | 1.74E−02 | 18.5 |
| LYM1 | 11602.6 | G | 7.443 | 1.99E−01 | 13.3 | LYM100 | 12131.2 | D | 0.495 | 4.32E−02 | 43.5 |
| LYM4 | 11706.3 | G | 7.166 | 2.00E−01 | 9.1 | LYM137 | 12152.1 | D | 0.39 | 4.90E−02 | 13.2 |
| LYM153 | 12323.2 | G | 7.968 | 2.11E−01 | 21.3 | LYM57 | 12012.2 | D | 0.39 | 5.17E−02 | 13.1 |
| LYM2 | 11695.3 | G | 7.819 | 2.19E−01 | 19 | LYM69 | 11853.5 | D | 0.428 | 6.11E−02 | 24.3 |
| LYM3 | 12043.1 | G | 8.856 | 2.24E−01 | 34.8 | LYM14 | 12052.4 | D | 0.387 | 6.34E−02 | 12.5 |
| LYM13 | 11771.9 | G | 8.782 | 2.27E−01 | 33.7 | LYM143 | 12524.2 | D | 0.459 | 6.71E−02 | 33.1 |
| LYM289 | 12492.2 | G | 7.521 | 2.28E−01 | 14.5 | LYM53 | 11841.1 | D | 0.462 | 7.65E−02 | 34.1 |
| LYM162 | 12231.1 | G | 7.976 | 2.31E−01 | 21.4 | LYM148 | 12174.1 | D | 0.537 | 8.03E−02 | 55.9 |
| LYM113 | 12444.4 | G | 8.066 | 2.38E−01 | 22.8 | LYM290 | 12502.4 | D | 0.444 | 8.80E−02 | 28.8 |
| LYM130 | 12332.2 | G | 8.4 | 2.46E−01 | 27.9 | LYM105 | 12294.3 | D | 0.401 | 9.08E−02 | 16.3 |
| LYM10 | 11744.5 | G | 7.025 | 2.46E−01 | 6.9 | LYM119 | 12462.1 | D | 0.501 | 1.14E−01 | 45.4 |
| LYM174 | 12412.1 | G | 8.37 | 2.55E−01 | 27.4 | LYM68 | 11941.3 | D | 0.429 | 1.18E−01 | 24.5 |
| LYM9 | 11632.2 | G | 7.505 | 2.64E−01 | 14.2 | LYM57 | 12012.6 | D | 0.375 | 1.65E−01 | 8.9 |
| LYM100 | 12133.3 | G | 7.444 | 2.66E−01 | 13.3 | LYM137 | 12151.1 | D | 0.427 | 1.68E−01 | 23.9 |
| LYM152 | 12372.2 | G | 7.52 | 2.67E−01 | 14.5 | LYM30 | 11913.5 | D | 0.411 | 1.70E−01 | 19.2 |
| LYM119 | 12461.4 | G | 8.264 | 2.68E−01 | 25.8 | LYM43 | 11791.4 | D | 0.417 | 1.74E−01 | 21.1 |
| LYM140 | 12262.3 | G | 8.232 | 2.72E−01 | 25.3 | LYM111 | 12252.2 | D | 0.658 | 1.79E−01 | 90.8 |
| LYM140 | 12264.1 | G | 8.753 | 2.84E−01 | 33.2 | LYM138 | 12561.3 | D | 0.452 | 2.37E−01 | 31.3 |
| LYM148 | 12172.1 | G | 8.295 | 2.85E−01 | 26.3 | LYM152 | 12372.2 | D | 0.381 | 2.51E−01 | 10.5 |
| LYM138 | 12564.1 | G | 7.27 | 2.88E−01 | 10.7 | LYM119 | 12462.2 | D | 0.417 | 2.52E−01 | 21.1 |
| LYM143 | 12521.1 | G | 7.433 | 2.89E−01 | 13.1 | LYM111 | 12254.4 | D | 0.395 | 2.69E−01 | 14.7 |
| LYM4 | 11706.5 | G | 7.381 | 2.90E−01 | 12.4 | LYM137 | 12154.5 | D | 0.408 | 2.69E−01 | 18.3 |
| LYM106 | 12141.4 | G | 7.836 | 2.92E−01 | 19.3 | LYM111 | 12251.3 | D | 0.4 | 3.04E−01 | 16 |
| LYM102 | 12222.6 | G | 7.608 | 2.95E−01 | 15.8 | LYM30 | 11912.6 | D | 0.424 | 3.16E−01 | 22.9 |
| LYM2 | 11693.3 | G | 7.68 | 3.07E−01 | 16.9 | LYM62 | 12021.1 | D | 0.42 | 3.20E−01 | 22 |
| LYM106 | 12142.2 | G | 8.085 | 3.09E−01 | 23.1 | LYM268 | 12481.1 | D | 0.395 | 3.24E−01 | 14.6 |
| LYM119 | 12461.1 | G | 8.061 | 3.13E−01 | 22.7 | LYM43 | 11792.2 | D | 0.386 | 3.28E−01 | 12 |
| LYM148 | 12174.2 | G | 7.997 | 3.17E−01 | 21.7 | LYM130 | 12331.3 | D | 0.364 | 3.67E−01 | 5.8 |
| LYM105 | 12297.1 | G | 7.589 | 3.25E−01 | 15.5 | LYM137 | 12153.1 | D | 0.394 | 3.68E−01 | 14.4 |
| LYM10 | 11744.1 | G | 8.494 | 3.37E−01 | 29.3 | LYM68 | 11942.2 | D | 0.382 | 3.96E−01 | 11 |
| LYM290 | 12501.3 | G | 8.098 | 3.38E−01 | 23.3 | LYM68 | 11943.2 | D | 0.406 | 4.05E−01 | 17.7 |
| LYM2 | 11695.2 | G | 7.382 | 3.44E−01 | 12.4 | LYM172 | 12301.2 | D | 0.412 | 4.21E−01 | 19.4 |
| LYM9 | 11633.7 | G | 7.296 | 3.48E−01 | 11.1 | LYM53 | 11844.2 | D | 0.414 | 4.32E−01 | 20.1 |
| LYM174 | 12414.2 | G | 7.922 | 3.51E−01 | 20.6 | LYM51 | 11893.4 | D | 0.45 | 4.63E−01 | 30.7 |
| LYM13 | 11771.6 | G | 7.035 | 3.52E−01 | 7.1 | LYM119 | 12461.1 | D | 0.486 | 4.65E−01 | 41 |
| LYM3 | 12041.1 | G | 8.129 | 3.75E−01 | 23.7 | LYM105 | 12295.2 | D | 0.379 | 4.68E−01 | 10 |
| LYM19 | 11751.5 | G | 7.911 | 3.82E−01 | 20.4 | LYM51 | 11893.2 | D | 0.368 | 4.81E−01 | 6.8 |
| LYM15 | 11614.3 | G | 7.807 | 3.82E−01 | 18.8 | LYM152 | 12376.1 | D | 0.394 | 4.85E−01 | 14.5 |
| LYM1 | 11604.4 | G | 7.122 | 3.96E−01 | 8.4 | LYM134 | 12312.4 | D | 0.369 | 4.91E−01 | 7.2 |
| LYM137 | 12152.1 | G | 8.261 | 4.00E−01 | 25.7 | LYM51 | 11894.2 | D | 0.36 | 5.02E−01 | 4.4 |
| LYM21 | 11674.1 | G | 6.882 | 4.03E−01 | 4.8 | LYM152 | 12372.1 | D | 0.43 | 5.13E−01 | 24.8 |
| LYM137 | 12151.1 | G | 7.901 | 4.07E−01 | 20.3 | LYM62 | 12022.1 | D | 0.373 | 5.37E−01 | 8.1 |
| LYM162 | 12234.3 | G | 8.004 | 4.22E−01 | 21.8 | LYM111 | 12254.3 | D | 0.446 | 5.43E−01 | 29.5 |
| LYM138 | 12561.1 | G | 6.87 | 4.25E−01 | 4.6 | LYM100 | 12131.3 | D | 0.357 | 5.49E−01 | 3.5 |
| LYM289 | 12491.1 | G | 7.202 | 4.30E−01 | 9.6 | LYM143 | 12524.7 | D | 0.45 | 5.61E−01 | 30.6 |
| LYM129 | 12573.5 | G | 7.198 | 4.45E−01 | 9.6 | LYM290 | 12502.2 | D | 0.401 | 5.62E−01 | 16.4 |
| LYM132 | 12276.1 | G | 7.232 | 4.45E−01 | 10.1 | LYM14 | 12051.4 | D | 0.365 | 5.63E−01 | 6 |
| LYM10 | 11741.2 | G | 7.633 | 4.60E−01 | 16.2 | LYM67 | 11783.5 | D | 0.386 | 6.06E−01 | 12 |
| LYM2 | 11691.2 | G | 7.396 | 4.69E−01 | 12.6 | LYM43 | 11793.2 | D | 0.375 | 6.13E−01 | 8.9 |
| LYM17 | 11684.5 | G | 7.527 | 4.73E−01 | 14.6 | LYM30 | 11912.7 | D | 0.359 | 6.25E−01 | 4.1 |
| LYM111 | 12254.3 | G | 7.474 | 4.74E−01 | 13.8 | LYM100 | 12133.3 | D | 0.356 | 6.28E−01 | 3.4 |
| LYM153 | 12324.2 | G | 7.351 | 4.78E−01 | 11.9 | LYM119 | 12461.4 | D | 0.376 | 6.48E−01 | 9.1 |
| LYM17 | 11684.4 | G | 7.29 | 4.79E−01 | 11 | LYM68 | 11941.4 | D | 0.353 | 6.66E−01 | 2.5 |
| LYM119 | 12462.2 | G | 6.941 | 4.86E−01 | 5.6 | LYM100 | 12134.1 | D | 0.363 | 6.77E−01 | 5.5 |
| LYM152 | 12371.2 | G | 7.565 | 4.94E−01 | 15.2 | LYM290 | 12501.3 | D | 0.362 | 7.05E−01 | 5.2 |
| LYM16 | 11623.5 | G | 7.011 | 4.96E−01 | 6.7 | LYM95 | 12124.4 | D | 0.352 | 7.39E−01 | 2.1 |
| LYM141 | 12404.3 | G | 7.036 | 5.07E−01 | 7.1 | LYM26 | 11824.6 | D | 0.362 | 7.57E−01 | 5 |
| LYM21 | 11673.1 | G | 8.617 | 5.09E−01 | 31.2 | LYM143 | 12521.2 | D | 0.351 | 7.58E−01 | 1.8 |
| LYM106 | 12142.1 | G | 7.448 | 5.21E−01 | 13.4 | LYM138 | 12562.1 | D | 0.363 | 7.64E−01 | 5.3 |
| LYM21 | 11671.2 | G | 9.058 | 5.24E−01 | 37.9 | LYM132 | 12275.1 | D | 0.351 | 7.77E−01 | 2 |
| LYM3 | 12043.2 | G | 8.688 | 5.30E−01 | 32.2 | LYM132 | 12276.1 | D | 0.352 | 7.92E−01 | 2.1 |
| LYM141 | 12402.4 | G | 7.384 | 5.30E−01 | 12.4 | LYM254 | 12474.4 | D | 0.375 | 7.96E−01 | 9 |
| LYM113 | 12441.4 | G | 7.049 | 5.31E−01 | 7.3 | LYM132 | 12271.4 | D | 0.356 | 8.08E−01 | 3.4 |
| LYM102 | 12222.1 | G | 7.917 | 5.33E−01 | 20.5 | LYM130 | 12332.2 | D | 0.357 | 8.15E−01 | 3.6 |
| LYM268 | 12483.2 | G | 7.794 | 5.34E−01 | 18.6 | LYM67 | 11782.4 | D | 0.356 | 8.23E−01 | 3.2 |
| LYM22 | 11762.1 | G | 7.801 | 5.39E−01 | 18.7 | LYM53 | 11842.4 | D | 0.362 | 8.38E−01 | 5.2 |
| LYM119 | 12462.1 | G | 7.692 | 5.48E−01 | 17.1 | LYM51 | 11891.1 | D | 0.348 | 8.52E−01 | 1.1 |
| LYM15 | 11612.3 | G | 7.175 | 5.52E−01 | 9.2 | LYM148 | 12173.1 | D | 0.348 | 9.01E−01 | 1 |
| LYM100 | 12131.3 | G | 7.145 | 5.60E−01 | 8.8 | LYM152 | 12373.1 | D | 0.353 | 9.14E−01 | 2.6 |
| LYM143 | 12523.4 | G | 7.046 | 5.67E−01 | 7.2 | LYM162 | 12231.3 | D | 0.349 | 9.41E−01 | 1.3 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM148 | 12174.1 | G | 7.403 | 5.77E−01 | 12.7 | LYM268 | 12482.1 | D | 0.35 | 9.52E−01 | 1.7 |
| LYM19 | 11751.4 | G | 7.084 | 5.88E−01 | 7.8 | LYM66 | 11954.4 | D | 0.345 | 9.97E−01 | 0.1 |
| LYM143 | 12521.2 | G | 6.962 | 6.60E−01 | 6 | CONTROL | — | D | 0.345 | — | 0 |
| LYM111 | 12251.3 | G | 6.832 | 6.96E−01 | 4 | LYM111 | 12252.2 | E | 9.688 | 7.00E−06 | 21.3 |
| LYM15 | 11612.2 | G | 6.956 | 6.97E−01 | 5.9 | LYM53 | 11841.1 | E | 9.063 | 1.80E−04 | 13.5 |
| LYM16 | 11623.2 | G | 7.05 | 7.01E−01 | 7.3 | LYM57 | 12013.5 | E | 9 | 2.83E−04 | 12.7 |
| LYM105 | 12297.2 | G | 6.789 | 7.14E−01 | 3.3 | LYM105 | 12297.1 | E | 8.875 | 6.26E−04 | 11.2 |
| LYM119 | 12463.2 | G | 6.813 | 7.50E−01 | 3.7 | LYM138 | 12561.1 | E | 9.5 | 7.87E−04 | 19 |
| LYM137 | 12151.2 | G | 6.992 | 7.65E−01 | 6.4 | LYM100 | 12131.2 | E | 8.813 | 1.02E−03 | 10.4 |
| LYM268 | 12483.4 | G | 6.844 | 7.81E−01 | 4.2 | LYM148 | 12174.1 | E | 9.25 | 1.72E−03 | 15.9 |
| LYM268 | 12482.1 | G | 6.755 | 8.29E−01 | 2.8 | LYM69 | 11853.5 | E | 9.25 | 1.72E−03 | 15.9 |
| LYM9 | 11633.2 | G | 6.803 | 8.47E−01 | 3.5 | LYM143 | 12524.2 | E | 8.688 | 2.72E−03 | 8.8 |
| LYM141 | 12404.2 | G | 6.786 | 8.53E−01 | 3.3 | LYM30 | 11913.5 | E | 8.688 | 2.72E−03 | 8.8 |
| LYM290 | 12502.4 | G | 6.641 | 8.59E−01 | 1.1 | LYM30 | 11913.4 | E | 8.598 | 4.80E−03 | 7.7 |
| LYM21 | 11672.4 | G | 6.67 | 8.97E−01 | 1.5 | LYM43 | 11791.4 | E | 8.563 | 7.93E−03 | 7.2 |
| LYM129 | 12572.2 | G | 6.616 | 9.20E−01 | 0.7 | LYM67 | 11783.5 | E | 8.741 | 1.00E−02 | 9.5 |
| LYM134 | 12312.4 | G | 6.759 | 9.21E−01 | 2.9 | LYM140 | 12264.1 | E | 8.5 | 1.16E−02 | 6.5 |
| LYM22 | 11764.1 | G | 6.648 | 9.44E−01 | 1.2 | LYM143 | 12521.2 | E | 8.5 | 1.16E−02 | 6.5 |
| LYM290 | 12502.2 | G | 6.607 | 9.83E−01 | 0.6 | LYM43 | 11791.5 | E | 8.75 | 1.31E−02 | 9.6 |
| LYM148 | 12173.1 | G | 6.582 | 9.90E−01 | 0.2 | LYM68 | 11941.3 | E | 8.75 | 1.31E−02 | 9.6 |
| CONTROL | — | G | 6.57 | — | 0 | LYM68 | 11942.3 | E | 9.313 | 1.72E−02 | 16.6 |
| LYM143 | 12524.7 | H | 16.067 | 1.30E−05 | 63.3 | LYM119 | 12461.1 | E | 9.188 | 2.19E−02 | 15.1 |
| LYM148 | 12171.2 | H | 16.114 | 1.80E−05 | 63.8 | LYM143 | 12524.7 | E | 9.188 | 2.19E−02 | 15.1 |
| LYM130 | 12333.1 | H | 14.809 | 6.50E−05 | 50.5 | LYM51 | 11894.2 | E | 8.438 | 2.49E−02 | 5.7 |
| LYM10 | 11741.2 | H | 18.71 | 9.40E−05 | 90.1 | LYM95 | 12124.4 | E | 8.438 | 2.49E−02 | 5.7 |
| LYM4 | 11706.5 | H | 14.074 | 2.31E−04 | 43 | LYM51 | 11893.2 | E | 9.063 | 2.84E−02 | 13.5 |
| LYM102 | 12222.2 | H | 14.087 | 2.46E−04 | 43.2 | LYM30 | 11913.3 | E | 8.938 | 3.78E−02 | 11.9 |
| LYM1 | 11602.1 | H | 13.972 | 2.52E−04 | 42 | LYM14 | 12052.4 | E | 8.5 | 5.02E−02 | 6.5 |
| LYM105 | 12293.1 | H | 13.879 | 3.34E−04 | 41 | LYM290 | 12502.2 | E | 8.5 | 5.02E−02 | 6.5 |
| LYM10 | 11744.1 | H | 13.85 | 3.39E−04 | 40.8 | LYM134 | 12314.2 | E | 8.813 | 5.19E−02 | 10.4 |
| LYM162 | 12234.3 | H | 13.567 | 4.59E−04 | 37.9 | LYM105 | 12294.2 | E | 8.313 | 8.12E−02 | 4.1 |
| LYM140 | 12262.3 | H | 12.958 | 1.39E−03 | 31.7 | LYM130 | 12332.2 | E | 8.875 | 1.03E−01 | 11.2 |
| LYM15 | 11614.3 | H | 12.89 | 1.69E−03 | 31 | LYM137 | 12153.1 | E | 8.268 | 1.05E−01 | 3.6 |
| LYM152 | 12372.2 | H | 13.517 | 5.83E−03 | 37.4 | LYM162 | 12234.3 | E | 8.375 | 1.08E−01 | 4.9 |
| LYM119 | 12461.4 | H | 12.416 | 7.53E−03 | 26.2 | LYM290 | 12501.3 | E | 8.375 | 1.08E−01 | 4.9 |
| LYM1 | 11602.6 | H | 19.477 | 7.70E−03 | 97.9 | LYM62 | 12022.1 | E | 8.375 | 1.08E−01 | 4.9 |
| LYM132 | 12273.2 | H | 12.917 | 1.21E−02 | 31.3 | LYM119 | 12462.2 | E | 8.563 | 1.10E−01 | 7.2 |
| LYM130 | 12334.1 | H | 13.043 | 1.44E−02 | 32.5 | LYM172 | 12302.2 | E | 8.563 | 1.10E−01 | 7.2 |
| LYM100 | 12133.1 | H | 11.996 | 1.53E−02 | 21.9 | LYM148 | 12172.1 | E | 8.25 | 1.24E−01 | 3.3 |
| LYM162 | 12231.3 | H | 12.208 | 2.21E−02 | 24.1 | LYM95 | 12121.2 | E | 8.25 | 1.24E−01 | 3.3 |
| LYM289 | 12493.2 | H | 14.544 | 2.84E−02 | 47.8 | LYM130 | 12331.3 | E | 8.75 | 1.31E−01 | 9.6 |
| LYM119 | 12463.2 | H | 13.326 | 3.16E−02 | 35.4 | LYM130 | 12334.1 | E | 8.75 | 1.31E−01 | 9.6 |
| LYM17 | 11684.4 | H | 12.364 | 3.64E−02 | 25.7 | LYM137 | 12151.1 | E | 9.25 | 1.43E−01 | 15.9 |
| LYM141 | 12404.2 | H | 11.475 | 3.87E−02 | 16.6 | LYM68 | 11941.4 | E | 8.411 | 1.43E−01 | 5.3 |
| LYM1 | 11603.2 | H | 12.674 | 4.14E−02 | 28.8 | LYM170 | 12453.2 | E | 8.955 | 1.60E−01 | 12.2 |
| LYM138 | 12561.1 | H | 16.127 | 4.40E−02 | 63.9 | LYM111 | 12254.3 | E | 8.625 | 1.71E−01 | 8 |
| LYM289 | 12493.6 | H | 11.22 | 6.44E−02 | 14 | LYM100 | 12134.1 | E | 8.438 | 1.72E−01 | 5.7 |
| LYM268 | 12483.2 | H | 12.016 | 8.02E−02 | 22.1 | LYM14 | 12051.4 | E | 8.438 | 1.72E−01 | 5.7 |
| LYM102 | 12221.1 | H | 11.137 | 8.39E−02 | 13.2 | LYM68 | 11942.2 | E | 8.438 | 1.72E−01 | 5.7 |
| LYM19 | 11751.5 | H | 13.31 | 8.63E−02 | 35.3 | LYM268 | 12482.3 | E | 8.813 | 1.79E−01 | 10.4 |
| LYM13 | 11771.6 | H | 11.597 | 9.59E−02 | 17.9 | LYM100 | 12131.3 | E | 8.5 | 2.31E−01 | 6.5 |
| LYM9 | 11632.2 | H | 11.393 | 1.03E−01 | 15.8 | LYM100 | 12133.3 | E | 8.5 | 2.31E−01 | 6.5 |
| LYM9 | 11632.1 | H | 16.555 | 1.11E−01 | 68.2 | LYM138 | 12566.1 | E | 8.5 | 2.31E−01 | 6.5 |
| LYM1 | 11604.4 | H | 14.531 | 1.12E−01 | 47.7 | LYM24 | 12061.2 | E | 8.5 | 2.31E−01 | 6.5 |
| LYM148 | 12174.1 | H | 14.488 | 1.13E−01 | 47.2 | LYM26 | 11824.6 | E | 8.5 | 2.31E−01 | 6.5 |
| LYM141 | 12402.4 | H | 14.402 | 1.20E−01 | 46.4 | LYM254 | 12472.3 | E | 8.25 | 2.39E−01 | 3.3 |
| LYM10 | 11742.2 | H | 13.928 | 1.24E−01 | 41.5 | LYM105 | 12293.1 | E | 8.188 | 2.52E−01 | 2.5 |
| LYM138 | 12562.1 | H | 10.915 | 1.30E−01 | 10.9 | LYM51 | 11891.1 | E | 8.188 | 2.52E−01 | 2.5 |
| LYM19 | 11753.1 | H | 12.687 | 1.39E−01 | 28.9 | LYM67 | 11781.5 | E | 8.188 | 2.52E−01 | 2.5 |
| LYM143 | 12521.1 | H | 11.254 | 1.45E−01 | 14.4 | LYM290 | 12502.1 | E | 8.75 | 2.56E−01 | 9.6 |
| LYM132 | 12271.4 | H | 12.14 | 1.46E−01 | 23.4 | LYM148 | 12173.1 | E | 9 | 2.70E−01 | 12.7 |
| LYM119 | 12462.2 | H | 17.013 | 1.48E−01 | 72.9 | LYM111 | 12251.1 | E | 8.563 | 2.76E−01 | 7.2 |
| LYM174 | 12411.2 | H | 14.025 | 1.60E−01 | 42.5 | LYM119 | 12462.1 | E | 8.563 | 2.76E−01 | 7.2 |
| LYM113 | 12442.1 | H | 10.841 | 1.67E−01 | 10.2 | LYM152 | 12372.1 | E | 8.563 | 2.76E−01 | 7.2 |
| LYM15 | 11612.2 | H | 11.862 | 1.76E−01 | 20.5 | LYM51 | 11893.4 | E | 8.563 | 2.76E−01 | 7.2 |
| LYM4 | 11705.2 | H | 11.33 | 1.76E−01 | 15.1 | LYM152 | 12372.2 | E | 8.313 | 2.80E−01 | 4.1 |
| LYM19 | 11754.1 | H | 11.711 | 1.84E−01 | 19 | LYM172 | 12301.2 | E | 8.313 | 2.80E−01 | 4.1 |
| LYM129 | 12573.5 | H | 10.742 | 2.00E−01 | 9.2 | LYM268 | 12483.2 | E | 8.313 | 2.80E−01 | 4.1 |
| LYM9 | 11633.7 | H | 12.318 | 2.07E−01 | 25.2 | LYM31 | 11923.1 | E | 8.313 | 2.80E−01 | 4.1 |
| LYM2 | 11692.3 | H | 10.866 | 2.22E−01 | 10.4 | LYM138 | 12561.3 | E | 8.813 | 2.84E−01 | 10.4 |
| LYM143 | 12524.2 | H | 11.856 | 2.30E−01 | 20.5 | LYM31 | 11923.4 | E | 8.813 | 2.84E−01 | 10.4 |
| LYM130 | 12332.2 | H | 13.397 | 2.34E−01 | 36.2 | LYM290 | 12504.1 | E | 8.83 | 2.91E−01 | 10.6 |
| LYM119 | 12462.1 | H | 14.498 | 2.51E−01 | 47.3 | LYM62 | 12021.1 | E | 8.625 | 3.08E−01 | 8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM21 | 11673.1 | H | 11.772 | 2.65E−01 | 19.6 | LYM132 | 12271.4 | E | 8.375 | 3.23E−01 | 4.9 |
| LYM174 | 12414.3 | H | 14.966 | 2.87E−01 | 52.1 | LYM137 | 12154.5 | E | 8.688 | 3.33E−01 | 8.8 |
| LYM138 | 12561.3 | H | 14.529 | 2.90E−01 | 47.7 | LYM68 | 11943.2 | E | 8.688 | 3.33E−01 | 8.8 |
| LYM141 | 12404.3 | H | 12.256 | 2.98E−01 | 24.6 | LYM152 | 12376.1 | E | 8.438 | 3.55E−01 | 5.7 |
| LYM15 | 11612.3 | H | 13.103 | 2.99E−01 | 33.2 | LYM290 | 12502.4 | E | 8.438 | 3.55E−01 | 5.7 |
| LYM134 | 12311.2 | H | 12.68 | 3.01E−01 | 28.9 | LYM31 | 11922.3 | E | 8.438 | 3.55E−01 | 5.7 |
| LYM15 | 11611.3 | H | 12.542 | 3.17E−01 | 27.5 | LYM53 | 11844.2 | E | 8.438 | 3.55E−01 | 5.7 |
| LYM19 | 11751.4 | H | 13.251 | 3.21E−01 | 34.7 | LYM111 | 12254.4 | E | 9.188 | 3.72E−01 | 15.1 |
| LYM162 | 12231.1 | H | 12.669 | 3.42E−01 | 28.8 | LYM153 | 12321.2 | E | 8.491 | 3.76E−01 | 6.3 |
| LYM289 | 12491.4 | H | 11.387 | 3.46E−01 | 15.7 | LYM152 | 12371.2 | E | 8.563 | 3.96E−01 | 7.2 |
| LYM17 | 11684.5 | H | 10.515 | 3.52E−01 | 6.9 | LYM105 | 12295.2 | E | 8.625 | 4.09E−01 | 8 |
| LYM152 | 12371.2 | H | 12.307 | 3.54E−01 | 25.1 | LYM30 | 11912.6 | E | 8.313 | 4.71E−01 | 4.1 |
| LYM21 | 11671.2 | H | 12.04 | 3.73E−01 | 22.4 | LYM51 | 11892.1 | E | 8.313 | 4.71E−01 | 4.1 |
| LYM290 | 12501.3 | H | 11.464 | 3.76E−01 | 16.5 | LYM57 | 12012.2 | E | 8.313 | 4.71E−01 | 4.1 |
| LYM16 | 11624.4 | H | 10.469 | 3.83E−01 | 6.4 | LYM138 | 12562.1 | E | 8.188 | 4.71E−01 | 2.5 |
| LYM141 | 12404.4 | H | 12.483 | 3.95E−01 | 26.9 | LYM140 | 12261.4 | E | 8.188 | 4.71E−01 | 2.5 |
| LYM289 | 12491.1 | H | 13.358 | 3.97E−01 | 35.8 | LYM162 | 12231.1 | E | 8.188 | 4.71E−01 | 2.5 |
| LYM17 | 11683.1 | H | 10.448 | 4.15E−01 | 6.2 | LYM140 | 12262.3 | E | 8.375 | 4.75E−01 | 4.9 |
| LYM148 | 12173.1 | H | 12.842 | 4.17E−01 | 30.5 | LYM148 | 12171.2 | E | 8.5 | 4.82E−01 | 6.5 |
| LYM162 | 12234.4 | H | 14.145 | 4.21E−01 | 43.7 | LYM30 | 11912.7 | E | 8.563 | 4.85E−01 | 7.2 |
| LYM13 | 11772.1 | H | 10.815 | 4.47E−01 | 9.9 | LYM268 | 12481.1 | E | 8.625 | 4.87E−01 | 8 |
| LYM174 | 12411.3 | H | 11.925 | 4.47E−01 | 21.2 | LYM100 | 12133.1 | E | 8.125 | 5.09E−01 | 1.8 |
| LYM268 | 12483.4 | H | 11.476 | 4.61E−01 | 16.6 | LYM137 | 12152.1 | E | 8.125 | 5.09E−01 | 1.8 |
| LYM174 | 12412.1 | H | 11.503 | 4.65E−01 | 16.9 | LYM14 | 12052.5 | E | 8.125 | 5.09E−01 | 1.8 |
| LYM102 | 12222.3 | H | 12.838 | 4.66E−01 | 30.5 | LYM26 | 11824.5 | E | 8.125 | 5.09E−01 | 1.8 |
| LYM111 | 12251.1 | H | 11.987 | 4.83E−01 | 21.8 | LYM132 | 12275.1 | E | 8.563 | 5.52E−01 | 7.2 |
| LYM21 | 11672.4 | H | 11.725 | 4.84E−01 | 19.2 | LYM53 | 11842.4 | E | 8.5 | 5.58E−01 | 6.5 |
| LYM268 | 12482.3 | H | 10.787 | 4.91E−01 | 9.6 | LYM57 | 12012.6 | E | 8.25 | 6.05E−01 | 3.3 |
| LYM174 | 12414.2 | H | 10.274 | 5.09E−01 | 4.4 | LYM69 | 11853.4 | E | 8.5 | 6.15E−01 | 6.5 |
| LYM10 | 11744.5 | H | 11.527 | 5.13E−01 | 17.1 | LYM132 | 12276.1 | E | 8.241 | 6.23E−01 | 3.2 |
| LYM290 | 12502.4 | H | 11.749 | 5.22E−01 | 19.4 | LYM105 | 12294.3 | E | 8.188 | 6.34E−01 | 2.5 |
| LYM17 | 11682.1 | H | 12.286 | 5.68E−01 | 24.9 | LYM69 | 11852.4 | E | 8.188 | 6.34E−01 | 2.5 |
| LYM105 | 12294.2 | H | 12.291 | 6.34E−01 | 24.9 | LYM95 | 12124.5 | E | 8.063 | 6.47E−01 | 1 |
| LYM137 | 12153.1 | H | 10.938 | 6.48E−01 | 11.2 | LYM95 | 12124.6 | E | 8.125 | 6.82E−01 | 1.8 |
| LYM17 | 11681.4 | H | 10.405 | 6.58E−01 | 5.7 | LYM43 | 11793.2 | E | 8.438 | 7.13E−01 | 5.7 |
| LYM10 | 11742.1 | H | 11.348 | 7.13E−01 | 15.3 | LYM130 | 12332.1 | E | 8.375 | 7.33E−01 | 4.9 |
| LYM111 | 12252.2 | H | 11.494 | 7.14E−01 | 16.8 | LYM140 | 12261.1 | E | 8.25 | 7.45E−01 | 3.3 |
| LYM100 | 12131.3 | H | 10.807 | 7.19E−01 | 9.8 | LYM67 | 11782.6 | E | 8.063 | 7.71E−01 | 1 |
| LYM140 | 12261.2 | H | 10.294 | 7.56E−01 | 4.6 | LYM14 | 12051.1 | E | 8.125 | 7.75E−01 | 1.8 |
| LYM9 | 11633.2 | H | 10.562 | 7.61E−01 | 7.3 | LYM254 | 12474.4 | E | 8.188 | 7.80E−01 | 2.5 |
| LYM162 | 12233.2 | H | 10.524 | 7.66E−01 | 6.9 | LYM268 | 12482.1 | E | 8.259 | 8.09E−01 | 3.4 |
| LYM132 | 12275.1 | H | 10.029 | 7.80E−01 | 1.9 | LYM69 | 11854.2 | E | 8.107 | 8.10E−01 | 1.5 |
| LYM148 | 12172.1 | H | 10.795 | 8.12E−01 | 9.7 | LYM130 | 12333.1 | E | 8.063 | 8.49E−01 | 1 |
| LYM268 | 12482.1 | H | 10.48 | 8.16E−01 | 6.5 | LYM138 | 12564.1 | E | 8.063 | 8.49E−01 | 1 |
| LYM290 | 12502.1 | H | 10.411 | 8.38E−01 | 5.8 | LYM170 | 12452.3 | E | 8.063 | 8.49E−01 | 1 |
| LYM22 | 11762.1 | H | 10.161 | 8.39E−01 | 3.3 | LYM134 | 12311.2 | E | 8.125 | 8.60E−01 | 1.8 |
| LYM1 | 11601.1 | H | 10.24 | 8.44E−01 | 4.1 | LYM62 | 12022.2 | E | 8.125 | 8.60E−01 | 1.8 |
| LYM2 | 11693.3 | H | 10.026 | 8.49E−01 | 1.9 | LYM66 | 11954.4 | E | 8.125 | 8.82E−01 | 1.8 |
| LYM143 | 12521.2 | H | 9.995 | 9.08E−01 | 1.6 | LYM3 | 12043.1 | E | 8.063 | 9.13E−01 | 1 |
| LYM13 | 11771.9 | H | 9.918 | 9.11E−01 | 0.8 | LYM152 | 12373.1 | E | 8 | 9.40E−01 | 0.2 |
| LYM290 | 12504.1 | H | 10.034 | 9.18E−01 | 2 | LYM153 | 12322.1 | E | 8 | 9.63E−01 | 0.2 |
| LYM143 | 12523.4 | H | 10.041 | 9.29E−01 | 2 | LYM31 | 11924.4 | E | 8 | 9.80E−01 | 0.2 |
| LYM102 | 12222.6 | H | 10.068 | 9.54E−01 | 2.3 | CONTROL | — | E | 7.984 | — | 0 |
| LYM111 | 12254.4 | H | 9.865 | 9.76E−01 | 0.3 | LYM137 | 12151.1 | F | 0.636 | 3.25E−04 | 50 |
| CONTROL | — | H | 9.84 | — | 0 | LYM57 | 12013.5 | F | 0.605 | 7.25E−04 | 42.7 |
| LYM1 | 11602.6 | J | 0.05 | 2.90E−05 | 82.4 | LYM134 | 12314.2 | F | 0.605 | 7.28E−04 | 42.7 |
| LYM10 | 11741.2 | J | 0.047 | 2.61E−04 | 69.6 | LYM138 | 12561.3 | F | 0.603 | 8.37E−04 | 42.2 |
| LYM148 | 12171.2 | J | 0.044 | 1.16E−03 | 57.9 | LYM51 | 11893.2 | F | 0.607 | 1.97E−03 | 43 |
| LYM143 | 12524.7 | J | 0.043 | 1.72E−03 | 56 | LYM268 | 12482.3 | F | 0.576 | 2.18E−03 | 35.7 |
| LYM119 | 12462.2 | J | 0.044 | 2.18E−03 | 60.3 | LYM68 | 11942.3 | F | 0.57 | 2.74E−03 | 34.3 |
| LYM9 | 11632.1 | J | 0.042 | 3.46E−03 | 51.9 | LYM148 | 12174.1 | F | 0.795 | 3.37E−03 | 87.5 |
| LYM138 | 12561.1 | J | 0.039 | 1.28E−02 | 42.5 | LYM290 | 12502.4 | F | 0.563 | 3.59E−03 | 32.8 |
| LYM1 | 11604.4 | J | 0.039 | 1.45E−02 | 41.6 | LYM69 | 11853.5 | F | 0.63 | 4.12E−03 | 48.5 |
| LYM1 | 11602.1 | J | 0.039 | 1.68E−02 | 41.3 | LYM68 | 11941.5 | F | 0.676 | 4.18E−03 | 59.3 |
| LYM138 | 12561.3 | J | 0.038 | 2.14E−02 | 39.2 | LYM137 | 12153.1 | F | 0.544 | 7.80E−03 | 28.2 |
| LYM289 | 12493.2 | J | 0.038 | 3.13E−02 | 38 | LYM137 | 12154.5 | F | 0.584 | 1.03E−02 | 37.8 |
| LYM10 | 11742.2 | J | 0.038 | 3.37E−02 | 35.8 | LYM143 | 12521.2 | F | 0.541 | 1.35E−02 | 27.5 |
| LYM174 | 12414.3 | J | 0.038 | 3.60E−02 | 37.6 | LYM43 | 11791.5 | F | 0.552 | 1.40E−02 | 30.2 |
| LYM162 | 12234.4 | J | 0.039 | 3.75E−02 | 39.7 | LYM30 | 11913.4 | F | 0.578 | 1.86E−02 | 36.3 |
| LYM130 | 12333.1 | J | 0.037 | 4.04E−02 | 34.6 | LYM30 | 11913.5 | F | 0.537 | 1.99E−02 | 26.7 |
| LYM102 | 12222.2 | J | 0.037 | 4.21E−02 | 33.3 | LYM290 | 12501.3 | F | 0.516 | 2.54E−02 | 21.7 |
| LYM174 | 12411.2 | J | 0.037 | 4.72E−02 | 33.9 | LYM53 | 11841.1 | F | 0.632 | 2.58E−02 | 49.1 |
| LYM162 | 12234.3 | J | 0.037 | 4.72E−02 | 34 | LYM170 | 12453.2 | F | 0.511 | 3.14E−02 | 20.5 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM15 | 11614.3 | J | 0.037 | 4.86E−02 | 32.3 | LYM140 | 12264.1 | F | 0.508 | 3.58E−02 | 19.9 |
| LYM148 | 12174.1 | J | 0.036 | 5.71E−02 | 30.8 | LYM30 | 11913.3 | F | 0.513 | 4.45E−02 | 20.9 |
| LYM105 | 12293.1 | J | 0.036 | 5.84E−02 | 31.5 | LYM105 | 12297.1 | F | 0.503 | 4.63E−02 | 18.6 |
| LYM140 | 12262.3 | J | 0.036 | 6.17E−02 | 30 | LYM62 | 12022.1 | F | 0.501 | 5.09E−02 | 18.2 |
| LYM119 | 12462.1 | J | 0.036 | 6.65E−02 | 30.3 | LYM31 | 11923.4 | F | 0.574 | 5.51E−02 | 35.4 |
| LYM10 | 11744.1 | J | 0.036 | 7.19E−02 | 29.9 | LYM68 | 11943.2 | F | 0.604 | 5.83E−02 | 42.4 |
| LYM19 | 11751.5 | J | 0.036 | 7.62E−02 | 29.3 | LYM152 | 12372.2 | F | 0.517 | 5.83E−02 | 21.9 |
| LYM141 | 12402.4 | J | 0.036 | 7.71E−02 | 30.2 | LYM105 | 12295.2 | F | 0.552 | 6.04E−02 | 30.1 |
| LYM152 | 12372.2 | J | 0.035 | 9.41E−02 | 27.8 | LYM137 | 12152.1 | F | 0.504 | 6.15E−02 | 18.8 |
| LYM134 | 12311.2 | J | 0.036 | 9.65E−02 | 28.5 | LYM138 | 12561.1 | F | 0.644 | 7.28E−02 | 51.8 |
| LYM19 | 11751.4 | J | 0.036 | 9.82E−02 | 28.8 | LYM62 | 12021.1 | F | 0.504 | 8.04E−02 | 18.8 |
| LYM15 | 11611.3 | J | 0.036 | 1.02E−01 | 30.1 | LYM30 | 11912.6 | F | 0.521 | 9.04E−02 | 22.9 |
| LYM162 | 12231.3 | J | 0.035 | 1.13E−01 | 25.7 | LYM111 | 12252.2 | F | 0.817 | 9.40E−02 | 92.5 |
| LYM15 | 11612.3 | J | 0.035 | 1.21E−01 | 26.5 | LYM119 | 12462.2 | F | 0.513 | 9.81E−02 | 21 |
| LYM148 | 12173.1 | J | 0.035 | 1.32E−01 | 26.4 | LYM290 | 12502.2 | F | 0.524 | 1.07E−01 | 23.6 |
| LYM1 | 11603.2 | J | 0.034 | 1.32E−01 | 24.2 | LYM100 | 12131.2 | F | 0.575 | 1.17E−01 | 35.6 |
| LYM17 | 11684.4 | J | 0.034 | 1.34E−01 | 24 | LYM14 | 12051.1 | F | 0.488 | 1.25E−01 | 15.1 |
| LYM174 | 12412.1 | J | 0.035 | 1.37E−01 | 26.8 | LYM290 | 12502.1 | F | 0.48 | 1.39E−01 | 13.1 |
| LYM162 | 12231.1 | J | 0.034 | 1.41E−01 | 24.4 | LYM143 | 12524.2 | F | 0.594 | 1.41E−01 | 40 |
| LYM132 | 12273.2 | J | 0.034 | 1.52E−01 | 22.6 | LYM138 | 12562.1 | F | 0.512 | 1.65E−01 | 20.7 |
| LYM132 | 12271.4 | J | 0.034 | 1.55E−01 | 23.2 | LYM138 | 12564.1 | F | 0.472 | 1.84E−01 | 11.3 |
| LYM4 | 11705.2 | J | 0.034 | 1.60E−01 | 23.1 | LYM172 | 12301.2 | F | 0.511 | 1.88E−01 | 20.4 |
| LYM19 | 11753.1 | J | 0.034 | 1.68E−01 | 21.9 | LYM152 | 12376.1 | F | 0.528 | 1.96E−01 | 24.5 |
| LYM119 | 12461.4 | J | 0.034 | 1.68E−01 | 22.2 | LYM14 | 12052.4 | F | 0.532 | 1.98E−01 | 25.5 |
| LYM289 | 12491.1 | J | 0.034 | 1.81E−01 | 21.7 | LYM119 | 12462.1 | F | 0.567 | 2.22E−01 | 33.7 |
| LYM119 | 12463.2 | J | 0.034 | 1.84E−01 | 21.5 | LYM100 | 12134.1 | F | 0.508 | 2.22E−01 | 19.7 |
| LYM141 | 12404.3 | J | 0.033 | 2.00E−01 | 21 | LYM105 | 12294.3 | F | 0.516 | 2.28E−01 | 21.6 |
| LYM130 | 12332.2 | J | 0.034 | 2.03E−01 | 21.2 | LYM132 | 12271.4 | F | 0.5 | 2.30E−01 | 17.9 |
| LYM141 | 12404.4 | J | 0.033 | 2.07E−01 | 20.4 | LYM51 | 11891.1 | F | 0.471 | 2.32E−01 | 11 |
| LYM4 | 11706.5 | J | 0.033 | 2.13E−01 | 19.8 | LYM67 | 11783.5 | F | 0.541 | 2.36E−01 | 27.6 |
| LYM9 | 11633.7 | J | 0.033 | 2.16E−01 | 21 | LYM26 | 11824.6 | F | 0.516 | 2.42E−01 | 21.6 |
| LYM152 | 12371.2 | J | 0.033 | 2.34E−01 | 19.7 | LYM268 | 12481.1 | F | 0.522 | 2.44E−01 | 23 |
| LYM17 | 11682.1 | J | 0.033 | 2.45E−01 | 20.4 | LYM14 | 12051.4 | F | 0.467 | 2.48E−01 | 10.2 |
| LYM21 | 11673.1 | J | 0.033 | 2.57E−01 | 18.1 | LYM148 | 12171.2 | F | 0.468 | 2.60E−01 | 10.4 |
| LYM21 | 11672.4 | J | 0.033 | 2.70E−01 | 18.7 | LYM130 | 12332.2 | F | 0.466 | 2.86E−01 | 9.9 |
| LYM15 | 11612.2 | J | 0.032 | 2.77E−01 | 17.4 | LYM100 | 12133.3 | F | 0.474 | 2.88E−01 | 11.8 |
| LYM9 | 11632.2 | J | 0.032 | 2.83E−01 | 17.2 | LYM53 | 11844.2 | F | 0.522 | 3.01E−01 | 23.1 |
| LYM143 | 12521.1 | J | 0.032 | 2.83E−01 | 17.1 | LYM51 | 11893.4 | F | 0.615 | 3.06E−01 | 45.1 |
| LYM143 | 12524.2 | J | 0.032 | 2.84E−01 | 17.3 | LYM152 | 12372.1 | F | 0.625 | 3.14E−01 | 47.3 |
| LYM102 | 12222.3 | J | 0.033 | 2.90E−01 | 18.6 | LYM111 | 12251.1 | F | 0.468 | 3.26E−01 | 10.4 |
| LYM10 | 11744.5 | J | 0.032 | 3.16E−01 | 16.9 | LYM162 | 12231.3 | F | 0.47 | 3.29E−01 | 10.8 |
| LYM13 | 11771.6 | J | 0.032 | 3.27E−01 | 16.2 | LYM119 | 12461.1 | F | 0.649 | 3.29E−01 | 52.9 |
| LYM111 | 12251.2 | J | 0.032 | 3.47E−01 | 16.1 | LYM143 | 12524.7 | F | 0.583 | 3.35E−01 | 37.3 |
| LYM105 | 12294.2 | J | 0.032 | 3.57E−01 | 17.1 | LYM130 | 12331.3 | F | 0.48 | 3.48E−01 | 13.2 |
| LYM174 | 12411.3 | J | 0.032 | 3.66E−01 | 14.4 | LYM130 | 12334.1 | F | 0.476 | 3.58E−01 | 12.3 |
| LYM19 | 11754.1 | J | 0.032 | 3.67E−01 | 14.1 | LYM132 | 12275.1 | F | 0.456 | 3.63E−01 | 7.5 |
| LYM268 | 12483.2 | J | 0.031 | 3.73E−01 | 13.8 | LYM111 | 12254.4 | F | 0.553 | 3.74E−01 | 30.4 |
| LYM268 | 12483.4 | J | 0.032 | 3.80E−01 | 15 | LYM111 | 12254.3 | F | 0.603 | 3.81E−01 | 42.1 |
| LYM290 | 12502.4 | J | 0.032 | 3.97E−01 | 14.2 | LYM148 | 12173.1 | F | 0.513 | 4.04E−01 | 20.9 |
| LYM289 | 12493.6 | J | 0.031 | 4.46E−01 | 11.8 | LYM68 | 11942.2 | F | 0.489 | 4.14E−01 | 15.3 |
| LYM141 | 12404.2 | J | 0.031 | 4.48E−01 | 12.2 | LYM57 | 12012.2 | F | 0.462 | 4.14E−01 | 9 |
| LYM13 | 11772.1 | J | 0.031 | 4.52E−01 | 12.1 | LYM57 | 12012.6 | F | 0.462 | 4.28E−01 | 9 |
| LYM21 | 11671.2 | J | 0.031 | 4.72E−01 | 11.1 | LYM100 | 12131.3 | F | 0.482 | 4.31E−01 | 13.6 |
| LYM129 | 12573.5 | J | 0.031 | 4.89E−01 | 10.8 | LYM153 | 12321.2 | F | 0.507 | 4.37E−01 | 19.5 |
| LYM17 | 11681.4 | J | 0.031 | 4.90E−01 | 10.8 | LYM162 | 12234.3 | F | 0.456 | 4.41E−01 | 7.6 |
| LYM143 | 12521.2 | J | 0.03 | 5.23E−01 | 10.1 | LYM24 | 12061.2 | F | 0.515 | 4.44E−01 | 21.5 |
| LYM148 | 12172.1 | J | 0.031 | 5.23E−01 | 11.5 | LYM134 | 12312.4 | F | 0.467 | 4.57E−01 | 10.2 |
| LYM289 | 12491.4 | J | 0.03 | 5.61E−01 | 9.4 | LYM68 | 11941.4 | F | 0.465 | 4.72E−01 | 9.6 |
| LYM100 | 12133.1 | J | 0.03 | 5.63E−01 | 9 | LYM30 | 11912.7 | F | 0.485 | 4.92E−01 | 14.2 |
| LYM102 | 12221.1 | J | 0.03 | 5.66E−01 | 9.1 | LYM132 | 12276.1 | F | 0.513 | 4.98E−01 | 21 |
| LYM100 | 12131.3 | J | 0.03 | 5.87E−01 | 9.1 | LYM95 | 12124.4 | F | 0.454 | 5.03E−01 | 7.1 |
| LYM2 | 11692.3 | J | 0.03 | 5.92E−01 | 8.4 | LYM148 | 12174.2 | F | 0.467 | 5.95E−01 | 10.2 |
| LYM16 | 11624.4 | J | 0.03 | 6.06E−01 | 8 | LYM43 | 11791.4 | F | 0.488 | 5.95E−01 | 15.1 |
| LYM290 | 12501.3 | J | 0.03 | 6.10E−01 | 8.3 | LYM152 | 12371.3 | F | 0.476 | 6.25E−01 | 12.3 |
| LYM10 | 11742.1 | J | 0.03 | 6.16E−01 | 8.9 | LYM66 | 11954.4 | F | 0.501 | 6.29E−01 | 18.2 |
| LYM138 | 12562.1 | J | 0.03 | 6.36E−01 | 7.3 | LYM67 | 11781.5 | F | 0.446 | 6.32E−01 | 5.3 |
| LYM17 | 11684.5 | J | 0.03 | 6.40E−01 | 7.2 | LYM67 | 11782.6 | F | 0.442 | 6.43E−01 | 4.3 |
| LYM111 | 12252.2 | J | 0.03 | 6.46E−01 | 8.2 | LYM140 | 12261.1 | F | 0.465 | 6.49E−01 | 9.6 |
| LYM268 | 12482.1 | J | 0.03 | 6.52E−01 | 7.8 | LYM172 | 12302.2 | F | 0.471 | 6.57E−01 | 11 |
| LYM17 | 11683.1 | J | 0.029 | 6.68E−01 | 6.6 | LYM31 | 11922.3 | F | 0.47 | 6.61E−01 | 10.8 |
| LYM1 | 11601.1 | J | 0.029 | 6.76E−01 | 6.7 | LYM14 | 12052.5 | F | 0.439 | 6.69E−01 | 3.4 |
| LYM137 | 12153.1 | J | 0.029 | 6.95E−01 | 6.6 | LYM51 | 11894.2 | F | 0.44 | 6.79E−01 | 3.7 |
| LYM162 | 12233.2 | J | 0.029 | 6.97E−01 | 6.4 | LYM170 | 12452.3 | F | 0.441 | 6.91E−01 | 3.9 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM268 | 12482.3 | J | 0.029 | 7.03E−01 | 6 | LYM153 | 12322.1 | F | 0.485 | 6.92E−01 | 14.4 |
| LYM130 | 12334.1 | J | 0.029 | 7.32E−01 | 5.2 | LYM62 | 12022.2 | F | 0.464 | 7.01E−01 | 9.4 |
| LYM22 | 11762.1 | J | 0.029 | 8.38E−01 | 3.2 | LYM105 | 12293.1 | F | 0.448 | 7.04E−01 | 5.7 |
| LYM140 | 12261.4 | J | 0.028 | 8.73E−01 | 2.6 | LYM31 | 11923.1 | F | 0.451 | 7.09E−01 | 6.4 |
| LYM143 | 12523.4 | J | 0.028 | 9.21E−01 | 1.6 | LYM69 | 11854.2 | F | 0.447 | 7.13E−01 | 5.5 |
| LYM111 | 12254.4 | J | 0.028 | 9.41E−01 | 1.1 | LYM268 | 12482.1 | F | 0.486 | 7.27E−01 | 14.5 |
| LYM2 | 11693.3 | J | 0.028 | 9.79E−01 | 0.4 | LYM119 | 12461.4 | F | 0.444 | 7.34E−01 | 4.8 |
| LYM102 | 12222.6 | J | 0.028 | 9.79E−01 | 0.5 | LYM268 | 12483.2 | F | 0.461 | 7.41E−01 | 8.6 |
| LYM113 | 12442.1 | J | 0.028 | 9.82E−01 | 0.4 | LYM111 | 12251.3 | F | 0.452 | 7.42E−01 | 6.5 |
| CONTROL | — | J | 0.028 | — | 0 | LYM162 | 12231.1 | F | 0.45 | 7.55E−01 | 6.2 |
| LYM119 | 12462.2 | K | 0.627 | 1.12E−02 | 31.8 | LYM100 | 12133.1 | F | 0.446 | 7.57E−01 | 5.3 |
| LYM148 | 12174.1 | K | 0.617 | 2.05E−02 | 29.8 | LYM26 | 11824.5 | F | 0.442 | 7.76E−01 | 4.1 |
| LYM268 | 12483.2 | K | 0.607 | 2.07E−02 | 27.7 | LYM152 | 12373.1 | F | 0.46 | 7.98E−01 | 8.4 |
| LYM268 | 12482.3 | K | 0.612 | 2.74E−02 | 28.6 | LYM69 | 11853.4 | F | 0.455 | 8.07E−01 | 7.3 |
| LYM102 | 12222.6 | K | 0.616 | 3.04E−02 | 29.6 | LYM254 | 12474.4 | F | 0.466 | 8.11E−01 | 9.9 |
| LYM4 | 11706.5 | K | 0.603 | 3.66E−02 | 26.7 | LYM172 | 12301.3 | F | 0.439 | 8.30E−01 | 3.6 |
| LYM102 | 12222.2 | K | 0.608 | 4.08E−02 | 27.9 | LYM95 | 12124.5 | F | 0.43 | 8.69E−01 | 1.4 |
| LYM143 | 12524.7 | K | 0.614 | 4.15E−02 | 29.2 | LYM130 | 12333.1 | F | 0.438 | 8.73E−01 | 3.2 |
| LYM15 | 11611.3 | K | 0.59 | 4.46E−02 | 24.1 | LYM148 | 12172.1 | F | 0.431 | 8.75E−01 | 1.7 |
| LYM140 | 12261.1 | K | 0.585 | 4.64E−02 | 22.9 | LYM53 | 11842.4 | F | 0.449 | 8.83E−01 | 5.8 |
| LYM119 | 12461.4 | K | 0.589 | 4.73E−02 | 23.8 | LYM43 | 11793.2 | F | 0.446 | 9.06E−01 | 5.1 |
| LYM21 | 11674.5 | K | 0.581 | 5.23E−02 | 22.2 | LYM140 | 12262.3 | F | 0.433 | 9.11E−01 | 2.2 |
| LYM132 | 12271.4 | K | 0.584 | 5.49E−02 | 22.8 | LYM254 | 12472.3 | F | 0.429 | 9.16E−01 | 1.1 |
| LYM130 | 12332.2 | K | 0.586 | 6.37E−02 | 23.3 | LYM137 | 12151.2 | F | 0.436 | 9.21E−01 | 2.7 |
| LYM100 | 12131.2 | K | 0.584 | 7.48E−02 | 22.8 | CONTROL | — | F | 0.424 | — | 0 |
| LYM100 | 12133.1 | K | 0.583 | 8.16E−02 | 22.7 | LYM148 | 12174.1 | G | 10.531 | 6.00E−05 | 46.2 |
| LYM138 | 12561.1 | K | 0.582 | 9.29E−02 | 22.5 | LYM105 | 12297.1 | G | 9.406 | 9.40E−05 | 30.6 |
| LYM141 | 12402.4 | K | 0.578 | 9.33E−02 | 21.5 | LYM137 | 12154.5 | G | 9.272 | 1.82E−04 | 28.7 |
| LYM10 | 11741.2 | K | 0.572 | 9.81E−02 | 20.4 | LYM290 | 12502.1 | G | 9.121 | 2.85E−04 | 26.6 |
| LYM10 | 11742.2 | K | 0.571 | 1.03E−01 | 20 | LYM132 | 12271.4 | G | 8.899 | 5.40E−04 | 23.5 |
| LYM152 | 12372.2 | K | 0.572 | 1.06E−01 | 20.2 | LYM111 | 12252.2 | G | 8.923 | 5.44E−04 | 23.9 |
| LYM105 | 12293.1 | K | 0.564 | 1.39E−01 | 18.6 | LYM290 | 12502.2 | G | 8.832 | 7.44E−04 | 22.6 |
| LYM17 | 11681.4 | K | 0.566 | 1.40E−01 | 19.1 | LYM143 | 12524.2 | G | 8.77 | 9.08E−04 | 21.7 |
| LYM137 | 12153.1 | K | 0.564 | 1.47E−01 | 18.5 | LYM268 | 12482.3 | G | 8.973 | 1.05E−03 | 24.6 |
| LYM21 | 11671.2 | K | 0.569 | 1.48E−01 | 19.6 | LYM67 | 11781.5 | G | 8.534 | 2.64E−03 | 18.5 |
| LYM10 | 11742.1 | K | 0.564 | 1.50E−01 | 18.6 | LYM138 | 12561.1 | G | 10.311 | 3.08E−03 | 43.1 |
| LYM289 | 12491.4 | K | 0.549 | 1.64E−01 | 15.5 | LYM138 | 12561.3 | G | 9.901 | 3.55E−03 | 37.4 |
| LYM153 | 12321.2 | K | 0.553 | 1.68E−01 | 16.3 | LYM57 | 12013.5 | G | 9.583 | 3.82E−03 | 33 |
| LYM289 | 12491.1 | K | 0.573 | 1.78E−01 | 20.5 | LYM143 | 12524.7 | G | 8.422 | 3.87E−03 | 16.9 |
| LYM174 | 12411.2 | K | 0.56 | 1.82E−01 | 17.7 | LYM290 | 12501.3 | G | 8.474 | 4.45E−03 | 17.6 |
| LYM22 | 11764.1 | K | 0.547 | 1.85E−01 | 15 | LYM153 | 12322.1 | G | 8.566 | 4.91E−03 | 18.9 |
| LYM289 | 12493.2 | K | 0.549 | 1.87E−01 | 15.5 | LYM67 | 11783.5 | G | 8.896 | 8.15E−03 | 23.5 |
| LYM106 | 12142.2 | K | 0.547 | 1.97E−01 | 15 | LYM140 | 12261.1 | G | 8.624 | 9.34E−03 | 19.7 |
| LYM174 | 12412.1 | K | 0.557 | 2.01E−01 | 17.2 | LYM43 | 11791.5 | G | 8.227 | 1.13E−02 | 14.2 |
| LYM174 | 12414.2 | K | 0.549 | 2.07E−01 | 15.5 | LYM268 | 12483.2 | G | 8.173 | 1.25E−02 | 13.4 |
| LYM105 | 12297.1 | K | 0.55 | 2.08E−01 | 15.6 | LYM111 | 12251.1 | G | 8.206 | 1.25E−02 | 13.9 |
| LYM152 | 12373.1 | K | 0.542 | 2.24E−01 | 14 | LYM100 | 12134.1 | G | 8.493 | 1.46E−02 | 17.9 |
| LYM22 | 11764.7 | K | 0.545 | 2.25E−01 | 14.5 | LYM30 | 11913.5 | G | 9.106 | 1.46E−02 | 26.4 |
| LYM119 | 12462.1 | K | 0.555 | 2.28E−01 | 16.8 | LYM134 | 12311.2 | G | 8.005 | 2.81E−02 | 11.1 |
| LYM1 | 11602.6 | K | 0.561 | 2.30E−01 | 18 | LYM130 | 12334.1 | G | 8.539 | 3.38E−02 | 18.5 |
| LYM130 | 12334.1 | K | 0.559 | 2.36E−01 | 17.5 | LYM162 | 12231.1 | G | 9.308 | 3.90E−02 | 29.2 |
| LYM138 | 12564.1 | K | 0.546 | 2.43E−01 | 14.8 | LYM30 | 11912.7 | G | 7.962 | 4.08E−02 | 10.5 |
| LYM268 | 12481.1 | K | 0.536 | 2.59E−01 | 12.6 | LYM68 | 11941.3 | G | 10.235 | 4.13E−02 | 42.1 |
| LYM3 | 12041.2 | K | 0.551 | 2.68E−01 | 15.9 | LYM100 | 12133.1 | G | 8.264 | 5.83E−02 | 14.7 |
| LYM102 | 12222.3 | K | 0.546 | 2.81E−01 | 14.8 | LYM153 | 12324.1 | G | 9.059 | 5.91E−02 | 25.7 |
| LYM162 | 12234.3 | K | 0.541 | 2.97E−01 | 13.9 | LYM100 | 12131.3 | G | 7.845 | 6.29E−02 | 8.9 |
| LYM162 | 12234.4 | K | 0.54 | 3.06E−01 | 13.6 | LYM268 | 12483.4 | G | 8.176 | 6.43E−02 | 13.5 |
| LYM148 | 12173.1 | K | 0.547 | 3.18E−01 | 15.1 | LYM31 | 11923.4 | G | 8.75 | 7.07E−02 | 21.5 |
| LYM290 | 12501.3 | K | 0.533 | 3.19E−01 | 12 | LYM57 | 12012.2 | G | 8.174 | 8.06E−02 | 13.5 |
| LYM9 | 11632.6 | K | 0.537 | 3.25E−01 | 13 | LYM174 | 12411.3 | G | 9.046 | 8.44E−02 | 25.6 |
| LYM113 | 12442.1 | K | 0.527 | 3.29E−01 | 10.9 | LYM53 | 11843.2 | G | 7.796 | 8.61E−02 | 8.2 |
| LYM19 | 11754.1 | K | 0.527 | 3.47E−01 | 10.8 | LYM137 | 12151.1 | G | 10.024 | 8.70E−02 | 39.1 |
| LYM111 | 12251.1 | K | 0.532 | 3.60E−01 | 11.9 | LYM111 | 12254.3 | G | 8.786 | 9.05E−02 | 22 |
| LYM19 | 12463.2 | K | 0.533 | 3.81E−01 | 12.1 | LYM95 | 12121.2 | G | 7.752 | 1.05E−01 | 7.6 |
| LYM15 | 11614.3 | K | 0.525 | 3.92E−01 | 10.4 | LYM162 | 12234.4 | G | 8.337 | 1.12E−01 | 15.7 |
| LYM140 | 12264.1 | K | 0.524 | 3.93E−01 | 10.2 | LYM30 | 11913.3 | G | 8.024 | 1.18E−01 | 11.4 |
| LYM19 | 11753.1 | K | 0.523 | 4.08E−01 | 10 | LYM105 | 12295.2 | G | 8.798 | 1.36E−01 | 22.1 |
| LYM141 | 12404.2 | K | 0.525 | 4.11E−01 | 10.3 | LYM3 | 12042.1 | G | 7.697 | 1.37E−01 | 6.8 |
| LYM10 | 11744.1 | K | 0.522 | 4.16E−01 | 9.8 | LYM132 | 12275.1 | G | 7.686 | 1.44E−01 | 6.7 |
| LYM130 | 12331.3 | K | 0.523 | 4.27E−01 | 9.9 | LYM68 | 11942.2 | G | 8.305 | 1.48E−01 | 15.3 |
| LYM289 | 12493.6 | K | 0.519 | 4.34E−01 | 9.2 | LYM137 | 12152.1 | G | 8.278 | 1.51E−01 | 14.9 |
| LYM19 | 11752.2 | K | 0.532 | 4.41E−01 | 11.8 | LYM152 | 12372.1 | G | 9.361 | 1.57E−01 | 29.9 |
| LYM138 | 12562.1 | K | 0.519 | 4.60E−01 | 9.2 | LYM268 | 12482.1 | G | 9.011 | 1.64E−01 | 25.1 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM290 | 12502.4 | K | 0.519 | 4.61E−01 | 9.1 | LYM134 | 12314.2 | G | 9.935 | 1.83E−01 | 37.9 |
| LYM105 | 12294.3 | K | 0.518 | 5.00E−01 | 8.9 | LYM162 | 12231.3 | G | 8.428 | 1.87E−01 | 17 |
| LYM1 | 11603.2 | K | 0.515 | 5.19E−01 | 8.3 | LYM66 | 11952.1 | G | 8.194 | 1.92E−01 | 13.7 |
| LYM174 | 12414.3 | K | 0.513 | 5.33E−01 | 7.8 | LYM66 | 11954.4 | G | 8.631 | 2.06E−01 | 19.8 |
| LYM17 | 11682.1 | K | 0.515 | 5.34E−01 | 8.2 | LYM43 | 11791.4 | G | 8.574 | 2.13E−01 | 19 |
| LYM290 | 12502.2 | K | 0.521 | 5.41E−01 | 9.6 | LYM26 | 11824.6 | G | 8.67 | 2.15E−01 | 20.3 |
| LYM141 | 12404.4 | K | 0.514 | 5.48E−01 | 8.1 | LYM31 | 11921.3 | G | 8.127 | 2.23E−01 | 12.8 |
| LYM3 | 12041.1 | K | 0.508 | 5.57E−01 | 6.9 | LYM148 | 12174.2 | G | 9.026 | 2.26E−01 | 25.3 |
| LYM268 | 12482.1 | K | 0.506 | 5.59E−01 | 6.5 | LYM111 | 12251.3 | G | 8.396 | 2.31E−01 | 16.5 |
| LYM162 | 12233.2 | K | 0.506 | 5.75E−01 | 6.4 | LYM24 | 12062.3 | G | 8.378 | 2.38E−01 | 16.3 |
| LYM152 | 12371.3 | K | 0.507 | 5.75E−01 | 6.6 | LYM137 | 12151.2 | G | 7.637 | 2.41E−01 | 6 |
| LYM162 | 12231.1 | K | 0.513 | 5.85E−01 | 7.8 | LYM111 | 12254.4 | G | 8.571 | 2.44E−01 | 19 |
| LYM152 | 12371.2 | K | 0.505 | 5.88E−01 | 6.2 | LYM68 | 11942.3 | G | 7.989 | 2.45E−01 | 10.9 |
| LYM106 | 12141.4 | K | 0.505 | 5.96E−01 | 6.1 | LYM153 | 12323.2 | G | 7.588 | 2.51E−01 | 5.3 |
| LYM15 | 11612.3 | K | 0.506 | 6.17E−01 | 6.4 | LYM138 | 12564.1 | G | 8.799 | 2.53E−01 | 22.1 |
| LYM105 | 12297.2 | K | 0.507 | 6.20E−01 | 6.5 | LYM67 | 11782.6 | G | 7.563 | 2.57E−01 | 5 |
| LYM105 | 12294.2 | K | 0.505 | 6.39E−01 | 6.1 | LYM68 | 11943.2 | G | 8.649 | 2.60E−01 | 20.1 |
| LYM21 | 11672.4 | K | 0.504 | 6.50E−01 | 5.9 | LYM62 | 12022.1 | G | 8.781 | 2.63E−01 | 21.9 |
| LYM1 | 11604.4 | K | 0.5 | 6.53E−01 | 5.1 | LYM14 | 12051.1 | G | 7.587 | 2.72E−01 | 5.3 |
| LYM15 | 11612.2 | K | 0.502 | 6.56E−01 | 5.6 | LYM138 | 12562.1 | G | 8.862 | 2.79E−01 | 23 |
| LYM141 | 12404.2 | K | 0.501 | 6.61E−01 | 5.3 | LYM152 | 12376.1 | G | 7.952 | 2.80E−01 | 10.4 |
| LYM17 | 11684.4 | K | 0.502 | 6.69E−01 | 5.5 | LYM26 | 11821.2 | G | 7.544 | 2.80E−01 | 4.7 |
| LYM19 | 11751.4 | K | 0.504 | 6.71E−01 | 5.9 | LYM105 | 12294.3 | G | 8.885 | 2.83E−01 | 23.3 |
| LYM10 | 11744.5 | K | 0.498 | 6.80E−01 | 4.8 | LYM26 | 11824.5 | G | 7.682 | 2.83E−01 | 6.6 |
| LYM4 | 11706.3 | K | 0.496 | 6.93E−01 | 4.4 | LYM100 | 12131.2 | G | 7.596 | 2.88E−01 | 5.4 |
| LYM132 | 12275.1 | K | 0.498 | 7.10E−01 | 4.8 | LYM137 | 12153.1 | G | 9.256 | 2.90E−01 | 28.5 |
| LYM113 | 12444.4 | K | 0.494 | 7.42E−01 | 3.8 | LYM51 | 11891.1 | G | 7.81 | 2.91E−01 | 8.4 |
| LYM129 | 12573.5 | K | 0.494 | 7.44E−01 | 3.8 | LYM69 | 11853.5 | G | 8.643 | 2.92E−01 | 20 |
| LYM13 | 11773.2 | K | 0.492 | 7.46E−01 | 3.5 | LYM51 | 11893.4 | G | 9.298 | 2.98E−01 | 29.1 |
| LYM130 | 12333.1 | K | 0.495 | 7.48E−01 | 4 | LYM62 | 12022.2 | G | 8.814 | 3.09E−01 | 22.3 |
| LYM16 | 11624.4 | K | 0.492 | 7.53E−01 | 3.4 | LYM119 | 12462.1 | G | 7.626 | 3.21E−01 | 5.8 |
| LYM143 | 12521.1 | K | 0.494 | 7.62E−01 | 3.8 | LYM172 | 12301.2 | G | 8.25 | 3.22E−01 | 14.5 |
| LYM129 | 12571.3 | K | 0.493 | 7.92E−01 | 3.7 | LYM143 | 12521.2 | G | 9.228 | 3.24E−01 | 28.1 |
| LYM13 | 11772.2 | K | 0.488 | 8.40E−01 | 2.6 | LYM31 | 11924.4 | G | 8.269 | 3.35E−01 | 14.8 |
| LYM9 | 11633.2 | K | 0.486 | 8.54E−01 | 2.2 | LYM14 | 12052.5 | G | 8.091 | 3.45E−01 | 12.3 |
| LYM290 | 12502.1 | K | 0.487 | 8.54E−01 | 2.4 | LYM62 | 12021.1 | G | 8.695 | 3.46E−01 | 20.7 |
| LYM9 | 11634.5 | K | 0.484 | 8.82E−01 | 1.7 | LYM53 | 11841.1 | G | 9.045 | 3.63E−01 | 25.6 |
| LYM106 | 12144.4 | K | 0.484 | 8.84E−01 | 1.8 | LYM67 | 11782.5 | G | 7.534 | 3.65E−01 | 4.6 |
| LYM174 | 12411.3 | K | 0.485 | 8.98E−01 | 1.9 | LYM119 | 12461.1 | G | 8.655 | 3.72E−01 | 20.1 |
| LYM268 | 12483.4 | K | 0.482 | 9.01E−01 | 1.5 | LYM30 | 11912.6 | G | 7.91 | 3.80E−01 | 9.8 |
| LYM129 | 12572.2 | K | 0.481 | 9.19E−01 | 1.2 | LYM30 | 11913.4 | G | 14.939 | 3.98E−01 | 107.4 |
| LYM134 | 12311.2 | K | 0.48 | 9.39E−01 | 0.9 | LYM254 | 12471.2 | G | 8.136 | 4.05E−01 | 12.9 |
| LYM9 | 11633.7 | K | 0.48 | 9.41E−01 | 0.8 | LYM24 | 12061.2 | G | 8.905 | 4.08E−01 | 23.6 |
| LYM13 | 11771.9 | K | 0.479 | 9.49E−01 | 0.7 | LYM53 | 11844.2 | G | 8.516 | 4.19E−01 | 18.2 |
| LYM137 | 12151.1 | K | 0.479 | 9.51E−01 | 0.7 | LYM130 | 12333.1 | G | 8.44 | 4.29E−01 | 17.1 |
| LYM134 | 12312.3 | K | 0.478 | 9.61E−01 | 0.6 | LYM51 | 11893.2 | G | 8.6 | 4.35E−01 | 19.4 |
| LYM162 | 12231.3 | K | 0.478 | 9.64E−01 | 0.6 | LYM51 | 11892.1 | G | 8.007 | 4.43E−01 | 11.1 |
| LYM2 | 11693.3 | K | 0.477 | 9.81E−01 | 0.3 | LYM26 | 11824.3 | G | 7.467 | 4.44E−01 | 3.6 |
| CONTROL | — | K | 0.476 | — | 0 | LYM148 | 12173.1 | G | 7.909 | 4.46E−01 | 9.8 |
| LYM1 | 11602.6 | L | 2.507 | 2.00E−05 | 100.5 | LYM62 | 12023.4 | G | 7.505 | 4.48E−01 | 4.2 |
| LYM10 | 11741.2 | L | 2.405 | 3.80E−05 | 92.3 | LYM170 | 12453.3 | G | 8.378 | 4.85E−01 | 16.3 |
| LYM119 | 12462.2 | L | 2.191 | 8.04E−04 | 75.2 | LYM162 | 12234.3 | G | 8.246 | 4.91E−01 | 14.5 |
| LYM9 | 11632.1 | L | 2.134 | 1.01E−03 | 70.6 | LYM170 | 12452.3 | G | 7.89 | 4.91E−01 | 9.5 |
| LYM143 | 12524.7 | L | 2.094 | 1.12E−03 | 67.4 | LYM31 | 11922.3 | G | 8.374 | 5.24E−01 | 16.2 |
| LYM148 | 12171.2 | L | 2.033 | 1.84E−03 | 62.6 | LYM134 | 12313.2 | G | 8.028 | 5.29E−01 | 11.4 |
| LYM138 | 12561.1 | L | 2.041 | 2.32E−03 | 63.2 | LYM153 | 12321.2 | G | 8.374 | 5.39E−01 | 16.2 |
| LYM174 | 12414.3 | L | 1.921 | 9.20E−03 | 53.6 | LYM254 | 12472.3 | G | 7.445 | 5.40E−01 | 3.3 |
| LYM1 | 11604.4 | L | 1.853 | 1.20E−02 | 48.1 | LYM152 | 12371.2 | G | 8.103 | 5.47E−01 | 12.5 |
| LYM102 | 12222.2 | L | 1.847 | 1.29E−02 | 47.7 | LYM290 | 12502.4 | G | 7.865 | 5.54E−01 | 9.2 |
| LYM130 | 12333.1 | L | 1.868 | 1.31E−02 | 49.3 | LYM130 | 12332.2 | G | 9.594 | 5.61E−01 | 33.2 |
| LYM148 | 12174.1 | L | 1.84 | 1.45E−02 | 47.1 | LYM172 | 12302.2 | G | 7.736 | 5.61E−01 | 7.4 |
| LYM289 | 12493.2 | L | 1.868 | 1.45E−02 | 49.3 | LYM3 | 12041.1 | G | 8.492 | 5.64E−01 | 17.9 |
| LYM141 | 12402.4 | L | 1.841 | 1.66E−02 | 47.2 | LYM62 | 12022.4 | G | 7.949 | 5.65E−01 | 10.3 |
| LYM119 | 12462.1 | L | 1.841 | 1.92E−02 | 47.2 | LYM130 | 12331.3 | G | 7.748 | 5.70E−01 | 7.5 |
| LYM10 | 11742.2 | L | 1.795 | 2.33E−02 | 43.5 | LYM174 | 12411.2 | G | 7.837 | 5.73E−01 | 8.8 |
| LYM138 | 12561.3 | L | 1.823 | 2.34E−02 | 45.8 | LYM138 | 12566.1 | G | 7.716 | 5.76E−01 | 7.1 |
| LYM1 | 11602.1 | L | 1.792 | 2.41E−02 | 43.2 | LYM14 | 12052.4 | G | 7.776 | 5.91E−01 | 7.9 |
| LYM105 | 12293.1 | L | 1.776 | 2.81E−02 | 42 | LYM43 | 11791.2 | G | 8.025 | 6.07E−01 | 11.4 |
| LYM174 | 12411.2 | L | 1.778 | 3.09E−02 | 42.1 | LYM69 | 11853.4 | G | 7.977 | 6.13E−01 | 10.7 |
| LYM10 | 11744.1 | L | 1.752 | 3.26E−02 | 40.1 | LYM68 | 11941.4 | G | 7.693 | 6.29E−01 | 6.8 |
| LYM162 | 12234.4 | L | 1.838 | 3.42E−02 | 47 | LYM268 | 12481.1 | G | 7.844 | 6.40E−01 | 8.9 |
| LYM152 | 12372.2 | L | 1.744 | 4.01E−02 | 39.4 | LYM43 | 11793.2 | G | 8.087 | 6.72E−01 | 12.3 |
| LYM4 | 11706.5 | L | 1.729 | 4.16E−02 | 38.3 | LYM53 | 11842.4 | G | 8.049 | 6.85E−01 | 11.7 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM162 | 12234.3 | L | 1.742 | 4.19E−02 | 39.3 | LYM31 | 11923.1 | G | 7.713 | 7.10E−01 | 7.1 |
| LYM130 | 12332.2 | L | 1.717 | 5.60E−02 | 37.3 | LYM148 | 12172.1 | G | 7.516 | 7.34E−01 | 4.3 |
| LYM19 | 11751.5 | L | 1.692 | 6.21E−02 | 35.3 | LYM132 | 12276.1 | G | 7.887 | 7.39E−01 | 9.5 |
| LYM15 | 11614.3 | L | 1.676 | 6.35E−02 | 34 | LYM105 | 12294.2 | G | 7.427 | 7.63E−01 | 3.1 |
| LYM119 | 12463.2 | L | 1.675 | 7.13E−02 | 33.9 | LYM119 | 12462.2 | G | 7.294 | 7.81E−01 | 1.2 |
| LYM140 | 12262.3 | L | 1.658 | 7.47E−02 | 32.6 | LYM53 | 11841.2 | G | 7.546 | 7.89E−01 | 4.7 |
| LYM15 | 11612.3 | L | 1.675 | 7.83E−02 | 33.9 | LYM100 | 12133.3 | G | 7.317 | 7.97E−01 | 1.6 |
| LYM289 | 12491.1 | L | 1.682 | 8.02E−02 | 34.5 | LYM51 | 11894.2 | G | 7.296 | 8.21E−01 | 1.3 |
| LYM130 | 12334.1 | L | 1.658 | 8.07E−02 | 32.6 | LYM119 | 12461.4 | G | 7.336 | 8.46E−01 | 1.8 |
| LYM19 | 11751.4 | L | 1.684 | 8.28E−02 | 34.6 | LYM95 | 12124.5 | G | 7.471 | 8.50E−01 | 3.7 |
| LYM19 | 11753.1 | L | 1.625 | 1.03E−01 | 29.9 | LYM105 | 12293.1 | G | 7.467 | 8.53E−01 | 3.6 |
| LYM134 | 12311.2 | L | 1.64 | 1.05E−01 | 31.1 | LYM254 | 12474.4 | G | 7.737 | 8.61E−01 | 7.4 |
| LYM162 | 12231.1 | L | 1.637 | 1.06E−01 | 30.9 | LYM254 | 12474.3 | G | 7.321 | 8.99E−01 | 1.6 |
| LYM132 | 12273.2 | L | 1.619 | 1.07E−01 | 29.5 | LYM170 | 12453.2 | G | 7.239 | 9.08E−01 | 0.5 |
| LYM1 | 11603.2 | L | 1.614 | 1.10E−01 | 29 | LYM172 | 12301.3 | G | 7.319 | 9.09E−01 | 1.6 |
| LYM119 | 12461.4 | L | 1.613 | 1.13E−01 | 29 | LYM170 | 12452.4 | G | 7.249 | 9.33E−01 | 0.6 |
| LYM15 | 11611.3 | L | 1.633 | 1.16E−01 | 30.6 | LYM69 | 11852.4 | G | 7.225 | 9.80E−01 | 0.3 |
| LYM17 | 11684.4 | L | 1.609 | 1.17E−01 | 28.6 | LYM14 | 12051.4 | G | 7.244 | 9.80E−01 | 0.6 |
| LYM148 | 12173.1 | L | 1.639 | 1.21E−01 | 31 | LYM143 | 12521.1 | G | 7.211 | 9.94E−01 | 0.1 |
| LYM141 | 12404.4 | L | 1.595 | 1.46E−01 | 27.6 | CONTROL | — | G | 7.204 | — | 0 |
| LYM102 | 12222.3 | L | 1.615 | 1.50E−01 | 29.1 | LYM138 | 12561.1 | H | 25.053 | 4.46E−04 | 61.4 |
| LYM268 | 12483.2 | L | 1.569 | 1.55E−01 | 25.5 | LYM134 | 12314.2 | H | 23.018 | 4.64E−04 | 48.3 |
| LYM162 | 12231.3 | L | 1.572 | 1.57E−01 | 25.7 | LYM268 | 12482.3 | H | 22.616 | 7.44E−04 | 45.7 |
| LYM132 | 12271.4 | L | 1.57 | 1.71E−01 | 25.5 | LYM43 | 11791.5 | H | 23.824 | 1.69E−03 | 53.5 |
| LYM152 | 12371.2 | L | 1.568 | 1.80E−01 | 25.4 | LYM100 | 12131.2 | H | 24.777 | 2.60E−03 | 59.6 |
| LYM141 | 12404.3 | L | 1.56 | 1.82E−01 | 24.7 | LYM140 | 12264.1 | H | 20.454 | 8.48E−03 | 31.8 |
| LYM21 | 11671.2 | L | 1.548 | 1.95E−01 | 23.8 | LYM68 | 11942.3 | H | 21.899 | 9.46E−03 | 41.1 |
| LYM9 | 11633.7 | L | 1.551 | 1.99E−01 | 24 | LYM57 | 12013.5 | H | 21.379 | 1.02E−02 | 37.7 |
| LYM17 | 11682.1 | L | 1.572 | 2.12E−01 | 25.7 | LYM143 | 12524.2 | H | 22.043 | 1.20E−02 | 42 |
| LYM105 | 12294.2 | L | 1.58 | 2.17E−01 | 26.3 | LYM148 | 12174.1 | H | 29.36 | 1.27E−02 | 89.1 |
| LYM100 | 12133.1 | L | 1.52 | 2.30E−01 | 21.5 | LYM31 | 11923.4 | H | 22.007 | 1.51E−02 | 41.8 |
| LYM15 | 11612.2 | L | 1.521 | 2.35E−01 | 21.6 | LYM170 | 12453.2 | H | 19.373 | 2.87E−02 | 24.8 |
| LYM111 | 12251.1 | L | 1.533 | 2.43E−01 | 22.6 | LYM69 | 11853.5 | H | 20.573 | 3.39E−02 | 32.5 |
| LYM143 | 12524.2 | L | 1.515 | 2.44E−01 | 21.2 | LYM290 | 12502.4 | H | 22.469 | 3.42E−02 | 44.7 |
| LYM21 | 11673.1 | L | 1.516 | 2.45E−01 | 21.2 | LYM130 | 12331.3 | H | 18.905 | 3.44E−02 | 21.8 |
| LYM174 | 12411.3 | L | 1.515 | 2.58E−01 | 21.1 | LYM137 | 12151.1 | H | 21.762 | 3.90E−02 | 40.2 |
| LYM290 | 12502.4 | L | 1.517 | 2.60E−01 | 21.3 | LYM53 | 11841.1 | H | 22.54 | 5.42E−02 | 45.2 |
| LYM21 | 11672.4 | L | 1.506 | 2.73E−01 | 20.4 | LYM51 | 11893.2 | H | 18.876 | 6.70E−02 | 21.6 |
| LYM19 | 11754.1 | L | 1.491 | 2.79E−01 | 19.2 | LYM138 | 12561.3 | H | 23.075 | 7.08E−02 | 48.7 |
| LYM290 | 12501.3 | L | 1.483 | 3.11E−01 | 18.6 | LYM148 | 12171.2 | H | 21.107 | 7.50E−02 | 36 |
| LYM174 | 12412.1 | L | 1.486 | 3.12E−01 | 18.8 | LYM119 | 12462.2 | H | 19.845 | 8.05E−02 | 27.8 |
| LYM10 | 11744.5 | L | 1.479 | 3.29E−01 | 18.2 | LYM57 | 12012.2 | H | 18.127 | 8.18E−02 | 16.8 |
| LYM13 | 11771.6 | L | 1.476 | 3.30E−01 | 18 | LYM119 | 12462.1 | H | 25.604 | 8.45E−02 | 64.9 |
| LYM268 | 12483.4 | L | 1.478 | 3.34E−01 | 18.1 | LYM14 | 12052.4 | H | 18.108 | 9.10E−02 | 16.7 |
| LYM9 | 11632.2 | L | 1.467 | 3.38E−01 | 17.3 | LYM68 | 11941.3 | H | 21.383 | 9.75E−02 | 37.7 |
| LYM4 | 11705.2 | L | 1.465 | 3.38E−01 | 17.1 | LYM43 | 11791.4 | H | 20.159 | 1.06E−01 | 29.9 |
| LYM289 | 12491.4 | L | 1.464 | 3.49E−01 | 17 | LYM137 | 12152.1 | H | 17.811 | 1.18E−01 | 14.7 |
| LYM143 | 12521.1 | L | 1.453 | 3.61E−01 | 16.2 | LYM105 | 12294.3 | H | 18.802 | 1.43E−01 | 21.1 |
| LYM141 | 12404.2 | L | 1.456 | 3.64E−01 | 16.4 | LYM111 | 12252.2 | H | 35.594 | 1.61E−01 | 129.3 |
| LYM10 | 11742.1 | L | 1.477 | 3.68E−01 | 18.1 | LYM30 | 11913.5 | H | 19.962 | 1.68E−01 | 28.6 |
| LYM289 | 12493.6 | L | 1.431 | 4.07E−01 | 14.4 | LYM268 | 12481.1 | H | 18.491 | 1.73E−01 | 19.1 |
| LYM102 | 12221.1 | L | 1.425 | 4.39E−01 | 13.9 | LYM130 | 12334.1 | H | 17.432 | 1.74E−01 | 12.3 |
| LYM111 | 12252.2 | L | 1.441 | 4.63E−01 | 15.2 | LYM148 | 12173.1 | H | 18.318 | 1.82E−01 | 18 |
| LYM138 | 12562.1 | L | 1.407 | 4.77E−01 | 12.5 | LYM68 | 11943.2 | H | 20.473 | 1.93E−01 | 31.9 |
| LYM137 | 12153.1 | L | 1.414 | 4.85E−01 | 13.1 | LYM137 | 12154.5 | H | 19.406 | 2.03E−01 | 25 |
| LYM268 | 12482.4 | L | 1.397 | 5.07E−01 | 11.7 | LYM152 | 12372.2 | H | 17.721 | 2.08E−01 | 14.2 |
| LYM2 | 11692.3 | L | 1.391 | 5.24E−01 | 11.2 | LYM100 | 12131.3 | H | 17.347 | 2.10E−01 | 11.7 |
| LYM13 | 11772.1 | L | 1.385 | 5.50E−01 | 10.8 | LYM105 | 12295.2 | H | 18.636 | 2.16E−01 | 20.1 |
| LYM129 | 12573.5 | L | 1.37 | 5.85E−01 | 9.5 | LYM130 | 12332.2 | H | 19.396 | 2.39E−01 | 25 |
| LYM162 | 12233.2 | L | 1.374 | 5.94E−01 | 9.8 | LYM290 | 12501.3 | H | 18.176 | 2.41E−01 | 17.1 |
| LYM100 | 12131.3 | L | 1.369 | 6.12E−01 | 9.5 | LYM172 | 12301.2 | H | 19.401 | 2.45E−01 | 25 |
| LYM113 | 12442.1 | L | 1.354 | 6.33E−01 | 8.2 | LYM68 | 11942.2 | H | 18.84 | 2.53E−01 | 21.4 |
| LYM148 | 12172.1 | L | 1.368 | 6.37E−01 | 9.4 | LYM62 | 12022.1 | H | 18.131 | 2.65E−01 | 16.8 |
| LYM17 | 11681.4 | L | 1.345 | 6.69E−01 | 7.6 | LYM57 | 12012.6 | H | 17.854 | 2.67E−01 | 15 |
| LYM268 | 12482.1 | L | 1.349 | 6.71E−01 | 7.9 | LYM111 | 12251.3 | H | 19.231 | 2.86E−01 | 23.9 |
| LYM16 | 11624.4 | L | 1.339 | 6.83E−01 | 7.1 | LYM111 | 12254.4 | H | 19.709 | 2.89E−01 | 27 |
| LYM17 | 11684.5 | L | 1.332 | 7.05E−01 | 6.5 | LYM51 | 11894.2 | H | 17.123 | 3.01E−01 | 10.3 |
| LYM9 | 11633.2 | L | 1.334 | 7.13E−01 | 6.7 | LYM30 | 11912.6 | H | 20.501 | 3.16E−01 | 32.1 |
| LYM174 | 12414.2 | L | 1.32 | 7.47E−01 | 5.6 | LYM53 | 11844.2 | H | 20.169 | 3.27E−01 | 29.9 |
| LYM17 | 11683.1 | L | 1.313 | 7.74E−01 | 5 | LYM132 | 12271.4 | H | 17.765 | 3.38E−01 | 14.4 |
| LYM290 | 12502.1 | L | 1.313 | 7.90E−01 | 5 | LYM62 | 12021.1 | H | 19.779 | 3.40E−01 | 27.4 |
| LYM140 | 12261.4 | L | 1.304 | 8.12E−01 | 4.2 | LYM137 | 12153.1 | H | 16.796 | 3.54E−01 | 8.2 |
| LYM1 | 11601.1 | L | 1.303 | 8.13E−01 | 4.2 | LYM100 | 12134.1 | H | 17.739 | 3.54E−01 | 14.3 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM102 | 12222.6 | L | 1.308 | 8.19E−01 | 4.6 | LYM152 | 12376.1 | H | 18.514 | 3.63E−01 | 19.3 |
| LYM2 | 11693.3 | L | 1.289 | 8.60E−01 | 3 | LYM51 | 11893.4 | H | 22.579 | 3.83E−01 | 45.5 |
| LYM132 | 12275.1 | L | 1.288 | 8.64E−01 | 3 | LYM100 | 12133.3 | H | 16.699 | 4.07E−01 | 7.6 |
| LYM143 | 12521.2 | L | 1.282 | 8.86E−01 | 2.5 | LYM143 | 12521.2 | H | 16.583 | 4.25E−01 | 6.8 |
| LYM22 | 11762.1 | L | 1.28 | 8.94E−01 | 2.3 | LYM111 | 12254.3 | H | 22.309 | 4.38E−01 | 43.7 |
| LYM143 | 12523.4 | L | 1.272 | 9.24E−01 | 1.7 | LYM14 | 12051.4 | H | 17.186 | 4.39E−01 | 10.7 |
| LYM13 | 11771.9 | L | 1.262 | 9.58E−01 | 0.9 | LYM152 | 12372.1 | H | 20.578 | 4.63E−01 | 32.6 |
| LYM111 | 12254.4 | L | 1.262 | 9.60E−01 | 0.9 | LYM143 | 12524.7 | H | 23.443 | 4.73E−01 | 51 |
| LYM138 | 12564.1 | L | 1.251 | 1.00E+00 | 0 | LYM134 | 12312.4 | H | 16.924 | 4.79E−01 | 9 |
| CONTROL | — | L | 1.251 | — | 0 | LYM290 | 12502.3 | H | 19.066 | 4.84E−01 | 22.8 |
| LYM1 | 11602.6 | M | 0.313 | 3.40E−05 | 94.2 | LYM68 | 11941.4 | H | 16.657 | 4.90E−01 | 7.3 |
| LYM10 | 11741.2 | M | 0.301 | 6.50E−05 | 86.3 | LYM119 | 12461.1 | H | 23.276 | 4.91E−01 | 49.9 |
| LYM119 | 12462.2 | M | 0.274 | 1.29E−03 | 69.7 | LYM26 | 11824.6 | H | 17.642 | 4.94E−01 | 13.7 |
| LYM9 | 11632.1 | M | 0.267 | 1.64E−03 | 65.3 | LYM132 | 12275.1 | H | 16.539 | 5.07E−01 | 6.5 |
| LYM143 | 12524.7 | M | 0.262 | 1.85E−03 | 62.2 | LYM67 | 11783.5 | H | 17.109 | 5.29E−01 | 10.2 |
| LYM148 | 12171.2 | M | 0.254 | 3.03E−03 | 57.5 | LYM132 | 12276.1 | H | 17.095 | 5.30E−01 | 10.1 |
| LYM138 | 12561.1 | M | 0.255 | 3.74E−03 | 58.1 | LYM119 | 12461.4 | H | 16.919 | 5.75E−01 | 9 |
| LYM174 | 12414.3 | M | 0.24 | 1.42E−02 | 48.8 | LYM43 | 11792.2 | H | 17.389 | 5.90E−01 | 12 |
| LYM1 | 11604.4 | M | 0.232 | 1.88E−02 | 43.5 | LYM53 | 11842.4 | H | 18.313 | 5.93E−01 | 18 |
| LYM130 | 12333.1 | M | 0.233 | 2.02E−02 | 44.7 | LYM30 | 11912.7 | H | 16.92 | 6.04E−01 | 9 |
| LYM102 | 12222.2 | M | 0.231 | 2.03E−02 | 43.1 | LYM95 | 12124.4 | H | 16.255 | 6.19E−01 | 4.7 |
| LYM289 | 12493.2 | M | 0.233 | 2.20E−02 | 44.7 | LYM138 | 12562.1 | H | 17.022 | 6.38E−01 | 9.7 |
| LYM148 | 12174.1 | M | 0.23 | 2.25E−02 | 42.5 | LYM30 | 11913.3 | H | 16.514 | 6.50E−01 | 6.4 |
| LYM141 | 12402.4 | M | 0.23 | 2.54E−02 | 42.6 | LYM43 | 11793.2 | H | 17.297 | 6.59E−01 | 11.4 |
| LYM119 | 12462.1 | M | 0.23 | 2.88E−02 | 42.6 | LYM162 | 12231.3 | H | 16.771 | 6.82E−01 | 8 |
| LYM138 | 12561.3 | M | 0.228 | 3.48E−02 | 41.2 | LYM67 | 11782.4 | H | 16.28 | 6.90E−01 | 4.9 |
| LYM10 | 11742.2 | M | 0.224 | 3.55E−02 | 39 | LYM26 | 11824.5 | H | 15.96 | 7.43E−01 | 2.8 |
| LYM1 | 11602.1 | M | 0.224 | 3.66E−02 | 38.8 | LYM31 | 11922.3 | H | 16.061 | 7.61E−01 | 3.5 |
| LYM105 | 12293.1 | M | 0.222 | 4.23E−02 | 37.6 | LYM152 | 12371.2 | H | 16.57 | 7.69E−01 | 6.7 |
| LYM174 | 12411.2 | M | 0.222 | 4.59E−02 | 37.7 | LYM69 | 11852.4 | H | 16.05 | 7.87E−01 | 3.4 |
| LYM162 | 12234.4 | M | 0.23 | 4.82E−02 | 42.4 | LYM254 | 12474.4 | H | 16.855 | 8.07E−01 | 8.6 |
| LYM10 | 11744.1 | M | 0.219 | 4.91E−02 | 35.7 | LYM111 | 12251.1 | H | 15.798 | 8.44E−01 | 1.8 |
| LYM152 | 12372.2 | M | 0.218 | 5.92E−02 | 35.1 | LYM152 | 12373.1 | H | 16.237 | 8.53E−01 | 4.6 |
| LYM162 | 12234.3 | M | 0.218 | 6.16E−02 | 34.9 | LYM268 | 12483.2 | H | 16.06 | 8.84E−01 | 3.5 |
| LYM4 | 11706.5 | M | 0.216 | 6.18E−02 | 34 | LYM51 | 11891.1 | H | 15.71 | 8.91E−01 | 1.2 |
| LYM15 | 11611.3 | M | 0.221 | 7.09E−02 | 36.8 | LYM172 | 12302.2 | H | 15.768 | 9.46E−01 | 1.6 |
| LYM130 | 12332.2 | M | 0.215 | 8.05E−02 | 33 | LYM66 | 11954.4 | H | 15.884 | 9.47E−01 | 2.3 |
| LYM19 | 11751.5 | M | 0.212 | 8.99E−02 | 31.1 | LYM138 | 12564.1 | H | 15.654 | 9.64E−01 | 0.8 |
| LYM15 | 11614.3 | M | 0.21 | 9.28E−02 | 29.8 | LYM140 | 12262.3 | H | 15.652 | 9.65E−01 | 0.8 |
| LYM119 | 12463.2 | M | 0.209 | 1.02E−01 | 29.8 | LYM290 | 12502.1 | H | 15.592 | 9.67E−01 | 0.4 |
| LYM132 | 12271.4 | M | 0.209 | 1.03E−01 | 29.8 | LYM170 | 12452.3 | H | 15.573 | 9.84E−01 | 0.3 |
| LYM140 | 12262.3 | M | 0.207 | 1.08E−01 | 28.5 | LYM268 | 12482.1 | H | 15.528 | 9.99E−01 | 0 |
| LYM15 | 11612.3 | M | 0.209 | 1.11E−01 | 29.7 | CONTROL | — | H | 15.523 | — | 0 |
| LYM289 | 12491.1 | M | 0.21 | 1.13E−01 | 30.3 | LYM111 | 12252.2 | J | 0.075 | 6.99E−04 | 88 |
| LYM130 | 12334.1 | M | 0.207 | 1.15E−01 | 28.5 | LYM148 | 12174.1 | J | 0.06 | 1.71E−02 | 51.2 |
| LYM19 | 11751.4 | M | 0.21 | 1.16E−01 | 30.4 | LYM100 | 12131.2 | J | 0.057 | 3.78E−02 | 43.8 |
| LYM19 | 11753.1 | M | 0.203 | 1.46E−01 | 25.9 | LYM119 | 12462.1 | J | 0.057 | 4.39E−02 | 42.8 |
| LYM134 | 12311.2 | M | 0.205 | 1.46E−01 | 27 | LYM134 | 12314.2 | J | 0.056 | 5.26E−02 | 40.2 |
| LYM162 | 12231.1 | M | 0.205 | 1.48E−01 | 26.8 | LYM138 | 12561.1 | J | 0.056 | 5.33E−02 | 40.8 |
| LYM132 | 12273.2 | M | 0.202 | 1.51E−01 | 25.4 | LYM53 | 11841.1 | J | 0.053 | 1.00E−01 | 33.8 |
| LYM1 | 11603.2 | M | 0.202 | 1.55E−01 | 25 | LYM119 | 12461.1 | J | 0.055 | 1.12E−01 | 39 |
| LYM119 | 12461.4 | M | 0.202 | 1.59E−01 | 24.9 | LYM43 | 11791.5 | J | 0.052 | 1.28E−01 | 30.7 |
| LYM148 | 12173.1 | M | 0.205 | 1.64E−01 | 26.9 | LYM143 | 12524.2 | J | 0.052 | 1.29E−01 | 30.9 |
| LYM17 | 11684.4 | M | 0.201 | 1.64E−01 | 24.6 | LYM138 | 12561.3 | J | 0.052 | 1.37E−01 | 31 |
| LYM141 | 12404.4 | M | 0.199 | 1.99E−01 | 23.6 | LYM268 | 12482.3 | J | 0.052 | 1.50E−01 | 29.7 |
| LYM102 | 12222.3 | M | 0.202 | 2.01E−01 | 25.1 | LYM51 | 11893.4 | J | 0.052 | 1.68E−01 | 31.2 |
| LYM174 | 12412.1 | M | 0.201 | 2.06E−01 | 24.5 | LYM170 | 12453.2 | J | 0.05 | 1.80E−01 | 26.5 |
| LYM268 | 12483.2 | M | 0.196 | 2.14E−01 | 21.6 | LYM148 | 12171.2 | J | 0.05 | 1.84E−01 | 25.8 |
| LYM162 | 12231.3 | M | 0.196 | 2.16E−01 | 21.8 | LYM290 | 12502.4 | J | 0.051 | 1.91E−01 | 27.3 |
| LYM4 | 11705.2 | M | 0.197 | 2.21E−01 | 22.2 | LYM69 | 11853.5 | J | 0.05 | 1.99E−01 | 25.8 |
| LYM152 | 12371.2 | M | 0.196 | 2.42E−01 | 21.5 | LYM143 | 12524.7 | J | 0.052 | 2.03E−01 | 30.5 |
| LYM141 | 12404.3 | M | 0.195 | 2.46E−01 | 20.8 | LYM152 | 12372.1 | J | 0.051 | 2.08E−01 | 27.9 |
| LYM21 | 11671.2 | M | 0.194 | 2.63E−01 | 19.9 | LYM31 | 11923.4 | J | 0.049 | 2.30E−01 | 23.8 |
| LYM9 | 11633.7 | M | 0.194 | 2.66E−01 | 20.2 | LYM62 | 12021.1 | J | 0.049 | 2.47E−01 | 23.5 |
| LYM17 | 11682.1 | M | 0.196 | 2.76E−01 | 21.7 | LYM68 | 11941.3 | J | 0.049 | 2.49E−01 | 22.7 |
| LYM105 | 12294.2 | M | 0.197 | 2.79E−01 | 22.4 | LYM68 | 11942.3 | J | 0.049 | 2.51E−01 | 22.9 |
| LYM100 | 12133.1 | M | 0.19 | 3.08E−01 | 17.7 | LYM30 | 11912.6 | J | 0.049 | 2.52E−01 | 23.6 |
| LYM15 | 11612.2 | M | 0.19 | 3.12E−01 | 17.8 | LYM137 | 12151.1 | J | 0.049 | 2.56E−01 | 23 |
| LYM111 | 12251.1 | M | 0.192 | 3.17E−01 | 18.8 | LYM111 | 12254.3 | J | 0.05 | 2.65E−01 | 26.4 |
| LYM143 | 12524.2 | M | 0.189 | 3.24E−01 | 17.4 | LYM137 | 12154.5 | J | 0.049 | 2.67E−01 | 22.6 |
| LYM21 | 11673.1 | M | 0.19 | 3.25E−01 | 17.4 | LYM43 | 11791.4 | J | 0.047 | 3.56E−01 | 18.4 |
| LYM174 | 12411.3 | M | 0.189 | 3.38E−01 | 17.3 | LYM57 | 12013.5 | J | 0.047 | 3.61E−01 | 17.9 |
| LYM290 | 12502.4 | M | 0.19 | 3.39E−01 | 17.5 | LYM53 | 11844.2 | J | 0.047 | 3.67E−01 | 18.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM21 | 11672.4 | M | 0.188 | 3.57E−01 | 16.6 | LYM30 | 11913.5 | J | 0.047 | 3.74E−01 | 18.1 |
| LYM19 | 11754.1 | M | 0.186 | 3.68E−01 | 15.5 | LYM172 | 12301.2 | J | 0.047 | 3.74E−01 | 17.8 |
| LYM290 | 12501.3 | M | 0.185 | 4.02E−01 | 14.9 | LYM140 | 12264.1 | J | 0.046 | 4.03E−01 | 16.5 |
| LYM10 | 11744.5 | M | 0.185 | 4.23E−01 | 14.5 | LYM111 | 12251.3 | J | 0.046 | 4.13E−01 | 16.2 |
| LYM13 | 11771.6 | M | 0.184 | 4.24E−01 | 14.3 | LYM105 | 12294.3 | J | 0.046 | 4.21E−01 | 15.8 |
| LYM268 | 12483.4 | M | 0.185 | 4.28E−01 | 14.5 | LYM119 | 12462.2 | J | 0.046 | 4.34E−01 | 16.2 |
| LYM9 | 11632.2 | M | 0.183 | 4.36E−01 | 13.6 | LYM290 | 12502.2 | J | 0.047 | 4.34E−01 | 16.7 |
| LYM289 | 12491.4 | M | 0.183 | 4.48E−01 | 13.4 | LYM68 | 11943.2 | J | 0.046 | 4.46E−01 | 15 |
| LYM10 | 11742.1 | M | 0.185 | 4.60E−01 | 14.4 | LYM268 | 12481.1 | J | 0.046 | 4.64E−01 | 14.3 |
| LYM143 | 12521.1 | M | 0.182 | 4.66E−01 | 12.6 | LYM137 | 12153.1 | J | 0.046 | 4.66E−01 | 14.7 |
| LYM141 | 12404.2 | M | 0.182 | 4.66E−01 | 12.7 | LYM137 | 12152.1 | J | 0.046 | 4.76E−01 | 14.3 |
| LYM289 | 12493.6 | M | 0.179 | 5.20E−01 | 10.9 | LYM111 | 12254.4 | J | 0.045 | 5.19E−01 | 12.8 |
| LYM17 | 11681.4 | M | 0.179 | 5.21E−01 | 11 | LYM67 | 11783.5 | J | 0.045 | 5.24E−01 | 13.1 |
| LYM102 | 12221.1 | M | 0.178 | 5.52E−01 | 10.4 | LYM14 | 12052.4 | J | 0.045 | 5.38E−01 | 12 |
| LYM111 | 12252.2 | M | 0.18 | 5.64E−01 | 11.6 | LYM152 | 12376.1 | J | 0.045 | 5.55E−01 | 11.7 |
| LYM138 | 12562.1 | M | 0.176 | 5.99E−01 | 9 | LYM57 | 12012.2 | J | 0.044 | 5.56E−01 | 11.6 |
| LYM137 | 12153.1 | M | 0.177 | 5.99E−01 | 9.6 | LYM43 | 11792.2 | J | 0.045 | 5.60E−01 | 11.9 |
| LYM268 | 12482.3 | M | 0.175 | 6.31E−01 | 8.3 | LYM68 | 11942.2 | J | 0.044 | 6.17E−01 | 9.8 |
| LYM2 | 11692.3 | M | 0.174 | 6.50E−01 | 7.8 | LYM134 | 12312.4 | J | 0.043 | 6.74E−01 | 8.3 |
| LYM13 | 11772.1 | M | 0.173 | 6.76E−01 | 7.3 | LYM138 | 12562.1 | J | 0.043 | 6.85E−01 | 7.9 |
| LYM129 | 12573.5 | M | 0.171 | 7.18E−01 | 6.1 | LYM105 | 12295.2 | J | 0.043 | 6.88E−01 | 7.9 |
| LYM162 | 12233.2 | M | 0.172 | 7.20E−01 | 6.4 | LYM152 | 12372.2 | J | 0.043 | 6.89E−01 | 7.7 |
| LYM100 | 12131.3 | M | 0.171 | 7.38E−01 | 6.1 | LYM254 | 12474.4 | J | 0.043 | 7.03E−01 | 8.3 |
| LYM148 | 12172.1 | M | 0.171 | 7.57E−01 | 6 | LYM51 | 11893.2 | J | 0.043 | 7.27E−01 | 6.7 |
| LYM113 | 12442.1 | M | 0.169 | 7.72E−01 | 4.9 | LYM57 | 12012.6 | J | 0.043 | 7.31E−01 | 6.8 |
| LYM268 | 12482.1 | M | 0.169 | 8.03E−01 | 4.5 | LYM119 | 12461.4 | J | 0.043 | 7.38E−01 | 6.7 |
| LYM16 | 11624.4 | M | 0.167 | 8.24E−01 | 3.7 | LYM100 | 12134.1 | J | 0.042 | 7.60E−01 | 6 |
| LYM17 | 11684.5 | M | 0.167 | 8.48E−01 | 3.2 | LYM132 | 12276.1 | J | 0.042 | 7.61E−01 | 5.8 |
| LYM9 | 11633.2 | M | 0.167 | 8.49E−01 | 3.4 | LYM290 | 12501.3 | J | 0.042 | 7.65E−01 | 5.8 |
| LYM174 | 12414.2 | M | 0.165 | 8.92E−01 | 2.3 | LYM62 | 12022.1 | J | 0.042 | 7.73E−01 | 5.6 |
| LYM17 | 11683.1 | M | 0.164 | 9.20E−01 | 1.7 | LYM26 | 11824.6 | J | 0.042 | 7.80E−01 | 5.3 |
| LYM290 | 12502.1 | M | 0.164 | 9.25E−01 | 1.7 | LYM51 | 11891.1 | J | 0.042 | 8.08E−01 | 4.6 |
| LYM102 | 12222.6 | M | 0.163 | 9.46E−01 | 1.3 | LYM43 | 11793.2 | J | 0.042 | 8.24E−01 | 4.5 |
| LYM140 | 12261.4 | M | 0.163 | 9.55E−01 | 1 | LYM100 | 12131.3 | J | 0.041 | 8.31E−01 | 4 |
| LYM1 | 11601.1 | M | 0.163 | 9.57E−01 | 0.9 | LYM143 | 12521.2 | J | 0.041 | 8.39E−01 | 3.9 |
| CONTROL | — | M | 0.161 | — | 0 | LYM132 | 12275.1 | J | 0.041 | 8.53E−01 | 3.6 |
| LYM10 | 11741.2 | N | 0.274 | 1.39E−04 | 51 | LYM100 | 12133.3 | J | 0.041 | 8.80E−01 | 2.9 |
| LYM9 | 11632.1 | N | 0.272 | 1.71E−04 | 49.7 | LYM51 | 11894.2 | J | 0.041 | 8.81E−01 | 2.9 |
| LYM1 | 11602.5 | N | 0.27 | 1.78E−04 | 48.6 | LYM67 | 11782.6 | J | 0.041 | 8.84E−01 | 2.9 |
| LYM143 | 12524.7 | N | 0.267 | 4.23E−04 | 46.9 | LYM14 | 12051.4 | J | 0.041 | 8.90E−01 | 2.7 |
| LYM119 | 12462.2 | N | 0.252 | 5.22E−03 | 38.9 | LYM53 | 11842.4 | J | 0.041 | 9.19E−01 | 2.1 |
| LYM10 | 11742.2 | N | 0.236 | 1.12E−02 | 29.9 | LYM172 | 12302.2 | J | 0.04 | 9.57E−01 | 1.1 |
| LYM289 | 12493.2 | N | 0.235 | 1.37E−02 | 29.4 | LYM130 | 12331.3 | J | 0.04 | 9.66E−01 | 0.8 |
| LYM174 | 12414.3 | N | 0.238 | 1.53E−02 | 30.8 | LYM268 | 12482.1 | J | 0.04 | 9.71E−01 | 0.7 |
| LYM148 | 12171.2 | N | 0.234 | 1.54E−02 | 29 | LYM132 | 12271.4 | J | 0.04 | 9.73E−01 | 0.7 |
| LYM105 | 12293.1 | N | 0.233 | 1.86E−02 | 28 | LYM162 | 12231.3 | J | 0.04 | 9.76E−01 | 0.6 |
| LYM138 | 12561.1 | N | 0.235 | 1.90E−02 | 29.3 | LYM14 | 12051.1 | J | 0.04 | 9.76E−01 | 0.6 |
| LYM102 | 12222.2 | N | 0.231 | 2.04E−02 | 27.3 | LYM30 | 11912.7 | J | 0.04 | 9.77E−01 | 0.6 |
| LYM148 | 12174.1 | N | 0.23 | 2.20E−02 | 26.7 | LYM69 | 11854.2 | J | 0.04 | 9.77E−01 | 0.5 |
| LYM130 | 12333.1 | N | 0.232 | 2.21E−02 | 27.5 | LYM152 | 12373.1 | J | 0.04 | 9.81E−01 | 0.5 |
| LYM162 | 12234.3 | N | 0.231 | 2.61E−02 | 27.1 | LYM148 | 12173.1 | J | 0.04 | 9.85E−01 | 0.4 |
| LYM1 | 11604.4 | N | 0.23 | 2.80E−02 | 26.7 | CONTROL | — | J | 0.04 | — | 0 |
| LYM15 | 11614.3 | N | 0.227 | 3.23E−02 | 25.2 | LYM67 | 11783.5 | K | 0.741 | 6.72E−04 | 44.8 |
| LYM152 | 12372.2 | N | 0.228 | 3.31E−02 | 25.6 | LYM132 | 12276.1 | K | 0.696 | 1.12E−02 | 36 |
| LYM162 | 12234.4 | N | 0.236 | 3.39E−02 | 30 | LYM138 | 12566.1 | K | 0.659 | 1.33E−02 | 28.9 |
| LYM141 | 12402.4 | N | 0.226 | 4.06E−02 | 24.5 | LYM119 | 12461.1 | K | 0.671 | 1.72E−02 | 31.2 |
| LYM134 | 12311.2 | N | 0.226 | 4.65E−02 | 24.2 | LYM69 | 11853.5 | K | 0.657 | 2.56E−02 | 28.4 |
| LYM19 | 11751.5 | N | 0.223 | 4.82E−02 | 22.9 | LYM137 | 12151.1 | K | 0.648 | 2.68E−02 | 26.8 |
| LYM10 | 11744.1 | N | 0.224 | 4.91E−02 | 23.5 | LYM138 | 12561.1 | K | 0.638 | 3.91E−02 | 24.7 |
| LYM1 | 11602.1 | N | 0.224 | 5.06E−02 | 23.2 | LYM105 | 12297.1 | K | 0.646 | 4.88E−02 | 26.3 |
| LYM132 | 12271.4 | N | 0.221 | 5.78E−02 | 21.8 | LYM30 | 11913.3 | K | 0.631 | 5.27E−02 | 23.3 |
| LYM174 | 12411.2 | N | 0.223 | 5.88E−02 | 22.8 | LYM53 | 11841.1 | K | 0.641 | 5.90E−02 | 25.3 |
| LYM140 | 12262.3 | N | 0.221 | 6.40E−02 | 21.4 | LYM111 | 12251.1 | K | 0.627 | 6.03E−02 | 22.5 |
| LYM119 | 12461.4 | N | 0.22 | 7.17E−02 | 21.3 | LYM24 | 12061.2 | K | 0.631 | 6.18E−02 | 23.3 |
| LYM4 | 11706.5 | N | 0.219 | 8.19E−02 | 20.4 | LYM24 | 12064.1 | K | 0.618 | 6.89E−02 | 20.9 |
| LYM15 | 11611.3 | N | 0.224 | 8.23E−02 | 23.1 | LYM254 | 12471.2 | K | 0.615 | 7.20E−02 | 20.3 |
| LYM130 | 12332.2 | N | 0.222 | 8.28E−02 | 22.3 | LYM31 | 11923.1 | K | 0.617 | 8.28E−02 | 20.6 |
| LYM268 | 12483.2 | N | 0.217 | 9.09E−02 | 19.5 | LYM57 | 12013.5 | K | 0.617 | 8.35E−02 | 20.7 |
| LYM174 | 12412.1 | N | 0.22 | 9.27E−02 | 20.8 | LYM105 | 12295.2 | K | 0.62 | 8.37E−02 | 21.2 |
| LYM162 | 12231.1 | N | 0.217 | 1.07E−01 | 19.4 | LYM105 | 12293.1 | K | 0.611 | 8.53E−02 | 19.5 |
| LYM19 | 11751.4 | N | 0.218 | 1.07E−01 | 19.8 | LYM51 | 11893.2 | K | 0.62 | 8.98E−02 | 21.3 |
| LYM138 | 12561.3 | N | 0.217 | 1.08E−01 | 19.3 | LYM62 | 12022.1 | K | 0.612 | 9.67E−02 | 19.7 |
| LYM141 | 12404.4 | N | 0.217 | 1.08E−01 | 19.3 | LYM68 | 11942.3 | K | 0.605 | 1.06E−01 | 18.2 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM19 | 11753.1 | N | 0.214 | 1.09E−01 | 18.1 | LYM148 | 12174.1 | K | 0.615 | 1.10E−01 | 20.3 |
| LYM174 | 12411.3 | N | 0.217 | 1.15E−01 | 19.2 | LYM111 | 12254.4 | K | 0.614 | 1.13E−01 | 20.1 |
| LYM132 | 12273.2 | N | 0.213 | 1.19E−01 | 17.4 | LYM268 | 12482.3 | K | 0.616 | 1.16E−01 | 20.4 |
| LYM17 | 11684.4 | N | 0.214 | 1.19E−01 | 17.9 | LYM111 | 12252.2 | K | 0.609 | 1.28E−01 | 19.1 |
| LYM4 | 11705.2 | N | 0.215 | 1.21E−01 | 18.1 | LYM67 | 11782.5 | K | 0.602 | 1.28E−01 | 17.6 |
| LYM15 | 11612.3 | N | 0.217 | 1.25E−01 | 19.3 | LYM62 | 12023.4 | K | 0.606 | 1.29E−01 | 18.4 |
| LYM9 | 11632.2 | N | 0.215 | 1.26E−01 | 18.3 | LYM148 | 12172.1 | K | 0.601 | 1.35E−01 | 17.5 |
| LYM119 | 12462.1 | N | 0.216 | 1.29E−01 | 18.6 | LYM143 | 12524.2 | K | 0.605 | 1.51E−01 | 18.2 |
| LYM21 | 11673.1 | N | 0.213 | 1.36E−01 | 17.4 | LYM138 | 12564.1 | K | 0.616 | 1.54E−01 | 20.4 |
| LYM290 | 12501.3 | N | 0.216 | 1.42E−01 | 18.7 | LYM134 | 12311.2 | K | 0.599 | 1.66E−01 | 17.1 |
| LYM130 | 12334.1 | N | 0.213 | 1.48E−01 | 17.3 | LYM26 | 11824.6 | K | 0.602 | 1.76E−01 | 17.6 |
| LYM17 | 11682.1 | N | 0.217 | 1.52E−01 | 19.2 | LYM290 | 12504.1 | K | 0.596 | 1.83E−01 | 16.5 |
| LYM162 | 12231.3 | N | 0.211 | 1.58E−01 | 16.2 | LYM95 | 12124.4 | K | 0.591 | 1.85E−01 | 15.5 |
| LYM100 | 12133.1 | N | 0.21 | 1.59E−01 | 15.8 | LYM153 | 12321.2 | K | 0.595 | 1.94E−01 | 16.4 |
| LYM19 | 11754.1 | N | 0.211 | 1.60E−01 | 15.9 | LYM170 | 12453.2 | K | 0.585 | 2.40E−01 | 14.3 |
| LYM148 | 12173.1 | N | 0.214 | 1.61E−01 | 17.8 | LYM30 | 11913.5 | K | 0.585 | 2.41E−01 | 14.3 |
| LYM137 | 12153.1 | N | 0.21 | 1.80E−01 | 15.8 | LYM119 | 12462.2 | K | 0.586 | 2.44E−01 | 14.7 |
| LYM138 | 12562.1 | N | 0.208 | 1.95E−01 | 14.6 | LYM143 | 12524.7 | K | 0.6 | 2.47E−01 | 17.4 |
| LYM102 | 12221.1 | N | 0.208 | 1.97E−01 | 14.5 | LYM172 | 12302.2 | K | 0.578 | 2.79E−01 | 13 |
| LYM15 | 11612.2 | N | 0.208 | 2.06E−01 | 14.6 | LYM68 | 11943.2 | K | 0.583 | 2.80E−01 | 14 |
| LYM13 | 11772.1 | N | 0.209 | 2.08E−01 | 14.9 | LYM132 | 12275.1 | K | 0.585 | 2.80E−01 | 14.3 |
| LYM1 | 11601.1 | N | 0.209 | 2.18E−01 | 15.2 | LYM66 | 11955.2 | K | 0.575 | 2.85E−01 | 12.4 |
| LYM143 | 12521.1 | N | 0.207 | 2.19E−01 | 14 | LYM290 | 12502.2 | K | 0.577 | 2.87E−01 | 12.8 |
| LYM152 | 12371.2 | N | 0.208 | 2.27E−01 | 14.5 | LYM140 | 12261.1 | K | 0.598 | 2.92E−01 | 16.8 |
| LYM289 | 12491.4 | N | 0.206 | 2.34E−01 | 13.6 | LYM290 | 12502.1 | K | 0.578 | 2.94E−01 | 13 |
| LYM1 | 11603.2 | N | 0.205 | 2.45E−01 | 13 | LYM134 | 12314.2 | K | 0.575 | 2.95E−01 | 12.4 |
| LYM268 | 12483.4 | N | 0.208 | 2.49E−01 | 14.4 | LYM62 | 12021.1 | K | 0.579 | 3.02E−01 | 13.2 |
| LYM21 | 11672.4 | N | 0.207 | 2.55E−01 | 14 | LYM14 | 12052.5 | K | 0.574 | 3.05E−01 | 12.2 |
| LYM289 | 12493.6 | N | 0.205 | 2.58E−01 | 12.7 | LYM95 | 12121.2 | K | 0.573 | 3.13E−01 | 12 |
| LYM21 | 11671.2 | N | 0.206 | 2.59E−01 | 13.3 | LYM268 | 12481.1 | K | 0.575 | 3.22E−01 | 12.5 |
| LYM111 | 12251.1 | N | 0.207 | 2.60E−01 | 13.9 | LYM69 | 11854.2 | K | 0.57 | 3.32E−01 | 11.5 |
| LYM119 | 12463.2 | N | 0.205 | 2.61E−01 | 12.9 | LYM62 | 12022.2 | K | 0.574 | 3.34E−01 | 12.2 |
| LYM10 | 11744.5 | N | 0.206 | 2.65E−01 | 13.5 | LYM30 | 11912.7 | K | 0.574 | 3.35E−01 | 12.3 |
| LYM148 | 12172.1 | N | 0.209 | 2.78E−01 | 15 | LYM69 | 11853.4 | K | 0.578 | 3.42E−01 | 13 |
| LYM141 | 12404.2 | N | 0.203 | 2.88E−01 | 11.9 | LYM132 | 12275.3 | K | 0.569 | 3.42E−01 | 11.2 |
| LYM13 | 11771.6 | N | 0.205 | 2.89E−01 | 12.6 | LYM130 | 12333.1 | K | 0.565 | 3.66E−01 | 10.6 |
| LYM141 | 12404.3 | N | 0.204 | 2.94E−01 | 12.1 | LYM105 | 12294.2 | K | 0.563 | 3.67E−01 | 10.1 |
| LYM102 | 12222.3 | N | 0.207 | 3.08E−01 | 14.2 | LYM31 | 11922.3 | K | 0.567 | 3.69E−01 | 10.8 |
| LYM289 | 12491.3 | N | 0.206 | 3.10E−01 | 13.2 | LYM170 | 12453.3 | K | 0.568 | 3.72E−01 | 11.1 |
| LYM17 | 11681.4 | N | 0.202 | 3.14E−01 | 11.3 | LYM254 | 12473.1 | K | 0.563 | 4.05E−01 | 10 |
| LYM268 | 12482.3 | N | 0.203 | 3.18E−01 | 11.5 | LYM31 | 11924.4 | K | 0.57 | 4.08E−01 | 11.4 |
| LYM162 | 12233.2 | N | 0.202 | 3.39E−01 | 11.3 | LYM152 | 12376.1 | K | 0.564 | 4.22E−01 | 10.3 |
| LYM174 | 12414.2 | N | 0.201 | 3.47E−01 | 10.8 | LYM57 | 12012.2 | K | 0.565 | 4.26E−01 | 10.4 |
| LYM16 | 11624.4 | N | 0.2 | 3.59E−01 | 10.2 | LYM14 | 12051.4 | K | 0.56 | 4.29E−01 | 9.5 |
| LYM129 | 12573.5 | N | 0.2 | 3.63E−01 | 10.2 | LYM140 | 12261.4 | K | 0.557 | 4.32E−01 | 9 |
| LYM290 | 12502.4 | N | 0.202 | 3.73E−01 | 11.1 | LYM130 | 12334.1 | K | 0.558 | 4.46E−01 | 9.1 |
| LYM268 | 12482.1 | N | 0.198 | 4.54E−01 | 9 | LYM137 | 12154.5 | K | 0.556 | 4.67E−01 | 8.7 |
| LYM105 | 12294.2 | N | 0.2 | 4.70E−01 | 10 | LYM100 | 12131.3 | K | 0.557 | 4.69E−01 | 9 |
| LYM132 | 12275.3 | N | 0.2 | 4.79E−01 | 10 | LYM53 | 11841.2 | K | 0.558 | 4.74E−01 | 9.2 |
| LYM19 | 11752.2 | N | 0.197 | 4.82E−01 | 8.5 | LYM268 | 12483.4 | K | 0.565 | 4.77E−01 | 10.4 |
| LYM143 | 12524.2 | N | 0.196 | 4.88E−01 | 7.8 | LYM68 | 11941.3 | K | 0.555 | 4.80E−01 | 8.6 |
| LYM9 | 11633.7 | N | 0.196 | 4.90E−01 | 8.1 | LYM170 | 12452.4 | K | 0.559 | 4.81E−01 | 9.3 |
| LYM153 | 12321.2 | N | 0.196 | 5.19E−01 | 7.7 | LYM148 | 12173.1 | K | 0.555 | 4.86E−01 | 8.5 |
| LYM111 | 12254.4 | N | 0.195 | 5.30E−01 | 7.1 | LYM268 | 12482.1 | K | 0.558 | 4.94E−01 | 9.1 |
| LYM132 | 12275.1 | N | 0.194 | 5.34E−01 | 7 | LYM26 | 11821.2 | K | 0.56 | 5.00E−01 | 9.4 |
| LYM143 | 12521.2 | N | 0.194 | 5.39E−01 | 6.9 | LYM31 | 11921.3 | K | 0.558 | 5.05E−01 | 9.1 |
| LYM10 | 11742.1 | N | 0.196 | 5.54E−01 | 7.8 | LYM31 | 11923.4 | K | 0.554 | 5.08E−01 | 8.3 |
| LYM102 | 12222.6 | N | 0.196 | 5.56E−01 | 7.9 | LYM153 | 12322.1 | K | 0.56 | 5.10E−01 | 9.5 |
| LYM13 | 11771.9 | N | 0.193 | 5.98E−01 | 6.2 | LYM30 | 11913.4 | K | 0.549 | 5.23E−01 | 7.4 |
| LYM113 | 12442.1 | N | 0.192 | 6.01E−01 | 5.9 | LYM53 | 11844.2 | K | 0.552 | 5.40E−01 | 7.9 |
| LYM2 | 11693.3 | N | 0.192 | 6.18E−01 | 5.7 | LYM138 | 12561.3 | K | 0.551 | 5.44E−01 | 7.7 |
| LYM140 | 12261.4 | N | 0.191 | 6.66E−01 | 4.9 | LYM152 | 12372.1 | K | 0.552 | 5.48E−01 | 7.9 |
| LYM16 | 11622.2 | N | 0.19 | 6.70E−01 | 4.8 | LYM24 | 12061.4 | K | 0.548 | 5.49E−01 | 7.2 |
| LYM130 | 12331.1 | N | 0.189 | 7.24E−01 | 4.2 | LYM172 | 12304.2 | K | 0.552 | 5.50E−01 | 7.8 |
| LYM100 | 12131.3 | N | 0.189 | 7.44E−01 | 3.9 | LYM148 | 12174.2 | K | 0.552 | 5.65E−01 | 7.9 |
| LYM2 | 11692.3 | N | 0.188 | 7.48E−01 | 3.6 | LYM254 | 12474.3 | K | 0.55 | 5.67E−01 | 7.6 |
| LYM138 | 12564.1 | N | 0.188 | 7.56E−01 | 3.5 | LYM51 | 11891.1 | K | 0.543 | 5.74E−01 | 6.2 |
| LYM111 | 12252.2 | N | 0.189 | 7.61E−01 | 4.2 | LYM152 | 12371.2 | K | 0.548 | 5.75E−01 | 7.2 |
| LYM106 | 12141.4 | N | 0.188 | 7.62E−01 | 3.5 | LYM43 | 11793.2 | K | 0.55 | 5.77E−01 | 7.6 |
| LYM141 | 12404.1 | N | 0.187 | 7.90E−01 | 3 | LYM152 | 12373.1 | K | 0.55 | 5.98E−01 | 7.6 |
| LYM289 | 12492.2 | N | 0.187 | 8.07E−01 | 2.9 | LYM254 | 12474.4 | K | 0.546 | 6.00E−01 | 6.7 |
| LYM153 | 12324.2 | N | 0.187 | 8.23E−01 | 2.9 | LYM67 | 11781.5 | K | 0.542 | 6.09E−01 | 6 |
| LYM17 | 11684.5 | N | 0.185 | 8.58E−01 | 2 | LYM43 | 11791.5 | K | 0.545 | 6.10E−01 | 6.6 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM119 | 12461.1 | N | 0.185 | 8.84E−01 | 1.7 | LYM51 | 11892.1 | K | 0.543 | 6.25E−01 | 6.2 |
| LYM143 | 12523.4 | N | 0.185 | 8.92E−01 | 1.6 | LYM100 | 12131.2 | K | 0.541 | 6.31E−01 | 5.8 |
| LYM9 | 11633.2 | N | 0.184 | 9.21E−01 | 1.3 | LYM143 | 12521.2 | K | 0.539 | 6.33E−01 | 5.4 |
| LYM17 | 11683.1 | N | 0.183 | 9.35E−01 | 0.9 | LYM162 | 12231.1 | K | 0.539 | 6.33E−01 | 5.4 |
| LYM106 | 12142.2 | N | 0.182 | 9.73E−01 | 0.4 | LYM143 | 12521.1 | K | 0.539 | 6.47E−01 | 5.4 |
| LYM22 | 11764.1 | N | 0.182 | 9.75E−01 | 0.4 | LYM67 | 11782.6 | K | 0.539 | 6.49E−01 | 5.4 |
| LYM22 | 11762.1 | N | 0.182 | 9.78E−01 | 0.3 | LYM53 | 11843.2 | K | 0.54 | 6.70E−01 | 5.5 |
| LYM140 | 12264.1 | N | 0.182 | 9.80E−01 | 0.3 | LYM26 | 11824.5 | K | 0.536 | 6.75E−01 | 4.7 |
| LYM153 | 12323.2 | N | 0.182 | 9.81E−01 | 0.3 | LYM130 | 12332.1 | K | 0.542 | 6.78E−01 | 5.9 |
| LYM106 | 12144.4 | N | 0.182 | 9.82E−01 | 0.3 | LYM66 | 11952.1 | K | 0.535 | 6.92E−01 | 4.6 |
| LYM105 | 12294.3 | N | 0.182 | 9.87E−01 | 0.2 | LYM100 | 12133.3 | K | 0.533 | 7.11E−01 | 4.2 |
| CONTROL | — | N | 0.182 | — | 0 | LYM290 | 12502.4 | K | 0.534 | 7.21E−01 | 4.4 |
| LYM143 | 12524.7 | O | 2.008 | 1.50E−05 | 58.2 | LYM162 | 12234.3 | K | 0.533 | 7.24E−01 | 4.2 |
| LYM148 | 12171.2 | O | 2.014 | 2.00E−05 | 58.6 | LYM174 | 12414.3 | K | 0.533 | 7.34E−01 | 4.2 |
| LYM130 | 12333.1 | O | 1.851 | 7.90E−05 | 45.8 | LYM143 | 12523.4 | K | 0.532 | 7.42E−01 | 3.9 |
| LYM10 | 11741.2 | O | 2.339 | 1.39E−04 | 84.2 | LYM14 | 12051.1 | K | 0.531 | 7.52E−01 | 3.8 |
| LYM4 | 11706.5 | O | 1.759 | 2.95E−04 | 38.5 | LYM140 | 12262.3 | K | 0.531 | 7.59E−01 | 3.8 |
| LYM102 | 12222.2 | O | 1.761 | 3.14E−04 | 38.7 | LYM24 | 12063.3 | K | 0.529 | 7.68E−01 | 3.5 |
| LYM1 | 11602.1 | O | 1.747 | 3.45E−04 | 37.5 | LYM43 | 11791.4 | K | 0.53 | 7.70E−01 | 3.7 |
| LYM105 | 12293.1 | O | 1.735 | 4.36E−04 | 36.6 | LYM148 | 12171.2 | K | 0.529 | 7.79E−01 | 3.4 |
| LYM10 | 11744.1 | O | 1.731 | 4.44E−04 | 36.3 | LYM51 | 11894.2 | K | 0.529 | 7.80E−01 | 3.5 |
| LYM162 | 12234.3 | O | 1.696 | 6.35E−04 | 33.6 | LYM174 | 12411.3 | K | 0.527 | 8.03E−01 | 3 |
| LYM140 | 12262.3 | O | 1.62 | 2.10E−03 | 27.6 | LYM153 | 12323.2 | K | 0.527 | 8.05E−01 | 3 |
| LYM132 | 12271.4 | O | 1.618 | 2.28E−03 | 27.4 | LYM268 | 12483.2 | K | 0.526 | 8.15E−01 | 2.9 |
| LYM15 | 11614.3 | O | 1.611 | 2.52E−03 | 26.9 | LYM162 | 12231.3 | K | 0.527 | 8.18E−01 | 3 |
| LYM152 | 12372.2 | O | 1.69 | 8.69E−03 | 33.1 | LYM134 | 12313.2 | K | 0.523 | 8.47E−01 | 2.3 |
| LYM1 | 11602.6 | O | 2.435 | 9.41E−03 | 91.7 | LYM137 | 12151.2 | K | 0.523 | 8.53E−01 | 2.3 |
| LYM119 | 12461.4 | O | 1.552 | 1.28E−02 | 22.2 | LYM14 | 12054.2 | K | 0.522 | 8.56E−01 | 2.1 |
| LYM132 | 12273.2 | O | 1.615 | 1.84E−02 | 27.2 | LYM132 | 12271.4 | K | 0.522 | 8.70E−01 | 2 |
| LYM130 | 12334.1 | O | 1.63 | 2.12E−02 | 28.4 | LYM26 | 11824.3 | K | 0.52 | 8.83E−01 | 1.7 |
| LYM100 | 12133.1 | O | 1.499 | 2.74E−02 | 18.1 | LYM68 | 11942.2 | K | 0.52 | 8.89E−01 | 1.6 |
| LYM289 | 12493.2 | O | 1.818 | 3.54E−02 | 43.2 | LYM134 | 12312.3 | K | 0.519 | 9.12E−01 | 1.4 |
| LYM162 | 12231.3 | O | 1.526 | 3.61E−02 | 20.2 | LYM57 | 12012.6 | K | 0.519 | 9.13E−01 | 1.4 |
| LYM119 | 12463.2 | O | 1.666 | 4.22E−02 | 31.2 | LYM68 | 11941.4 | K | 0.518 | 9.13E−01 | 1.3 |
| LYM138 | 12561.1 | O | 2.016 | 5.07E−02 | 58.8 | LYM95 | 12124.5 | K | 0.518 | 9.25E−01 | 1.2 |
| LYM17 | 11684.4 | O | 1.546 | 5.44E−02 | 21.7 | LYM100 | 12133.1 | K | 0.517 | 9.31E−01 | 1 |
| LYM1 | 11603.2 | O | 1.584 | 5.79E−02 | 24.8 | LYM119 | 12461.4 | K | 0.516 | 9.42E−01 | 1 |
| LYM141 | 12404.2 | O | 1.434 | 7.37E−02 | 13 | LYM152 | 12372.2 | K | 0.514 | 9.65E−01 | 0.5 |
| LYM19 | 11751.5 | O | 1.664 | 1.05E−01 | 31 | LYM140 | 12264.1 | K | 0.514 | 9.70E−01 | 0.5 |
| LYM268 | 12483.2 | O | 1.502 | 1.15E−01 | 18.3 | LYM57 | 12013.3 | K | 0.514 | 9.72E−01 | 0.4 |
| LYM9 | 11632.1 | O | 2.069 | 1.20E−01 | 63 | LYM137 | 12152.1 | K | 0.513 | 9.74E−01 | 0.4 |
| LYM289 | 12493.6 | O | 1.403 | 1.25E−01 | 10.5 | LYM30 | 11912.6 | K | 0.513 | 9.76E−01 | 0.4 |
| LYM1 | 11604.4 | O | 1.816 | 1.26E−01 | 43 | LYM3 | 12041.1 | K | 0.513 | 9.85E−01 | 0.3 |
| LYM148 | 12174.1 | O | 1.811 | 1.28E−01 | 42.6 | LYM119 | 12462.1 | K | 0.512 | 9.90E−01 | 0.2 |
| LYM141 | 12402.4 | O | 1.8 | 1.35E−01 | 41.8 | LYM26 | 11824.1 | K | 0.512 | 9.97E−01 | 0 |
| LYM10 | 11742.2 | O | 1.741 | 1.42E−01 | 37.1 | LYM62 | 12022.4 | K | 0.512 | 9.97E−01 | 0 |
| LYM13 | 11771.6 | O | 1.45 | 1.49E−01 | 14.2 | LYM105 | 12294.3 | K | 0.512 | 9.97E−01 | 0 |
| LYM119 | 12462.2 | O | 2.127 | 1.57E−01 | 67.5 | CONTROL | — | K | 0.511 | — | 0 |
| LYM102 | 12221.1 | O | 1.392 | 1.62E−01 | 9.6 | LYM111 | 12252.2 | L | 4.3 | 3.60E−05 | 126.4 |
| LYM19 | 11753.1 | O | 1.586 | 1.69E−01 | 24.9 | LYM148 | 12174.1 | L | 3.579 | 4.94E−04 | 88.4 |
| LYM9 | 11632.2 | O | 1.424 | 1.70E−01 | 12.1 | LYM119 | 12462.1 | L | 3.125 | 7.46E−03 | 64.5 |
| LYM174 | 12411.2 | O | 1.753 | 1.79E−01 | 38.1 | LYM100 | 12131.2 | L | 3.041 | 1.01E−02 | 60.1 |
| LYM17 | 11681.4 | O | 1.385 | 1.88E−01 | 9.1 | LYM138 | 12561.1 | L | 3.062 | 1.03E−02 | 61.2 |
| LYM15 | 11612.2 | O | 1.483 | 2.29E−01 | 16.8 | LYM43 | 11791.5 | L | 2.898 | 1.80E−02 | 52.6 |
| LYM143 | 12521.1 | O | 1.407 | 2.32E−01 | 10.8 | LYM134 | 12314.2 | L | 2.866 | 2.55E−02 | 50.9 |
| LYM19 | 11754.1 | O | 1.464 | 2.44E−01 | 15.3 | LYM138 | 12561.3 | L | 2.845 | 3.12E−02 | 49.8 |
| LYM9 | 11633.7 | O | 1.54 | 2.49E−01 | 21.3 | LYM53 | 11841.1 | L | 2.778 | 4.04E−02 | 46.2 |
| LYM138 | 12562.1 | O | 1.364 | 2.52E−01 | 7.4 | LYM268 | 12482.3 | L | 2.777 | 4.10E−02 | 46.2 |
| LYM130 | 12332.2 | O | 1.675 | 2.61E−01 | 31.9 | LYM290 | 12502.4 | L | 2.756 | 5.17E−02 | 45.1 |
| LYM119 | 12462.1 | O | 1.812 | 2.70E−01 | 42.7 | LYM143 | 12524.2 | L | 2.7 | 5.53E−02 | 42.2 |
| LYM143 | 12524.2 | O | 1.482 | 2.87E−01 | 16.7 | LYM51 | 11893.4 | L | 2.782 | 6.14E−02 | 46.4 |
| LYM174 | 12414.3 | O | 1.871 | 3.05E−01 | 47.3 | LYM137 | 12151.1 | L | 2.698 | 6.26E−02 | 42 |
| LYM138 | 12561.3 | O | 1.816 | 3.10E−01 | 43 | LYM31 | 11923.4 | L | 2.665 | 6.28E−02 | 40.3 |
| LYM113 | 12442.1 | O | 1.355 | 3.16E−01 | 6.7 | LYM143 | 12524.7 | L | 2.883 | 6.35E−02 | 51.8 |
| LYM21 | 11673.1 | O | 1.471 | 3.28E−01 | 15.9 | LYM68 | 11942.3 | L | 2.659 | 7.46E−02 | 40 |
| LYM15 | 11612.3 | O | 1.638 | 3.31E−01 | 29 | LYM119 | 12461.1 | L | 2.851 | 7.88E−02 | 50.1 |
| LYM134 | 12311.2 | O | 1.585 | 3.39E−01 | 24.8 | LYM68 | 11941.3 | L | 2.631 | 7.90E−02 | 38.5 |
| LYM141 | 12404.3 | O | 1.532 | 3.45E−01 | 20.7 | LYM148 | 12171.2 | L | 2.595 | 9.52E−02 | 36.6 |
| LYM19 | 11751.4 | O | 1.656 | 3.52E−01 | 30.4 | LYM57 | 12013.5 | L | 2.592 | 9.88E−02 | 36.4 |
| LYM2 | 11692.3 | O | 1.358 | 3.74E−01 | 7 | LYM111 | 12254.3 | L | 2.677 | 1.14E−01 | 40.9 |
| LYM129 | 12573.5 | O | 1.343 | 3.76E−01 | 5.7 | LYM69 | 11853.5 | L | 2.545 | 1.23E−01 | 34 |
| LYM4 | 11705.2 | O | 1.523 | 3.80E−01 | 19.9 | LYM30 | 11912.6 | L | 2.527 | 1.45E−01 | 33 |
| LYM162 | 12231.1 | O | 1.584 | 3.81E−01 | 24.7 | LYM140 | 12264.1 | L | 2.495 | 1.50E−01 | 31.3 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM152 | 12371.2 | O | 1.538 | 4.01E−01 | 21.1 | LYM152 | 12372.1 | L | 2.558 | 1.54E−01 | 34.6 |
| LYM15 | 11611.3 | O | 1.694 | 4.12E−01 | 33.4 | LYM68 | 11943.2 | L | 2.488 | 1.58E−01 | 31 |
| LYM21 | 11671.2 | O | 1.505 | 4.27E−01 | 18.5 | LYM43 | 11791.4 | L | 2.454 | 1.80E−01 | 29.2 |
| LYM289 | 12491.1 | O | 1.67 | 4.28E−01 | 31.5 | LYM62 | 12021.1 | L | 2.449 | 1.93E−01 | 28.9 |
| LYM289 | 12491.4 | O | 1.423 | 4.32E−01 | 12.1 | LYM53 | 11844.2 | L | 2.461 | 1.95E−01 | 29.6 |
| LYM141 | 12404.4 | O | 1.56 | 4.38E−01 | 22.9 | LYM30 | 11913.5 | L | 2.443 | 1.99E−01 | 28.6 |
| LYM162 | 12234.4 | O | 1.768 | 4.46E−01 | 39.2 | LYM137 | 12154.5 | L | 2.438 | 2.03E−01 | 28.4 |
| LYM148 | 12173.1 | O | 1.605 | 4.55E−01 | 26.4 | LYM170 | 12453.2 | L | 2.396 | 2.19E−01 | 26.2 |
| LYM290 | 12501.3 | O | 1.433 | 4.56E−01 | 12.8 | LYM119 | 12462.2 | L | 2.39 | 2.40E−01 | 25.8 |
| LYM102 | 12222.3 | O | 1.605 | 5.03E−01 | 26.4 | LYM111 | 12254.4 | L | 2.399 | 2.43E−01 | 26.3 |
| LYM174 | 12411.3 | O | 1.491 | 5.04E−01 | 17.4 | LYM172 | 12301.2 | L | 2.365 | 2.52E−01 | 24.5 |
| LYM174 | 12412.1 | O | 1.554 | 5.23E−01 | 22.4 | LYM111 | 12251.3 | L | 2.359 | 2.67E−01 | 24.2 |
| LYM268 | 12483.4 | O | 1.434 | 5.36E−01 | 13 | LYM51 | 11893.2 | L | 2.332 | 2.92E−01 | 22.8 |
| LYM111 | 12251.1 | O | 1.498 | 5.37E−01 | 18 | LYM290 | 12502.2 | L | 2.357 | 2.97E−01 | 24.1 |
| LYM21 | 11672.4 | O | 1.466 | 5.47E−01 | 15.4 | LYM105 | 12294.3 | L | 2.305 | 3.15E−01 | 21.3 |
| LYM290 | 12502.4 | O | 1.469 | 5.82E−01 | 15.7 | LYM130 | 12332.2 | L | 2.294 | 3.24E−01 | 20.8 |
| LYM10 | 11744.5 | O | 1.441 | 5.83E−01 | 13.5 | LYM68 | 11942.2 | L | 2.298 | 3.35E−01 | 21 |
| LYM13 | 11772.1 | O | 1.352 | 5.92E−01 | 6.5 | LYM268 | 12481.1 | L | 2.275 | 3.51E−01 | 19.7 |
| LYM17 | 11684.5 | O | 1.314 | 6.05E−01 | 3.5 | LYM105 | 12295.2 | L | 2.277 | 3.56E−01 | 19.9 |
| LYM17 | 11682.1 | O | 1.536 | 6.12E−01 | 20.9 | LYM130 | 12331.3 | L | 2.241 | 3.81E−01 | 18 |
| LYM268 | 12482.3 | O | 1.348 | 6.33E−01 | 6.2 | LYM148 | 12173.1 | L | 2.247 | 3.93E−01 | 18.3 |
| LYM16 | 11624.4 | O | 1.309 | 6.51E−01 | 3.1 | LYM152 | 12376.1 | L | 2.246 | 3.97E−01 | 18.2 |
| LYM105 | 12294.2 | O | 1.536 | 6.73E−01 | 21 | LYM290 | 12501.3 | L | 2.235 | 4.07E−01 | 17.7 |
| LYM17 | 11683.1 | O | 1.306 | 6.85E−01 | 2.9 | LYM57 | 12012.2 | L | 2.225 | 4.17E−01 | 17.1 |
| LYM137 | 12153.1 | O | 1.367 | 7.39E−01 | 7.7 | LYM132 | 12276.1 | L | 2.216 | 4.40E−01 | 16.6 |
| LYM111 | 12252.2 | O | 1.437 | 7.64E−01 | 13.1 | LYM14 | 12052.4 | L | 2.201 | 4.53E−01 | 15.9 |
| LYM10 | 11742.1 | O | 1.418 | 7.68E−01 | 11.7 | LYM137 | 12152.1 | L | 2.204 | 4.55E−01 | 16 |
| LYM100 | 12131.3 | O | 1.351 | 8.06E−01 | 6.4 | LYM62 | 12022.1 | L | 2.195 | 4.65E−01 | 15.5 |
| LYM174 | 12414.2 | O | 1.284 | 8.53E−01 | 1.1 | LYM100 | 12134.1 | L | 2.187 | 4.81E−01 | 15.1 |
| LYM9 | 11633.2 | O | 1.32 | 8.63E−01 | 4 | LYM26 | 11824.6 | L | 2.177 | 4.90E−01 | 14.6 |
| LYM162 | 12233.2 | O | 1.315 | 8.71E−01 | 3.6 | LYM57 | 12012.6 | L | 2.169 | 5.11E−01 | 14.2 |
| LYM148 | 12172.1 | O | 1.349 | 8.73E−01 | 6.3 | LYM53 | 11842.4 | L | 2.179 | 5.18E−01 | 14.7 |
| LYM268 | 12482.1 | O | 1.31 | 9.06E−01 | 3.2 | LYM67 | 11783.5 | L | 2.162 | 5.19E−01 | 13.8 |
| LYM140 | 12261.4 | O | 1.287 | 9.25E−01 | 1.3 | LYM132 | 12271.4 | L | 2.157 | 5.24E−01 | 13.5 |
| LYM290 | 12502.1 | O | 1.301 | 9.27E−01 | 2.5 | LYM100 | 12131.3 | L | 2.141 | 5.42E−01 | 12.7 |
| LYM1 | 11601.1 | O | 1.28 | 9.68E−01 | 0.8 | LYM152 | 12372.2 | L | 2.132 | 5.59E−01 | 12.2 |
| LYM22 | 11762.1 | O | 1.27 | 9.99E−01 | 0 | LYM138 | 12562.1 | L | 2.124 | 5.80E−01 | 11.8 |
| CONTROL | — | O | 1.27 | — | 0 | LYM43 | 11792.2 | L | 2.119 | 6.05E−01 | 11.6 |
| LYM143 | 12524.7 | P | 2.581 | 6.00E−06 | 38 | LYM51 | 11894.2 | L | 2.097 | 6.19E−01 | 10.4 |
| LYM148 | 12171.2 | P | 2.422 | 1.00E−04 | 29.5 | LYM130 | 12334.1 | L | 2.082 | 6.35E−01 | 9.6 |
| LYM148 | 12174.1 | P | 2.324 | 1.00E−04 | 24.2 | LYM43 | 11793.2 | L | 2.092 | 6.44E−01 | 10.1 |
| LYM4 | 11706.5 | P | 2.302 | 1.40E−04 | 23.1 | LYM134 | 12312.4 | L | 2.082 | 6.55E−01 | 9.6 |
| LYM10 | 11744.1 | P | 2.297 | 1.80E−04 | 22.8 | LYM14 | 12051.4 | L | 2.077 | 6.58E−01 | 9.4 |
| LYM105 | 12293.1 | P | 2.299 | 2.18E−04 | 22.9 | LYM119 | 12461.4 | L | 2.072 | 6.66E−01 | 9.1 |
| LYM10 | 11742.2 | P | 2.364 | 3.58E−04 | 26.4 | LYM132 | 12275.1 | L | 2.065 | 6.78E−01 | 8.7 |
| LYM102 | 12222.2 | P | 2.243 | 6.39E−04 | 19.9 | LYM30 | 11912.7 | L | 2.057 | 6.96E−01 | 8.3 |
| LYM132 | 12273.2 | P | 2.215 | 6.83E−04 | 18.4 | LYM162 | 12231.3 | L | 2.056 | 7.00E−01 | 8.2 |
| LYM132 | 12271.4 | P | 2.21 | 7.22E−04 | 18.2 | LYM137 | 12153.1 | L | 2.054 | 7.02E−01 | 8.1 |
| LYM130 | 12333.1 | P | 2.374 | 9.53E−04 | 26.9 | LYM254 | 12474.4 | L | 2.066 | 7.04E−01 | 8.8 |
| LYM140 | 12262.3 | P | 2.186 | 1.21E−03 | 16.9 | LYM143 | 12521.2 | L | 2.049 | 7.08E−01 | 7.8 |
| LYM1 | 11602.1 | P | 2.253 | 3.80E−03 | 20.4 | LYM100 | 12133.3 | L | 2.035 | 7.35E−01 | 7.1 |
| LYM162 | 12234.3 | P | 2.292 | 6.47E−03 | 22.6 | LYM30 | 11913.3 | L | 2.027 | 7.48E−01 | 6.7 |
| LYM130 | 12334.1 | P | 2.193 | 9.35E−03 | 17.3 | LYM68 | 11941.4 | L | 2.013 | 7.74E−01 | 6 |
| LYM19 | 11751.5 | P | 2.254 | 9.64E−03 | 20.5 | LYM152 | 12371.2 | L | 2.012 | 7.89E−01 | 5.9 |
| LYM13 | 11771.6 | P | 2.078 | 1.10E−02 | 11.1 | LYM67 | 11782.4 | L | 1.991 | 8.22E−01 | 4.8 |
| LYM289 | 12493.2 | P | 2.347 | 1.26E−02 | 25.5 | LYM26 | 11824.5 | L | 1.973 | 8.52E−01 | 3.9 |
| LYM119 | 12463.2 | P | 2.166 | 1.42E−02 | 15.8 | LYM138 | 12564.1 | L | 1.976 | 8.53E−01 | 4 |
| LYM10 | 11741.2 | P | 2.729 | 1.57E−02 | 45.9 | LYM51 | 11891.1 | L | 1.972 | 8.55E−01 | 3.8 |
| LYM102 | 12221.1 | P | 2.058 | 1.68E−02 | 10.1 | LYM152 | 12373.1 | L | 1.976 | 8.56E−01 | 4 |
| LYM152 | 12372.2 | P | 2.243 | 2.00E−02 | 20 | LYM95 | 12124.2 | L | 1.962 | 8.74E−01 | 3.3 |
| LYM17 | 11684.4 | P | 2.111 | 2.86E−02 | 12.9 | LYM268 | 12483.2 | L | 1.962 | 8.79E−01 | 3.3 |
| LYM1 | 11602.6 | P | 2.691 | 3.00E−02 | 43.9 | LYM31 | 11922.3 | L | 1.959 | 8.80E−01 | 3.1 |
| LYM141 | 12404.2 | P | 2.03 | 3.41E−02 | 8.5 | LYM172 | 12302.2 | L | 1.948 | 9.08E−01 | 2.6 |
| LYM15 | 11612.2 | P | 2.083 | 3.48E−02 | 11.4 | LYM14 | 12051.1 | L | 1.944 | 9.11E−01 | 2.4 |
| LYM143 | 12524.2 | P | 2.026 | 3.61E−02 | 8.3 | LYM69 | 11852.4 | L | 1.939 | 9.21E−01 | 2.1 |
| LYM13 | 11772.1 | P | 2.061 | 3.72E−02 | 10.2 | LYM111 | 12251.1 | L | 1.936 | 9.27E−01 | 1.9 |
| LYM143 | 12521.1 | P | 2.054 | 4.46E−02 | 9.8 | LYM66 | 11954.4 | L | 1.922 | 9.59E−01 | 1.2 |
| LYM100 | 12133.1 | P | 2.12 | 4.61E−02 | 13.4 | LYM105 | 12297.1 | L | 1.912 | 9.76E−01 | 0.6 |
| LYM16 | 11624.4 | P | 2.014 | 4.89E−02 | 7.7 | LYM140 | 12262.3 | L | 1.906 | 9.87E−01 | 0.3 |
| LYM17 | 11681.4 | P | 2.019 | 5.10E−02 | 8 | LYM290 | 12502.1 | L | 1.906 | 9.88E−01 | 0.3 |
| LYM19 | 11753.1 | P | 2.149 | 5.24E−02 | 14.9 | CONTROL | — | L | 1.9 | — | 0 |
| LYM138 | 12562.1 | P | 2.008 | 6.33E−02 | 7.3 | LYM111 | 12252.2 | M | 0.537 | 2.20E−05 | 121 |
| LYM1 | 11603.2 | P | 2.096 | 8.89E−02 | 12.1 | LYM148 | 12174.1 | M | 0.447 | 3.03E−04 | 84 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM9 | 11632.1 | P | 2.655 | 9.51E−02 | 42 | LYM119 | 12462.1 | M | 0.391 | 5.76E−03 | 60.6 |
| LYM119 | 12461.4 | P | 2.172 | 9.96E−02 | 16.1 | LYM100 | 12131.2 | M | 0.38 | 7.86E−03 | 56.3 |
| LYM129 | 12573.5 | P | 1.989 | 1.00E−01 | 6.3 | LYM138 | 12561.1 | M | 0.383 | 8.16E−03 | 57.4 |
| LYM19 | 11754.1 | P | 2.125 | 1.17E−01 | 13.6 | LYM43 | 11791.5 | M | 0.362 | 1.43E−02 | 49 |
| LYM174 | 12411.2 | P | 2.287 | 1.23E−01 | 22.3 | LYM134 | 12314.2 | M | 0.358 | 2.14E−02 | 47.3 |
| LYM113 | 12442.1 | P | 2.054 | 1.24E−01 | 9.8 | LYM138 | 12561.3 | M | 0.356 | 2.71E−02 | 46.2 |
| LYM141 | 12402.4 | P | 2.33 | 1.29E−01 | 24.6 | LYM119 | 12461.1 | M | 0.373 | 3.52E−02 | 53.4 |
| LYM15 | 11614.3 | P | 2.232 | 1.30E−01 | 19.4 | LYM53 | 11841.1 | M | 0.347 | 3.56E−02 | 42.8 |
| LYM289 | 12493.6 | P | 2.051 | 1.31E−01 | 9.7 | LYM268 | 12482.3 | M | 0.347 | 3.61E−02 | 42.7 |
| LYM9 | 11632.2 | P | 2.113 | 1.36E−01 | 13 | LYM290 | 12502.4 | M | 0.344 | 4.73E−02 | 41.6 |
| LYM138 | 12561.1 | P | 2.47 | 1.39E−01 | 32 | LYM143 | 12524.2 | M | 0.338 | 4.96E−02 | 38.8 |
| LYM119 | 12462.2 | P | 2.519 | 1.48E−01 | 34.7 | LYM31 | 11923.4 | M | 0.333 | 5.67E−02 | 37 |
| LYM9 | 11633.7 | P | 2.102 | 1.55E−01 | 12.4 | LYM137 | 12151.1 | M | 0.337 | 5.76E−02 | 38.7 |
| LYM162 | 12231.1 | P | 2.163 | 1.88E−01 | 15.6 | LYM51 | 11893.4 | M | 0.348 | 5.87E−02 | 43 |
| LYM162 | 12231.3 | P | 2.128 | 1.99E−01 | 13.8 | LYM143 | 12524.7 | M | 0.36 | 6.28E−02 | 48.2 |
| LYM4 | 11705.2 | P | 2.127 | 2.10E−01 | 13.8 | LYM68 | 11942.3 | M | 0.332 | 6.98E−02 | 36.7 |
| LYM141 | 12404.3 | P | 2.098 | 2.18E−01 | 12.2 | LYM68 | 11941.3 | M | 0.329 | 7.35E−02 | 35.2 |
| LYM174 | 12414.3 | P | 2.424 | 2.25E−01 | 29.6 | LYM148 | 12171.2 | M | 0.324 | 9.03E−02 | 33.4 |
| LYM1 | 11604.4 | P | 2.316 | 2.37E−01 | 23.8 | LYM57 | 12013.5 | M | 0.324 | 9.44E−02 | 33.2 |
| LYM19 | 11751.4 | P | 2.199 | 2.40E−01 | 17.6 | LYM170 | 12453.2 | M | 0.321 | 9.97E−02 | 31.9 |
| LYM289 | 12491.4 | P | 2.033 | 2.41E−01 | 8.7 | LYM111 | 12254.3 | M | 0.335 | 1.15E−01 | 37.6 |
| LYM138 | 12561.3 | P | 2.306 | 2.48E−01 | 23.3 | LYM69 | 11853.5 | M | 0.318 | 1.20E−01 | 30.8 |
| LYM134 | 12311.2 | P | 2.178 | 2.62E−01 | 16.5 | LYM30 | 11912.6 | M | 0.316 | 1.45E−01 | 29.9 |
| LYM130 | 12332.2 | P | 2.28 | 2.65E−01 | 21.9 | LYM140 | 12264.1 | M | 0.312 | 1.48E−01 | 28.2 |
| LYM21 | 11673.1 | P | 2.114 | 2.76E−01 | 13 | LYM152 | 12372.1 | M | 0.32 | 1.56E−01 | 31.5 |
| LYM152 | 12371.2 | P | 2.127 | 2.84E−01 | 13.7 | LYM68 | 11943.2 | M | 0.311 | 1.58E−01 | 27.9 |
| LYM119 | 12462.1 | P | 2.281 | 3.03E−01 | 21.9 | LYM43 | 11791.4 | M | 0.307 | 1.81E−01 | 26.1 |
| LYM268 | 12483.2 | P | 2.121 | 3.07E−01 | 13.4 | LYM62 | 12021.1 | M | 0.306 | 1.96E−01 | 25.9 |
| LYM174 | 12414.2 | P | 2.016 | 3.46E−01 | 7.8 | LYM53 | 11844.2 | M | 0.308 | 1.99E−01 | 26.5 |
| LYM174 | 12411.3 | P | 2.151 | 3.50E−01 | 15 | LYM30 | 11913.5 | M | 0.305 | 2.03E−01 | 25.6 |
| LYM15 | 11612.3 | P | 2.187 | 3.58E−01 | 16.9 | LYM137 | 12154.5 | M | 0.305 | 2.08E−01 | 25.3 |
| LYM174 | 12412.1 | P | 2.155 | 3.66E−01 | 15.2 | LYM119 | 12462.2 | M | 0.299 | 2.48E−01 | 22.9 |
| LYM148 | 12173.1 | P | 2.153 | 3.73E−01 | 15.1 | LYM111 | 12254.4 | M | 0.3 | 2.52E−01 | 23.3 |
| LYM141 | 12404.4 | P | 2.158 | 3.80E−01 | 15.4 | LYM172 | 12301.2 | M | 0.296 | 2.60E−01 | 21.6 |
| LYM290 | 12501.3 | P | 2.125 | 3.82E−01 | 13.6 | LYM132 | 12276.1 | M | 0.295 | 2.66E−01 | 21.5 |
| LYM162 | 12234.4 | P | 2.296 | 4.09E−01 | 22.8 | LYM111 | 12251.3 | M | 0.295 | 2.78E−01 | 21.2 |
| LYM111 | 12251.1 | P | 2.098 | 4.17E−01 | 12.2 | LYM51 | 11893.2 | M | 0.291 | 3.06E−01 | 19.9 |
| LYM15 | 11611.3 | P | 2.214 | 4.19E−01 | 18.4 | LYM290 | 12502.2 | M | 0.295 | 3.12E−01 | 21.2 |
| LYM22 | 11762.1 | P | 1.921 | 4.32E−01 | 2.7 | LYM67 | 11783.5 | M | 0.292 | 3.23E−01 | 20 |
| LYM132 | 12275.1 | P | 1.957 | 4.42E−01 | 4.7 | LYM105 | 12294.3 | M | 0.288 | 3.31E−01 | 18.5 |
| LYM21 | 11671.2 | P | 2.079 | 4.44E−01 | 11.1 | LYM130 | 12332.2 | M | 0.287 | 3.41E−01 | 17.9 |
| LYM17 | 11684.5 | P | 1.918 | 4.53E−01 | 2.6 | LYM68 | 11942.2 | M | 0.287 | 3.54E−01 | 18.1 |
| LYM2 | 11692.3 | P | 1.918 | 4.54E−01 | 2.6 | LYM268 | 12481.1 | M | 0.284 | 3.71E−01 | 16.9 |
| LYM137 | 12153.1 | P | 2.033 | 4.60E−01 | 8.7 | LYM105 | 12295.2 | M | 0.285 | 3.77E−01 | 17 |
| LYM102 | 12222.3 | P | 2.206 | 4.62E−01 | 18 | LYM130 | 12331.3 | M | 0.28 | 4.04E−01 | 15.2 |
| LYM17 | 11683.1 | P | 1.936 | 4.85E−01 | 3.5 | LYM148 | 12173.1 | M | 0.281 | 4.20E−01 | 15.5 |
| LYM289 | 12491.1 | P | 2.168 | 5.00E−01 | 15.9 | LYM152 | 12376.1 | M | 0.281 | 4.24E−01 | 15.4 |
| LYM10 | 11744.5 | P | 2.06 | 5.04E−01 | 10.1 | LYM290 | 12501.3 | M | 0.279 | 4.35E−01 | 14.9 |
| LYM1 | 11601.1 | P | 2.075 | 5.18E−01 | 10.9 | LYM57 | 12012.2 | M | 0.278 | 4.46E−01 | 14.4 |
| LYM268 | 12483.4 | P | 2.049 | 5.28E−01 | 9.5 | LYM14 | 12052.4 | M | 0.275 | 4.87E−01 | 13.1 |
| LYM17 | 11682.1 | P | 2.154 | 5.33E−01 | 15.2 | LYM137 | 12152.1 | M | 0.276 | 4.89E−01 | 13.3 |
| LYM21 | 11672.4 | P | 2.071 | 5.40E−01 | 10.7 | LYM62 | 12022.1 | M | 0.274 | 5.01E−01 | 12.8 |
| LYM111 | 12254.4 | P | 1.929 | 5.68E−01 | 3.2 | LYM137 | 12153.1 | M | 0.275 | 5.04E−01 | 13.1 |
| LYM13 | 11771.9 | P | 1.974 | 5.76E−01 | 5.5 | LYM100 | 12134.1 | M | 0.273 | 5.19E−01 | 12.4 |
| LYM268 | 12482.3 | P | 1.974 | 5.94E−01 | 5.5 | LYM26 | 11824.6 | M | 0.272 | 5.29E−01 | 11.9 |
| LYM2 | 11693.3 | P | 1.929 | 5.99E−01 | 3.1 | LYM57 | 12012.6 | M | 0.271 | 5.53E−01 | 11.5 |
| LYM290 | 12502.4 | P | 2.025 | 6.17E−01 | 8.3 | LYM53 | 11842.4 | M | 0.272 | 5.60E−01 | 12 |
| LYM140 | 12261.4 | P | 1.947 | 6.59E−01 | 4.1 | LYM132 | 12271.4 | M | 0.27 | 5.68E−01 | 10.8 |
| LYM268 | 12482.1 | P | 1.969 | 6.73E−01 | 5.3 | LYM68 | 11941.4 | M | 0.269 | 5.74E−01 | 10.5 |
| LYM148 | 12172.1 | P | 2.069 | 6.76E−01 | 10.6 | LYM100 | 12131.3 | M | 0.268 | 5.89E−01 | 10.1 |
| LYM10 | 11742.1 | P | 1.999 | 6.93E−01 | 6.9 | LYM152 | 12372.2 | M | 0.266 | 6.09E−01 | 9.6 |
| LYM19 | 11752.2 | P | 1.954 | 6.98E−01 | 4.5 | LYM138 | 12562.1 | M | 0.266 | 6.32E−01 | 9.2 |
| LYM143 | 12521.2 | P | 1.911 | 7.08E−01 | 2.2 | LYM43 | 11792.2 | M | 0.265 | 6.58E−01 | 8.9 |
| LYM105 | 12294.2 | P | 2.025 | 7.30E−01 | 8.3 | LYM51 | 11894.2 | M | 0.262 | 6.76E−01 | 7.8 |
| LYM111 | 12252.2 | P | 2 | 7.59E−01 | 6.9 | LYM130 | 12334.1 | M | 0.26 | 6.96E−01 | 7 |
| LYM100 | 12131.3 | P | 1.94 | 7.90E−01 | 3.7 | LYM43 | 11793.2 | M | 0.262 | 7.03E−01 | 7.5 |
| LYM153 | 12323.2 | P | 1.893 | 7.92E−01 | 1.2 | LYM134 | 12312.4 | M | 0.26 | 7.16E−01 | 7 |
| LYM162 | 12233.2 | P | 1.927 | 7.99E−01 | 3 | LYM14 | 12051.4 | M | 0.26 | 7.20E−01 | 6.8 |
| LYM143 | 12523.4 | P | 1.91 | 8.45E−01 | 2.1 | LYM119 | 12461.4 | M | 0.259 | 7.29E−01 | 6.5 |
| LYM2 | 11695.3 | P | 1.885 | 8.49E−01 | 0.8 | LYM132 | 12275.1 | M | 0.258 | 7.43E−01 | 6.1 |
| LYM153 | 12321.2 | P | 1.915 | 8.77E−01 | 2.4 | LYM30 | 11912.7 | M | 0.257 | 7.63E−01 | 5.7 |
| LYM9 | 11633.2 | P | 1.913 | 8.81E−01 | 2.3 | LYM254 | 12474.4 | M | 0.258 | 7.67E−01 | 6.2 |
| LYM130 | 12331.3 | P | 1.886 | 9.18E−01 | 0.9 | LYM162 | 12231.3 | M | 0.257 | 7.67E−01 | 5.7 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM132 | 12275.3 | P | 1.908 | 9.31E−01 | 2 | LYM143 | 12521.2 | M | 0.256 | 7.77E−01 | 5.3 |
| LYM102 | 12222.6 | P | 1.882 | 9.74E−01 | 0.6 | LYM268 | 12482.1 | M | 0.257 | 7.87E−01 | 5.7 |
| LYM290 | 12502.1 | P | 1.871 | 9.99E−01 | 0 | LYM100 | 12133.3 | M | 0.254 | 8.07E−01 | 4.6 |
| CONTROL | — | P | 1.87 | — | 0 | LYM69 | 11854.2 | M | 0.254 | 8.16E−01 | 4.4 |
| LYM103 | 12713.5 | A | 95.446 | 6.40E−05 | 3.7 | LYM153 | 12321.2 | M | 0.254 | 8.20E−01 | 4.4 |
| LYM20 | 11711.2 | A | 94.199 | 1.22E−03 | 2.3 | LYM30 | 11913.3 | M | 0.253 | 8.23E−01 | 4.2 |
| LYM51 | 11891.1 | A | 93.981 | 1.89E−03 | 2.1 | LYM152 | 12371.2 | M | 0.252 | 8.64E−01 | 3.4 |
| LYM110 | 12921.7 | A | 94.061 | 1.99E−03 | 2.2 | LYM67 | 11782.4 | M | 0.249 | 9.03E−01 | 2.3 |
| LYM30 | 11913.3 | A | 93.936 | 2.18E−03 | 2.1 | LYM138 | 12564.1 | M | 0.247 | 9.36E−01 | 1.6 |
| LYM31 | 11924.4 | A | 93.865 | 2.88E−03 | 2 | LYM152 | 12373.1 | M | 0.247 | 9.38E−01 | 1.6 |
| LYM56 | 13111.5 | A | 93.843 | 2.90E−03 | 2 | LYM26 | 11824.5 | M | 0.247 | 9.39E−01 | 1.4 |
| LYM82 | 12204.2 | A | 93.824 | 3.63E−03 | 1.9 | LYM51 | 11891.1 | M | 0.246 | 9.42E−01 | 1.3 |
| LYM95 | 12121.2 | A | 94.294 | 3.66E−03 | 2.4 | LYM95 | 12124.4 | M | 0.245 | 9.64E−01 | 0.8 |
| LYM30 | 11913.4 | A | 94.532 | 5.55E−03 | 2.7 | LYM268 | 12483.2 | M | 0.245 | 9.65E−01 | 0.9 |
| LYM145 | 12951.9 | A | 93.612 | 6.11E−03 | 1.7 | LYM31 | 11922.3 | M | 0.245 | 9.70E−01 | 0.7 |
| LYM95 | 12124.6 | A | 93.599 | 6.49E−03 | 1.7 | LYM172 | 12302.2 | M | 0.244 | 9.95E−01 | 0.1 |
| LYM128 | 12641.3 | A | 93.573 | 6.95E−03 | 1.7 | CONTROL | — | M | 0.243 | — | 0 |
| LYM41 | 11834.2 | A | 93.777 | 7.60E−03 | 1.9 | LYM111 | 12252.2 | N | 0.365 | 8.67E−04 | 57.1 |
| LYM43 | 11791.5 | A | 94.166 | 8.49E−03 | 2.3 | LYM148 | 12174.1 | N | 0.312 | 1.65E−02 | 34.3 |
| LYM66 | 11954.4 | A | 93.658 | 1.06E−02 | 1.7 | LYM69 | 11853.5 | N | 0.295 | 5.60E−02 | 27 |
| LYM14 | 12051.4 | A | 93.406 | 1.22E−02 | 1.5 | LYM138 | 12561.1 | N | 0.296 | 6.19E−02 | 27.2 |
| LYM116 | 13202.12 | A | 93.753 | 1.48E−02 | 1.9 | LYM119 | 12462.1 | N | 0.29 | 8.42E−02 | 24.7 |
| LYM271 | 12721.9 | A | 93.459 | 1.61E−02 | 1.5 | LYM100 | 12131.2 | N | 0.288 | 8.55E−02 | 23.7 |
| LYM145 | 12954.8 | A | 93.311 | 1.71E−02 | 1.4 | LYM143 | 12524.2 | N | 0.286 | 9.40E−02 | 22.8 |
| LYM41 | 11832.2 | A | 93.279 | 1.90E−02 | 1.3 | LYM68 | 11941.3 | N | 0.281 | 1.21E−01 | 21 |
| LYM26 | 11821.2 | A | 93.294 | 2.17E−02 | 1.4 | LYM119 | 12461.2 | N | 0.295 | 1.24E−01 | 26.9 |
| LYM53 | 11841.1 | A | 93.675 | 2.30E−02 | 1.8 | LYM67 | 11783.5 | N | 0.283 | 1.38E−01 | 21.6 |
| LYM271 | 12724.7 | A | 93.539 | 2.83E−02 | 1.6 | LYM134 | 12314.2 | N | 0.277 | 1.56E−01 | 18.9 |
| LYM232 | 13024.7 | A | 93.305 | 2.83E−02 | 1.4 | LYM138 | 12561.3 | N | 0.278 | 1.57E−01 | 19.4 |
| LYM271 | 12723.2 | A | 93.162 | 3.14E−02 | 1.2 | LYM31 | 11923.4 | N | 0.277 | 1.57E−01 | 19 |
| LYM67 | 11782.6 | A | 94.335 | 3.97E−02 | 2.5 | LYM290 | 12502.4 | N | 0.277 | 1.64E−01 | 19 |
| LYM110 | 12923.8 | A | 94.014 | 4.09E−02 | 2.1 | LYM57 | 12013.5 | N | 0.276 | 1.67E−01 | 18.7 |
| LYM156 | 12961.7 | A | 93.781 | 4.22E−02 | 1.9 | LYM268 | 12482.3 | N | 0.276 | 1.68E−01 | 18.8 |
| LYM88 | 12191.1 | A | 93.438 | 4.39E−02 | 1.5 | LYM53 | 11841.1 | N | 0.276 | 1.75E−01 | 18.7 |
| LYM232 | 13024.6 | A | 93.09 | 4.49E−02 | 1.1 | LYM62 | 12021.1 | N | 0.275 | 2.00E−01 | 18.4 |
| LYM239 | 13044.8 | A | 93.069 | 4.51E−02 | 1.1 | LYM143 | 12524.7 | N | 0.28 | 2.15E−01 | 20.4 |
| LYM239 | 13042.9 | A | 94.242 | 5.48E−02 | 2.4 | LYM30 | 11913.5 | N | 0.273 | 2.18E−01 | 17.4 |
| LYM103 | 12712.8 | A | 93.697 | 7.12E−02 | 1.8 | LYM53 | 11844.2 | N | 0.272 | 2.53E−01 | 16.7 |
| LYM67 | 11782.5 | A | 93.31 | 7.48E−02 | 1.4 | LYM51 | 11893.4 | N | 0.272 | 2.62E−01 | 16.8 |
| LYM26 | 11824.5 | A | 93.23 | 9.64E−02 | 1.3 | LYM30 | 11912.6 | N | 0.268 | 2.72E−01 | 15.1 |
| LYM24 | 12064.1 | A | 92.977 | 1.09E−01 | 1 | LYM68 | 11942.3 | N | 0.267 | 2.76E−01 | 15 |
| LYM24 | 12061.4 | A | 93.587 | 1.10E−01 | 1.7 | LYM170 | 12453.2 | N | 0.264 | 3.05E−01 | 13.5 |
| LYM26 | 11824.6 | A | 93.626 | 1.16E−01 | 1.7 | LYM26 | 11943.2 | N | 0.265 | 3.08E−01 | 14 |
| LYM285 | 12733.9 | A | 93.476 | 1.19E−01 | 1.6 | LYM111 | 12254.3 | N | 0.271 | 3.36E−01 | 16.4 |
| LYM99 | 12243.2 | A | 93.227 | 1.26E−01 | 1.3 | LYM137 | 12151.1 | N | 0.261 | 3.59E−01 | 12.4 |
| LYM66 | 11952.2 | A | 92.747 | 1.33E−01 | 0.8 | LYM140 | 12264.1 | N | 0.26 | 3.88E−01 | 11.6 |
| LYM82 | 12201.5 | A | 93.006 | 1.35E−01 | 1 | LYM152 | 12372.1 | N | 0.264 | 3.92E−01 | 13.5 |
| LYM95 | 12124.4 | A | 93.598 | 1.41E−01 | 1.7 | LYM43 | 11791.5 | N | 0.258 | 4.06E−01 | 11 |
| LYM26 | 11824.1 | A | 94.062 | 1.54E−01 | 2.2 | LYM137 | 12154.5 | N | 0.258 | 4.09E−01 | 11 |
| LYM53 | 11844.2 | A | 92.949 | 1.58E−01 | 1 | LYM290 | 12502.2 | N | 0.258 | 4.41E−01 | 10.8 |
| LYM238 | 12762.8 | A | 92.661 | 1.75E−01 | 0.7 | LYM111 | 12251.3 | N | 0.257 | 4.46E−01 | 10.7 |
| LYM57 | 12013.3 | A | 93.063 | 1.82E−01 | 1.1 | LYM105 | 12295.2 | N | 0.256 | 4.60E−01 | 10.1 |
| LYM125 | 12934.5 | A | 94.064 | 1.92E−01 | 2.2 | LYM111 | 12254.4 | N | 0.255 | 4.96E−01 | 9.7 |
| LYM128 | 12641.5 | A | 93.644 | 1.94E−01 | 1.7 | LYM268 | 12481.1 | N | 0.253 | 5.27E−01 | 8.6 |
| LYM51 | 11894.2 | A | 92.955 | 1.98E−01 | 1 | LYM51 | 11893.2 | N | 0.251 | 5.42E−01 | 8 |
| LYM66 | 11955.2 | A | 93.658 | 2.03E−01 | 1.7 | LYM51 | 11891.1 | N | 0.251 | 5.54E−01 | 7.9 |
| LYM238 | 12763.5 | A | 93.475 | 2.13E−01 | 1.6 | LYM68 | 11942.2 | N | 0.251 | 5.61E−01 | 8.1 |
| LYM20 | 11712.2 | A | 92.972 | 2.19E−01 | 1 | LYM172 | 12301.2 | N | 0.25 | 5.79E−01 | 7.6 |
| LYM145 | 12953.5 | A | 93.925 | 2.34E−01 | 2 | LYM137 | 12153.1 | N | 0.249 | 5.93E−01 | 7.3 |
| LYM53 | 11843.2 | A | 92.9 | 2.43E−01 | 0.9 | LYM138 | 12562.1 | N | 0.249 | 6.03E−01 | 6.9 |
| LYM125 | 12932.8 | A | 97.238 | 2.56E−01 | 5.6 | LYM43 | 11791.4 | N | 0.249 | 6.08E−01 | 6.9 |
| LYM284 | 12883.5 | A | 95.309 | 2.58E−01 | 3.5 | LYM105 | 12294.3 | N | 0.248 | 6.13E−01 | 6.7 |
| LYM41 | 11831.5 | A | 93.347 | 2.68E−01 | 1.4 | LYM148 | 12171.2 | N | 0.248 | 6.13E−01 | 6.7 |
| LYM284 | 12884.2 | A | 93.492 | 2.80E−01 | 1.6 | LYM100 | 12131.3 | N | 0.248 | 6.13E−01 | 6.6 |
| LYM125 | 12934.7 | A | 92.535 | 2.81E−01 | 0.5 | LYM62 | 12022.1 | N | 0.247 | 6.26E−01 | 6.4 |
| LYM26 | 11824.3 | A | 94.293 | 2.82E−01 | 2.4 | LYM132 | 12276.1 | N | 0.249 | 6.26E−01 | 6.9 |
| LYM277 | 13104.9 | A | 94.232 | 3.03E−01 | 2.4 | LYM130 | 12331.3 | N | 0.247 | 6.36E−01 | 6.1 |
| LYM156 | 12963.4 | A | 93.322 | 3.23E−01 | 1.4 | LYM26 | 11824.6 | N | 0.248 | 6.42E−01 | 6.5 |
| LYM277 | 13101.1 | A | 93.457 | 3.32E−01 | 1.5 | LYM14 | 12052.4 | N | 0.245 | 6.80E−01 | 5.5 |
| LYM277 | 13105.7 | A | 93.165 | 3.34E−01 | 1.2 | LYM152 | 12376.1 | N | 0.246 | 6.82E−01 | 5.6 |
| LYM88 | 12194.2 | A | 92.773 | 3.50E−01 | 0.8 | LYM43 | 11792.2 | N | 0.246 | 6.97E−01 | 5.7 |
| LYM30 | 11912.7 | A | 93.371 | 3.68E−01 | 1.4 | LYM100 | 12134.1 | N | 0.245 | 7.03E−01 | 5.3 |
| LYM103 | 12712.5 | A | 94.013 | 3.80E−01 | 2.1 | LYM57 | 12012.2 | N | 0.244 | 7.15E−01 | 4.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM116 | 13204.4 | A | 92.411 | 4.06E−01 | 0.4 | LYM105 | 12297.1 | N | 0.243 | 7.31E−01 | 4.7 |
| LYM99 | 12244.1 | A | 92.873 | 4.11E−01 | 0.9 | LYM137 | 12152.1 | N | 0.242 | 7.68E−01 | 3.9 |
| LYM57 | 12013.5 | A | 92.867 | 4.13E−01 | 0.9 | LYM152 | 12372.2 | N | 0.242 | 7.69E−01 | 3.9 |
| LYM128 | 12641.1 | A | 92.436 | 4.13E−01 | 0.4 | LYM100 | 12133.3 | N | 0.241 | 7.86E−01 | 3.6 |
| LYM110 | 12924.5 | A | 93.592 | 4.13E−01 | 1.7 | LYM119 | 12462.2 | N | 0.241 | 7.88E−01 | 3.7 |
| LYM66 | 11953.6 | A | 93.538 | 4.18E−01 | 1.6 | LYM24 | 12061.2 | N | 0.241 | 7.97E−01 | 3.6 |
| LYM57 | 12012.2 | A | 92.705 | 4.22E−01 | 0.7 | LYM143 | 12521.2 | N | 0.24 | 8.16E−01 | 3.1 |
| LYM145 | 12952.9 | A | 92.482 | 4.55E−01 | 0.5 | LYM148 | 12173.1 | N | 0.24 | 8.22E−01 | 3 |
| LYM99 | 12241.1 | A | 93.281 | 4.58E−01 | 1.3 | LYM69 | 11854.2 | N | 0.239 | 8.47E−01 | 2.5 |
| LYM156 | 12961.9 | A | 93.723 | 4.82E−01 | 1.8 | LYM14 | 12051.4 | N | 0.237 | 8.82E−01 | 2 |
| LYM56 | 13112.7 | A | 93.781 | 4.85E−01 | 1.9 | LYM132 | 12271.4 | N | 0.237 | 8.82E−01 | 2 |
| LYM82 | 12201.1 | A | 92.948 | 5.15E−01 | 1 | LYM290 | 12501.3 | N | 0.237 | 8.83E−01 | 2 |
| LYM116 | 13202.7 | A | 92.951 | 5.22E−01 | 1 | LYM268 | 12482.1 | N | 0.238 | 8.83E−01 | 2.3 |
| LYM239 | 13041.7 | A | 92.482 | 5.31E−01 | 0.5 | LYM152 | 12373.1 | N | 0.237 | 9.00E−01 | 1.9 |
| LYM284 | 12884.6 | A | 92.958 | 5.74E−01 | 1 | LYM254 | 12474.4 | N | 0.237 | 9.03E−01 | 1.9 |
| LYM56 | 13112.5 | A | 93.518 | 5.79E−01 | 1.6 | LYM68 | 11941.4 | N | 0.236 | 9.24E−01 | 1.3 |
| LYM156 | 12963.3 | A | 92.931 | 5.88E−01 | 1 | LYM130 | 12334.1 | N | 0.235 | 9.24E−01 | 1.2 |
| LYM51 | 11893.4 | A | 92.963 | 5.94E−01 | 1 | LYM111 | 12251.1 | N | 0.235 | 9.41E−01 | 1 |
| LYM121 | 13211.8 | A | 92.858 | 6.05E−01 | 0.9 | LYM14 | 12052.5 | N | 0.235 | 9.44E−01 | 0.9 |
| LYM110 | 12923.5 | A | 92.576 | 6.26E−01 | 0.6 | LYM66 | 11954.4 | N | 0.235 | 9.46E−01 | 1.1 |
| LYM67 | 11782.4 | A | 92.533 | 6.33E−01 | 0.5 | LYM140 | 12261.1 | N | 0.234 | 9.57E−01 | 0.8 |
| LYM12 | 11871.1 | A | 92.319 | 6.34E−01 | 0.3 | LYM152 | 12371.2 | N | 0.234 | 9.76E−01 | 0.4 |
| LYM103 | 12713.7 | A | 93.46 | 6.35E−01 | 1.5 | CONTROL | — | N | 0.233 | — | 0 |
| LYM62 | 12022.4 | A | 93.315 | 6.56E−01 | 1.4 | LYM134 | 12314.2 | O | 2.877 | 1.57E−04 | 44.9 |
| LYM43 | 11793.2 | A | 92.84 | 6.72E−01 | 0.9 | LYM268 | 12482.3 | O | 2.827 | 2.54E−04 | 42.3 |
| LYM69 | 11852.4 | A | 92.347 | 6.74E−01 | 0.3 | LYM138 | 12561.1 | O | 3.132 | 7.56E−04 | 57.7 |
| LYM31 | 11923.1 | A | 93.048 | 6.91E−01 | 1.1 | LYM43 | 11791.5 | O | 2.978 | 3.01E−03 | 49.9 |
| LYM99 | 12244.2 | A | 92.212 | 7.08E−01 | 0.2 | LYM100 | 12131.2 | O | 3.097 | 5.61E−03 | 55.9 |
| LYM95 | 12121.4 | A | 92.376 | 7.27E−01 | 0.4 | LYM170 | 12453.2 | O | 2.589 | 6.69E−03 | 30.3 |
| LYM43 | 11792.2 | A | 92.62 | 7.34E−01 | 0.6 | LYM140 | 12264.1 | O | 2.557 | 7.02E−03 | 28.7 |
| LYM14 | 12052.4 | A | 92.727 | 7.41E−01 | 0.7 | LYM57 | 12013.5 | O | 2.672 | 1.45E−02 | 34.6 |
| LYM66 | 11953.1 | A | 92.666 | 7.44E−01 | 0.7 | LYM68 | 11942.3 | O | 2.737 | 1.48E−02 | 37.8 |
| LYM12 | 11872.1 | A | 92.724 | 7.81E−01 | 0.7 | LYM143 | 12524.2 | O | 2.755 | 1.94E−02 | 38.7 |
| LYM238 | 12764.8 | A | 92.236 | 7.83E−01 | 0.2 | LYM148 | 12174.1 | O | 3.67 | 2.35E−02 | 84.8 |
| LYM116 | 13201.8 | A | 92.484 | 7.84E−01 | 0.5 | LYM31 | 11923.4 | O | 2.751 | 2.44E−02 | 38.5 |
| LYM82 | 12203.3 | A | 92.175 | 8.22E−01 | 0.1 | LYM130 | 12331.3 | O | 2.363 | 2.49E−02 | 19 |
| LYM238 | 12761.6 | A | 92.222 | 8.23E−01 | 0.2 | LYM69 | 11853.5 | O | 2.572 | 4.76E−02 | 29.5 |
| LYM67 | 11781.5 | A | 92.622 | 8.43E−01 | 0.6 | LYM290 | 12502.4 | O | 2.809 | 5.25E−02 | 41.4 |
| LYM232 | 13024.4 | A | 92.931 | 8.45E−01 | 1 | LYM137 | 12151.1 | O | 2.72 | 5.81E−02 | 37 |
| LYM67 | 11783.5 | A | 92.182 | 8.54E−01 | 0.1 | LYM57 | 12012.2 | O | 2.266 | 6.86E−02 | 14.1 |
| LYM88 | 12193.1 | A | 92.108 | 8.99E−01 | 0.1 | LYM51 | 11893.2 | O | 2.359 | 7.59E−02 | 18.8 |
| LYM20 | 11716.3 | A | 92.257 | 9.05E−01 | 0.2 | LYM53 | 11841.1 | O | 2.817 | 7.71E−02 | 41.9 |
| LYM121 | 13214.3 | A | 92.309 | 9.05E−01 | 0.3 | LYM14 | 12052.4 | O | 2.264 | 8.31E−02 | 14 |
| LYM232 | 13022.1 | A | 92.236 | 9.28E−01 | 0.2 | LYM132 | 12276.1 | O | 2.274 | 9.43E−02 | 14.5 |
| LYM31 | 11921.3 | A | 92.086 | 9.31E−01 | 0 | LYM138 | 12561.3 | O | 2.884 | 9.53E−02 | 45.2 |
| LYM271 | 12721.8 | A | 92.21 | 9.39E−01 | 0.2 | LYM148 | 12171.2 | O | 2.638 | 1.02E−01 | 32.8 |
| LYM99 | 12243.1 | A | 92.142 | 9.40E−01 | 0.1 | LYM68 | 11941.4 | O | 2.223 | 1.03E−01 | 11.9 |
| LYM88 | 12193.5 | A | 92.179 | 9.49E−01 | 0.1 | LYM119 | 12462.1 | O | 3.201 | 1.06E−01 | 61.2 |
| LYM121 | 13211.6 | A | 92.125 | 9.70E−01 | 0.1 | LYM119 | 12462.2 | O | 2.481 | 1.06E−01 | 24.9 |
| LYM69 | 11853.5 | A | 92.063 | 9.73E−01 | 0 | LYM137 | 12152.1 | O | 2.226 | 1.08E−01 | 12.1 |
| LYM284 | 12882.5 | A | 92.091 | 9.89E−01 | 0 | LYM68 | 11941.3 | O | 2.673 | 1.27E−01 | 34.6 |
| LYM125 | 12931.5 | A | 92.065 | 9.94E−01 | 0 | LYM43 | 11791.4 | O | 2.52 | 1.37E−01 | 26.9 |
| CONTROL | — | A | 92.048 | — | 0 | LYM111 | 12252.2 | O | 4.449 | 1.69E−01 | 124 |
| LYM95 | 12124.4 | B | 0.391 | 1.15E−01 | 8.6 | LYM130 | 12334.1 | O | 2.179 | 1.70E−01 | 9.7 |
| LYM69 | 11852.2 | B | 0.388 | 1.69E−01 | 7.7 | LYM105 | 12294.3 | O | 2.35 | 1.77E−01 | 18.3 |
| LYM51 | 11891.1 | B | 0.421 | 3.86E−01 | 16.9 | LYM30 | 11913.5 | O | 2.495 | 2.05E−01 | 25.6 |
| LYM66 | 11953.6 | B | 0.376 | 4.19E−01 | 4.3 | LYM268 | 12481.1 | O | 2.311 | 2.11E−01 | 16.4 |
| LYM67 | 11782.6 | B | 0.408 | 4.83E−01 | 13.3 | LYM148 | 12173.1 | O | 2.29 | 2.22E−01 | 15.3 |
| LYM66 | 11954.4 | B | 0.372 | 5.30E−01 | 3.2 | LYM100 | 12131.3 | O | 2.168 | 2.24E−01 | 9.2 |
| LYM99 | 12244.1 | B | 0.369 | 6.38E−01 | 2.4 | LYM68 | 11943.2 | O | 2.559 | 2.28E−01 | 28.9 |
| LYM67 | 11782.4 | B | 0.374 | 6.79E−01 | 3.9 | LYM152 | 12372.2 | O | 2.215 | 2.44E−01 | 11.5 |
| LYM99 | 12243.1 | B | 0.365 | 8.06E−01 | 1.3 | LYM137 | 12154.5 | O | 2.426 | 2.44E−01 | 22.1 |
| LYM43 | 11793.2 | B | 0.374 | 8.36E−01 | 3.9 | LYM105 | 12295.2 | O | 2.33 | 2.62E−01 | 17.3 |
| LYM31 | 11924.4 | B | 0.369 | 9.06E−01 | 2.5 | LYM130 | 12332.2 | O | 2.424 | 2.81E−01 | 22.1 |
| LYM57 | 12013.3 | B | 0.363 | 9.80E−01 | 0.8 | LYM172 | 12301.2 | O | 2.425 | 2.87E−01 | 22.1 |
| CONTROL | — | B | 0.36 | — | 0 | LYM290 | 12501.3 | O | 2.272 | 2.90E−01 | 14.4 |
| LYM95 | 12124.4 | C | 4.281 | 2.01E−03 | 22.8 | LYM68 | 11942.2 | O | 2.355 | 3.00E−01 | 18.6 |
| LYM66 | 11953.6 | C | 4.238 | 4.68E−03 | 21.6 | LYM62 | 12022.1 | O | 2.266 | 3.17E−01 | 14.1 |
| LYM67 | 11782.4 | C | 4.006 | 2.07E−02 | 14.9 | LYM57 | 12012.6 | O | 2.232 | 3.21E−01 | 12.4 |
| LYM99 | 12244.1 | C | 4.006 | 2.94E−02 | 14.9 | LYM111 | 12254.4 | O | 2.464 | 3.28E−01 | 24 |
| LYM99 | 12243.2 | C | 3.969 | 3.28E−02 | 13.9 | LYM111 | 12251.3 | O | 2.404 | 3.30E−01 | 21 |
| LYM66 | 11954.4 | C | 3.913 | 3.91E−02 | 12.3 | LYM30 | 11912.6 | O | 2.563 | 3.48E−01 | 29 |
| LYM69 | 11852.2 | C | 3.931 | 5.24E−02 | 12.8 | LYM51 | 11894.2 | O | 2.14 | 3.52E−01 | 7.8 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM67 | 11782.5 | C | 3.875 | 5.34E−02 | 11.2 | LYM53 | 11844.2 | O | 2.521 | 3.61E−01 | 26.9 |
| LYM82 | 12203.3 | C | 3.813 | 9.88E−02 | 9.4 | LYM137 | 12153.1 | O | 2.252 | 3.67E−01 | 13.4 |
| LYM88 | 12194.2 | C | 3.794 | 1.08E−01 | 8.8 | LYM62 | 12021.1 | O | 2.472 | 3.77E−01 | 24.5 |
| LYM51 | 11891.1 | C | 3.813 | 1.95E−01 | 9.4 | LYM132 | 12271.4 | O | 2.221 | 4.01E−01 | 11.8 |
| LYM53 | 11841.1 | C | 3.744 | 2.04E−01 | 7.4 | LYM51 | 11893.4 | O | 2.822 | 4.03E−01 | 42.1 |
| LYM43 | 11791.5 | C | 3.681 | 2.86E−01 | 5.6 | LYM119 | 12461.1 | O | 3.049 | 4.11E−01 | 53.5 |
| LYM99 | 12241.1 | C | 3.65 | 3.67E−01 | 4.7 | LYM152 | 12376.1 | O | 2.314 | 4.14E−01 | 16.5 |
| LYM67 | 11782.6 | C | 4.25 | 3.83E−01 | 21.9 | LYM100 | 12134.1 | O | 2.217 | 4.18E−01 | 11.6 |
| LYM53 | 11841.2 | C | 3.631 | 4.57E−01 | 4.2 | LYM111 | 12254.3 | O | 2.789 | 4.58E−01 | 40.4 |
| LYM82 | 12201.5 | C | 3.794 | 4.71E−01 | 8.8 | LYM100 | 12133.3 | O | 2.087 | 4.87E−01 | 5.1 |
| LYM43 | 11793.2 | C | 3.794 | 5.39E−01 | 8.8 | LYM143 | 12524.7 | O | 2.93 | 4.89E−01 | 47.6 |
| LYM67 | 11783.5 | C | 3.594 | 6.03E−01 | 3.1 | LYM152 | 12372.1 | O | 2.572 | 4.90E−01 | 29.5 |
| LYM53 | 11842.4 | C | 3.575 | 6.17E−01 | 2.6 | LYM143 | 12521.2 | O | 2.073 | 5.09E−01 | 4.4 |
| LYM99 | 12243.1 | C | 3.588 | 6.17E−01 | 2.9 | LYM14 | 12051.4 | O | 2.148 | 5.20E−01 | 8.2 |
| LYM82 | 12201.1 | C | 3.569 | 6.50E−01 | 2.4 | LYM290 | 12502.2 | O | 2.383 | 5.23E−01 | 20 |
| LYM51 | 11893.4 | C | 3.59 | 6.68E−01 | 3 | LYM67 | 11783.5 | O | 2.307 | 5.53E−01 | 16.2 |
| LYM88 | 12193.1 | C | 3.694 | 7.08E−01 | 6 | LYM26 | 11824.6 | O | 2.205 | 5.59E−01 | 11 |
| LYM88 | 12193.5 | C | 3.681 | 7.16E−01 | 5.6 | LYM134 | 12312.4 | O | 2.116 | 5.72E−01 | 6.5 |
| LYM69 | 11854.2 | C | 3.556 | 7.53E−01 | 2 | LYM132 | 12275.1 | O | 2.067 | 6.20E−01 | 4.1 |
| LYM66 | 11955.2 | C | 3.625 | 8.66E−01 | 4 | LYM53 | 11842.4 | O | 2.289 | 6.36E−01 | 15.3 |
| LYM51 | 11892.1 | C | 3.5 | 9.37E−01 | 0.4 | LYM43 | 11792.2 | O | 2.174 | 6.56E−01 | 9.4 |
| CONTROL | — | C | 3.485 | — | 0 | LYM119 | 12461.2 | O | 2.115 | 6.64E−01 | 6.5 |
| LYM116 | 13202.12 | D | 0.379 | 1.40E−05 | 41.9 | LYM30 | 11912.7 | O | 2.115 | 6.90E−01 | 6.5 |
| LYM67 | 11782.6 | D | 0.337 | 4.39E−04 | 26.2 | LYM138 | 12562.1 | O | 2.128 | 7.14E−01 | 7.1 |
| LYM128 | 12641.5 | D | 0.364 | 8.83E−04 | 36.4 | LYM43 | 11793.2 | O | 2.162 | 7.20E−01 | 8.9 |
| LYM20 | 11711.2 | D | 0.363 | 8.90E−04 | 36.1 | LYM30 | 11913.3 | O | 2.064 | 7.61E−01 | 3.9 |
| LYM238 | 12764.8 | D | 0.334 | 7.05E−03 | 25.3 | LYM162 | 12231.3 | O | 2.096 | 7.65E−01 | 5.6 |
| LYM88 | 12193.1 | D | 0.298 | 2.70E−02 | 11.8 | LYM95 | 12124.4 | O | 2.032 | 7.69E−01 | 2.3 |
| LYM12 | 11871.3 | D | 0.298 | 3.76E−02 | 11.8 | LYM67 | 11782.4 | O | 2.035 | 8.22E−01 | 2.5 |
| LYM116 | 13202.7 | D | 0.321 | 3.92E−02 | 20.2 | LYM153 | 12321.2 | O | 2.051 | 8.30E−01 | 3.3 |
| LYM239 | 13042.9 | D | 0.33 | 5.21E−02 | 23.8 | LYM152 | 12371.2 | O | 2.071 | 8.45E−01 | 4.3 |
| LYM53 | 11841.1 | D | 0.303 | 7.50E−02 | 13.5 | LYM254 | 12474.4 | O | 2.107 | 8.58E−01 | 6.1 |
| LYM26 | 11824.3 | D | 0.312 | 8.07E−02 | 17 | LYM268 | 12482.1 | O | 2.111 | 8.72E−01 | 6.3 |
| LYM99 | 12243.1 | D | 0.348 | 8.18E−02 | 30.4 | LYM69 | 11854.2 | O | 2.006 | 9.07E−01 | 1 |
| LYM31 | 11923.4 | D | 0.289 | 1.00E−01 | 8.3 | LYM31 | 11922.3 | O | 2.008 | 9.14E−01 | 1.1 |
| LYM31 | 11924.4 | D | 0.297 | 1.21E−01 | 11.4 | LYM152 | 12373.1 | O | 2.03 | 9.27E−01 | 2.2 |
| LYM66 | 11955.2 | D | 0.289 | 1.36E−01 | 8.5 | LYM69 | 11852.4 | O | 2.006 | 9.29E−01 | 1 |
| LYM53 | 11843.2 | D | 0.287 | 1.41E−01 | 7.7 | LYM26 | 11824.5 | O | 1.995 | 9.47E−01 | 0.5 |
| LYM26 | 11824.6 | D | 0.327 | 1.42E−01 | 22.4 | LYM268 | 12483.2 | O | 2.007 | 9.62E−01 | 1.1 |
| LYM285 | 12733.9 | D | 0.38 | 1.57E−01 | 42.3 | CONTROL | — | O | 1.986 | — | 0 |
| LYM20 | 11716.5 | D | 0.292 | 1.84E−01 | 9.5 | LYM68 | 11941.3 | P | 2.991 | 4.57E−04 | 24.7 |
| LYM103 | 12713.5 | D | 0.346 | 1.85E−01 | 29.6 | LYM134 | 12314.2 | P | 2.974 | 5.82E−04 | 24 |
| LYM24 | 12061.4 | D | 0.327 | 1.93E−01 | 22.7 | LYM148 | 12174.1 | P | 3.461 | 9.68E−04 | 44.3 |
| LYM14 | 12051.4 | D | 0.307 | 1.94E−01 | 15 | LYM57 | 12013.5 | P | 2.901 | 1.36E−03 | 20.9 |
| LYM26 | 11824.1 | D | 0.338 | 1.97E−01 | 26.8 | LYM268 | 12482.3 | P | 2.945 | 2.74E−03 | 22.8 |
| LYM238 | 12763.7 | D | 0.283 | 1.97E−01 | 6.1 | LYM31 | 11923.4 | P | 2.944 | 2.83E−03 | 22.7 |
| LYM66 | 11954.4 | D | 0.322 | 2.07E−01 | 20.7 | LYM140 | 12264.1 | P | 2.791 | 5.07E−03 | 16.4 |
| LYM12 | 11872.1 | D | 0.404 | 2.11E−01 | 51.6 | LYM100 | 12131.2 | P | 3.085 | 6.47E−03 | 28.6 |
| LYM99 | 12244.2 | D | 0.283 | 2.45E−01 | 6.2 | LYM130 | 12331.3 | P | 2.712 | 1.54E−02 | 13 |
| LYM12 | 11871.1 | D | 0.334 | 2.71E−01 | 25.1 | LYM148 | 12171.2 | P | 2.748 | 1.78E−02 | 14.5 |
| LYM128 | 12641.3 | D | 0.325 | 2.98E−01 | 21.7 | LYM51 | 11893.2 | P | 2.699 | 1.88E−02 | 12.5 |
| LYM239 | 13044.8 | D | 0.302 | 3.23E−01 | 13 | LYM138 | 12561.1 | P | 3.154 | 2.51E−02 | 31.5 |
| LYM232 | 13024.6 | D | 0.295 | 3.63E−01 | 10.7 | LYM69 | 11853.5 | P | 2.968 | 2.79E−02 | 23.7 |
| LYM103 | 12712.8 | D | 0.305 | 3.64E−01 | 14.3 | LYM290 | 12502.4 | P | 2.886 | 2.85E−02 | 20.3 |
| LYM95 | 12121.2 | D | 0.332 | 3.79E−01 | 24.5 | LYM170 | 12453.2 | P | 2.703 | 2.98E−02 | 12.7 |
| LYM95 | 12124.4 | D | 0.289 | 4.16E−01 | 8.4 | LYM143 | 12524.2 | P | 2.943 | 3.25E−02 | 22.7 |
| LYM69 | 11852.2 | D | 0.281 | 4.94E−01 | 5.2 | LYM68 | 11942.3 | P | 2.866 | 3.61E−02 | 19.5 |
| LYM156 | 12963.1 | D | 0.29 | 5.11E−01 | 8.6 | LYM53 | 11841.1 | P | 2.971 | 4.36E−02 | 23.9 |
| LYM82 | 12201.1 | D | 0.275 | 5.11E−01 | 3.1 | LYM57 | 12012.2 | P | 2.629 | 5.16E−02 | 9.6 |
| LYM67 | 11782.4 | D | 0.288 | 5.17E−01 | 8.1 | LYM119 | 12462.1 | P | 3.134 | 6.34E−02 | 30.7 |
| LYM30 | 11912.6 | D | 0.29 | 5.57E−01 | 8.6 | LYM137 | 12152.1 | P | 2.596 | 8.59E−02 | 8.2 |
| LYM24 | 12064.1 | D | 0.3 | 5.74E−01 | 12.5 | LYM62 | 12022.1 | P | 2.63 | 8.66E−02 | 9.6 |
| LYM26 | 11824.5 | D | 0.309 | 6.01E−01 | 15.9 | LYM138 | 12561.3 | P | 3.014 | 8.88E−02 | 25.6 |
| LYM232 | 13024.7 | D | 0.33 | 6.01E−01 | 23.6 | LYM137 | 12151.1 | P | 2.926 | 9.19E−02 | 22 |
| LYM30 | 11912.7 | D | 0.277 | 6.08E−01 | 3.7 | LYM137 | 12153.1 | P | 2.702 | 9.26E−02 | 12.6 |
| LYM26 | 11821.2 | D | 0.286 | 6.37E−01 | 7.3 | LYM130 | 12332.2 | P | 2.673 | 1.06E−01 | 11.4 |
| LYM103 | 12711.8 | D | 0.273 | 6.74E−01 | 2.5 | LYM43 | 11791.5 | P | 2.949 | 1.06E−01 | 22.9 |
| LYM103 | 12712.5 | D | 0.273 | 6.81E−01 | 2.3 | LYM43 | 11791.4 | P | 2.739 | 1.20E−01 | 14.2 |
| LYM116 | 13204.4 | D | 0.31 | 7.10E−01 | 16.3 | LYM111 | 12252.2 | P | 3.85 | 1.23E−01 | 60.5 |
| LYM62 | 12023.2 | D | 0.273 | 7.33E−01 | 2.2 | LYM105 | 12295.2 | P | 2.705 | 1.58E−01 | 12.8 |
| LYM128 | 12641.1 | D | 0.279 | 7.45E−01 | 4.4 | LYM100 | 12131.3 | P | 2.551 | 1.66E−01 | 6.3 |
| LYM57 | 12012.2 | D | 0.271 | 7.62E−01 | 1.4 | LYM30 | 11913.5 | P | 2.823 | 1.67E−01 | 17.7 |
| LYM66 | 11953.6 | D | 0.27 | 7.80E−01 | 1.3 | LYM137 | 12154.5 | P | 2.674 | 1.74E−01 | 11.5 |

TABLE 32-continued

Results obtained in a T2 experiment at the bolting assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM31 | 11921.3 | D | 0.269 | 8.84E−01 | 1 | LYM100 | 12134.1 | P | 2.625 | 1.75E−01 | 9.4 |
| LYM30 | 11913.5 | D | 0.273 | 8.96E−01 | 2.4 | LYM119 | 12462.2 | P | 2.683 | 1.81E−01 | 11.8 |
| LYM156 | 12961.9 | D | 0.268 | 9.20E−01 | 0.6 | LYM130 | 12334.1 | P | 2.543 | 2.00E−01 | 6 |
| LYM145 | 12951.9 | D | 0.267 | 9.76E−01 | 0.2 | LYM30 | 11912.6 | P | 2.794 | 2.04E−01 | 16.5 |
| CONTROL | — | D | 0.267 | — | 0 | LYM68 | 11941.4 | P | 2.535 | 2.13E−01 | 5.7 |
| LYM26 | 11824.3 | E | 8.813 | 2.28E−03 | 8.7 | LYM105 | 12294.3 | P | 2.685 | 2.22E−01 | 11.9 |
| LYM82 | 12201.1 | E | 9.125 | 4.62E−03 | 12.5 | LYM68 | 11943.2 | P | 2.853 | 2.25E−01 | 18.9 |
| LYM285 | 12733.9 | E | 9 | 7.67E−03 | 11 | LYM268 | 12481.1 | P | 2.672 | 2.31E−01 | 11.4 |
| LYM24 | 12064.1 | E | 8.625 | 9.72E−03 | 6.4 | LYM111 | 12251.3 | P | 2.689 | 2.51E−01 | 12.1 |
| LYM53 | 11841.1 | E | 8.875 | 1.34E−02 | 9.4 | LYM14 | 12052.4 | P | 2.609 | 2.63E−01 | 8.8 |
| LYM12 | 11872.1 | E | 8.563 | 2.18E−02 | 5.6 | LYM134 | 12312.4 | P | 2.518 | 2.68E−01 | 4.9 |
| LYM95 | 12121.2 | E | 9.313 | 2.37E−02 | 14.8 | LYM111 | 12254.4 | P | 2.753 | 2.72E−01 | 14.7 |
| LYM31 | 11923.4 | E | 8.75 | 2.50E−02 | 7.9 | LYM57 | 12012.6 | P | 2.524 | 2.86E−01 | 5.2 |
| LYM43 | 11791.4 | E | 8.75 | 2.50E−02 | 7.9 | LYM62 | 12021.1 | P | 2.827 | 2.91E−01 | 17.8 |
| LYM99 | 12243.2 | E | 8.75 | 2.50E−02 | 7.9 | LYM152 | 12372.2 | P | 2.623 | 3.12E−01 | 9.3 |
| LYM128 | 12641.5 | E | 9.188 | 3.04E−02 | 13.3 | LYM143 | 12521.2 | P | 2.539 | 3.29E−01 | 5.8 |
| LYM67 | 11782.6 | E | 8.625 | 4.97E−02 | 6.4 | LYM53 | 11844.2 | P | 2.851 | 3.42E−01 | 18.8 |
| LYM99 | 12244.2 | E | 8.625 | 4.97E−02 | 6.4 | LYM172 | 12301.2 | P | 2.688 | 3.44E−01 | 12.1 |
| LYM66 | 11954.4 | E | 8.938 | 5.42E−02 | 10.2 | LYM67 | 11783.5 | P | 2.698 | 3.48E−01 | 12.5 |
| LYM99 | 12243.1 | E | 9.25 | 7.13E−02 | 14.1 | LYM51 | 11893.4 | P | 2.942 | 3.50E−01 | 22.6 |
| LYM30 | 11913.4 | E | 8.438 | 7.36E−02 | 4 | LYM132 | 12271.4 | P | 2.569 | 3.58E−01 | 7.1 |
| LYM66 | 11953.6 | E | 8.438 | 7.36E−02 | 4 | LYM290 | 12502.2 | P | 2.694 | 3.87E−01 | 12.3 |
| LYM95 | 12124.4 | E | 8.438 | 7.36E−02 | 4 | LYM119 | 12461.1 | P | 3.083 | 3.95E−01 | 28.5 |
| LYM128 | 12641.3 | E | 8.813 | 7.63E−02 | 8.7 | LYM68 | 11942.2 | P | 2.673 | 3.96E−01 | 11.4 |
| LYM103 | 12713.5 | E | 8.5 | 1.05E−01 | 4.8 | LYM152 | 12376.1 | P | 2.632 | 4.09E−01 | 9.7 |
| LYM26 | 11824.6 | E | 8.5 | 1.05E−01 | 4.8 | LYM138 | 12562.1 | P | 2.59 | 4.09E−01 | 8 |
| LYM24 | 12061.4 | E | 9 | 1.06E−01 | 11 | LYM290 | 12501.3 | P | 2.571 | 4.21E−01 | 7.2 |
| LYM238 | 12764.8 | E | 8.688 | 1.12E−01 | 7.1 | LYM51 | 11891.1 | P | 2.501 | 4.32E−01 | 4.2 |
| LYM145 | 12951.9 | E | 8.375 | 1.13E−01 | 3.3 | LYM111 | 12254.3 | P | 2.964 | 4.42E−01 | 23.6 |
| LYM88 | 12194.2 | E | 8.563 | 1.73E−01 | 5.6 | LYM143 | 12524.7 | P | 2.928 | 4.42E−01 | 22 |
| LYM26 | 11824.1 | E | 8.75 | 1.74E−01 | 7.9 | LYM95 | 12124.4 | P | 2.485 | 4.88E−01 | 3.6 |
| LYM20 | 11711.2 | E | 8.938 | 1.81E−01 | 10.2 | LYM148 | 12173.1 | P | 2.551 | 4.89E−01 | 6.3 |
| LYM14 | 12051.4 | E | 8.813 | 2.22E−01 | 8.7 | LYM152 | 12372.1 | P | 2.816 | 5.25E−01 | 17.4 |
| LYM116 | 13202.12 | E | 8.375 | 2.33E−01 | 3.3 | LYM100 | 12133.3 | P | 2.501 | 5.25E−01 | 4.3 |
| LYM99 | 12241.1 | E | 8.375 | 2.33E−01 | 3.3 | LYM26 | 11824.6 | P | 2.619 | 5.33E−01 | 9.2 |
| LYM30 | 11912.6 | E | 8.313 | 2.38E−01 | 2.5 | LYM111 | 12251.1 | P | 2.463 | 5.41E−01 | 2.7 |
| LYM239 | 13042.9 | E | 8.438 | 2.80E−01 | 4 | LYM51 | 11894.2 | P | 2.462 | 5.54E−01 | 2.6 |
| LYM69 | 11852.2 | E | 8.938 | 2.86E−01 | 10.2 | LYM14 | 12051.4 | P | 2.534 | 5.68E−01 | 5.6 |
| LYM128 | 12641.1 | E | 8.5 | 3.24E−01 | 4.8 | LYM105 | 12297.1 | P | 2.475 | 5.86E−01 | 3.1 |
| LYM57 | 12012.2 | E | 8.5 | 3.24E−01 | 4.8 | LYM132 | 12276.1 | P | 2.532 | 5.96E−01 | 5.5 |
| LYM31 | 11921.3 | E | 8.554 | 3.53E−01 | 5.5 | LYM43 | 11792.2 | P | 2.564 | 6.02E−01 | 6.9 |
| LYM66 | 11955.2 | E | 8.938 | 3.68E−01 | 10.2 | LYM30 | 11913.3 | P | 2.456 | 6.49E−01 | 2.4 |
| LYM88 | 12193.1 | E | 8.625 | 3.80E−01 | 6.4 | LYM162 | 12231.3 | P | 2.496 | 6.50E−01 | 4.1 |
| LYM66 | 11952.2 | E | 8.375 | 4.66E−01 | 3.3 | LYM30 | 11913.4 | P | 2.472 | 6.77E−01 | 3 |
| LYM232 | 13024.7 | E | 8.313 | 4.68E−01 | 2.5 | LYM119 | 12461.4 | P | 2.515 | 7.10E−01 | 4.9 |
| LYM99 | 12244.1 | E | 8.438 | 4.71E−01 | 4 | LYM152 | 12371.2 | P | 2.508 | 7.20E−01 | 4.5 |
| LYM31 | 11924.4 | E | 8.563 | 4.80E−01 | 5.6 | LYM53 | 11842.4 | P | 2.589 | 7.25E−01 | 7.9 |
| LYM51 | 11891.1 | E | 8.25 | 5.02E−01 | 1.7 | LYM43 | 11793.2 | P | 2.535 | 7.25E−01 | 5.7 |
| LYM53 | 11842.4 | E | 8.25 | 5.02E−01 | 1.7 | LYM30 | 11912.7 | P | 2.442 | 7.59E−01 | 1.8 |
| LYM62 | 12023.5 | E | 8.25 | 5.02E−01 | 1.7 | LYM152 | 12373.1 | P | 2.503 | 7.68E−01 | 4.3 |
| LYM62 | 12023.2 | E | 8.688 | 5.52E−01 | 7.1 | LYM26 | 11824.5 | P | 2.428 | 7.79E−01 | 1.2 |
| LYM12 | 11873.4 | E | 8.438 | 5.87E−01 | 4 | LYM132 | 12275.1 | P | 2.424 | 8.07E−01 | 1.1 |
| LYM12 | 11871.3 | E | 8.188 | 6.37E−01 | 1 | LYM69 | 11852.4 | P | 2.439 | 8.44E−01 | 1.7 |
| LYM53 | 11843.2 | E | 8.188 | 6.37E−01 | 1 | LYM31 | 11922.3 | P | 2.425 | 8.59E−01 | 1.1 |
| LYM67 | 11782.4 | E | 8.438 | 6.63E−01 | 4 | LYM254 | 12474.4 | P | 2.487 | 8.63E−01 | 3.7 |
| LYM43 | 11793.2 | E | 8.438 | 7.17E−01 | 4 | LYM268 | 12482.1 | P | 2.471 | 8.81E−01 | 3 |
| LYM26 | 11821.2 | E | 8.313 | 7.24E−01 | 2.5 | LYM66 | 11954.4 | P | 2.478 | 8.96E−01 | 3.3 |
| LYM12 | 11871.1 | E | 8.5 | 7.33E−01 | 4.8 | LYM153 | 12321.2 | P | 2.423 | 9.16E−01 | 1 |
| LYM239 | 13044.8 | E | 8.188 | 7.69E−01 | 1 | LYM290 | 12502.1 | P | 2.411 | 9.36E−01 | 0.5 |
| LYM285 | 12734.9 | E | 8.313 | 7.80E−01 | 2.5 | LYM62 | 12022.2 | P | 2.412 | 9.44E−01 | 0.5 |
| LYM43 | 11791.5 | E | 8.125 | 9.18E−01 | 0.2 | LYM67 | 11782.4 | P | 2.406 | 9.49E−01 | 0.3 |
| LYM116 | 13204.4 | E | 8.188 | 9.28E−01 | 1 | LYM162 | 12234.3 | P | 2.4 | 9.95E−01 | 0 |
| LYM30 | 11913.5 | E | 8.188 | 9.28E−01 | 1 | CONTROL | — | P | 2.399 | — | 0 |
| LYM232 | 13024.6 | E | 8.125 | 9.39E−01 | 0.2 | | | | | | |
| LYM30 | 11912.7 | E | 8.188 | 9.39E−01 | 1 | | | | | | |
| LYM67 | 11782.5 | E | 8.125 | 9.62E−01 | 0.2 | | | | | | |
| LYM26 | 11824.5 | E | 8.125 | 9.89E−01 | 0.2 | | | | | | |
| CONTROL | — | E | 8.109 | — | 0 | | | | | | |

Table 32. Results of the greenhouse experiments. Provided are the measured values of each tested parameter [parameters (ID.) A-P according to the parameters described in Table 31 above] in plants expressing the indicated polynucleotides. "Ev" = event; "P" = P-value; "Mean" = the average of measured parameter across replicates. % incr. vs. cont. = percentage of increase versus control (as compared to control).

Example 11

Improved Transgenic Plant Performance—Tissue Culture Assays

To analyze the effect of expression of the isolated polynucleotides in plants, plants performance was tested in tissue culture.

Plant growth under favorable conditions in tissue culture using T1 or T2 plants—The experiments used either T2 seeds (T2 experiments herein below) or T1 seeds (T1 experiments herein below). Surface sterilized T1 or T2 seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, at T2 experiments seedlings randomly chosen were carefully transferred to plates containing 0.5 MS media. Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment. Alternatively, at T1 experiments seedlings randomly chosen were carefully transferred to plates containing 0.5 MS media. Each plate contained 5 T1 seedlings representing 5 independent transgenic events, and 3-4 different plates (total of 15-20 events). Plants expressing the polynucleotides of the invention were compared to the average measurement of the control plants (empty vector or GUS reporter gene under the same promoter) used in the same experiment.

Plant growth under low nitrogen conditions in Tissue culture using T2 plants—Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

For both experiments the same plant parameters were being measured and being described below:

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, is used for capturing images of plantlets sawn in agar plates.

The image capturing process is repeated every 4 days starting at day 1 till day 10. An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XVII, VII and XVIII.

Relative growth rate of leaf area=Regression coefficient of leaf area along time course.   Formula XVII Relative growth rate of root coverage=Regression coefficient of root coverage along time course.   Formula VII (above)

Relative growth rate of root length=Regression coefficient of root length along time course.   Formula XVIII:

At the end of the experiment, plantlets were removed from the media and weighed for the determination of plant fresh weight. Plantlets were then dried for 24 hours at 60° C., and weighed again to measure plant dry weight for later statistical analysis. Growth rate is determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, is determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately (T2 experiments) or as average of events (T1 experiments). To evaluate the effect of a gene event (T2 experiments) or gene (T1 experiment) over a control the data is analyzed by Student's t-test and the p value is calculated. Results were considered significant if $p \leq 0.1$. The JMP statistics software package was used (Version 5.2.1, SAS Institute Inc., Cary, N.C., USA).

Tables 33, 35 and 37 specify the parameters measured in plants in the tissue culture assays (T2 plants, T1 plants and low nitrogen T2 plants).

Experimental Results

Plans expressing the polynucleotides of the invention were assayed for a number of commercially desired traits. In cases where a certain event appears more than once, the event was tested in several independent experiments.

TABLE 33

Measured parameters at the tissue culture assay (T2 experiment) for transformed agriculture improving trait genes

| Tested Parameters | ID |
|---|---|
| Dry Weight (gr) | A |
| Fresh Weight (gr) | B |
| RGR Of Root Coverage | C |
| Roots Coverage TP3 (cm$^2$) | D |
| RGR Of Roots Length | E |
| Roots Length TP3 (cm) | F |
| Leaf Area TP3 (cm) | G |
| RGR Of Leaf Area | H |

Table 33: Provided are the identification (ID) letters of each of the Tested Parameters. TP3—Time Point 3; RGR—Relative Growth Rate.

TABLE 34

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM37 | 11801.2 | A | 0.007 | 4.96E-04 | 60.3 | LYM1 | 11602.6 | H | 0.104 | 0.00E+00 | 124 |
| LYM34 | 11902.2 | A | 0.006 | 2.28E-02 | 33.5 | LYM132 | 12275.3 | H | 0.085 | 0.00E+00 | 82.4 |
| LYM34 | 11904.3 | A | 0.006 | 7.24E-02 | 27.6 | LYM178 | 12164.3 | H | 0.106 | 0.00E+00 | 128.4 |
| LYM34 | 11901.1 | A | 0.005 | 8.11E-02 | 15.8 | LYM132 | 12271.4 | H | 0.075 | 1.00E-06 | 61.2 |
| LYM35 | 11813.5 | A | 0.005 | 8.90E-02 | 14.7 | LYM1 | 11601.1 | H | 0.074 | 2.00E-06 | 60.1 |
| CONTROL | — | A | 0.005 | — | 0 | LYM178 | 12163.3 | H | 0.093 | 2.00E-06 | 100.8 |
| LYM34 | 11904.3 | B | 0.119 | 8.41E-02 | 27.7 | LYM132 | 12276.1 | H | 0.086 | 6.00E-06 | 84.4 |
| LYM35 | 11813.5 | B | 0.109 | 9.32E-02 | 16.8 | LYM134 | 12314.2 | H | 0.075 | 3.10E-05 | 61.1 |
| CONTROL | — | B | 0.093 | — | 0 | LYM6 | 11736.1 | H | 0.077 | 5.10E-05 | 66 |
| LYM37 | 11801.1 | C | 0.697 | 1.40E-05 | 69.9 | LYM268 | 12482.1 | H | 0.072 | 6.60E-05 | 54.4 |
| LYM12 | 11874.1 | C | 0.59 | 3.88E-02 | 43.9 | LYM129 | 12573.5 | H | 0.078 | 1.22E-04 | 68.6 |
| LYM35 | 11813.5 | C | 0.518 | 7.38E-02 | 26.2 | LYM1 | 11603.2 | H | 0.066 | 5.10E-04 | 42.6 |
| LYM37 | 11803.2 | C | 0.527 | 8.20E-02 | 28.3 | LYM268 | 12483.2 | H | 0.072 | 5.20E-04 | 54.1 |
| LYM34 | 11902.2 | C | 0.505 | 9.84E-02 | 23.1 | LYM134 | 12313.2 | H | 0.098 | 8.99E-04 | 111.5 |
| CONTROL | — | C | 0.41 | — | 0 | LYM178 | 12164.2 | H | 0.064 | 1.35E-03 | 37.5 |
| LYM37 | 11801.1 | D | 6.178 | 1.90E-05 | 69.5 | LYM5 | 12432.1 | H | 0.072 | 1.67E-03 | 54.4 |
| LYM41 | 11831.5 | D | 4.331 | 7.99E-02 | 18.8 | LYM268 | 12483.4 | H | 0.07 | 3.94E-03 | 50.7 |
| CONTROL | — | D | 3.645 | — | 0 | LYM268 | 12482.3 | H | 0.064 | 5.44E-03 | 36.9 |
| LYM37 | 11801.1 | E | 0.5 | 9.40E-05 | 48.1 | LYM5 | 12435.1 | H | 0.067 | 9.04E-03 | 44.9 |
| LYM34 | 11902.4 | E | 0.434 | 4.61E-03 | 28.8 | LYM6 | 11735.1 | H | 0.064 | 1.69E-02 | 37.6 |
| LYM12 | 11871.1 | E | 0.421 | 1.67E-02 | 24.7 | LYM6 | 11735.2 | H | 0.059 | 1.93E-02 | 27.1 |
| LYM12 | 11874.1 | E | 0.475 | 2.60E-02 | 40.6 | LYM129 | 12572.2 | H | 0.059 | 2.39E-02 | 26.6 |
| LYM12 | 11873.4 | E | 0.437 | 2.78E-02 | 29.5 | LYM129 | 12571.3 | H | 0.061 | 5.64E-02 | 31 |
| LYM12 | 11872.1 | E | 0.419 | 3.43E-02 | 24.3 | LYM132 | 12273.2 | H | 0.061 | 6.13E-02 | 32.2 |
| LYM37 | 11803.2 | E | 0.44 | 4.37E-02 | 30.4 | LYM1 | 11602.1 | H | 0.057 | 6.26E-02 | 21.7 |
| LYM134 | 12312.3 | E | 0.413 | 4.44E-02 | 22.3 | LYM5 | 12436.2 | H | 0.059 | 8.93E-02 | 27.3 |
| LYM178 | 12164.2 | E | 0.455 | 4.69E-02 | 34.8 | CONTROL | — | H | 0.046 | — | 0 |
| LYM34 | 11903.3 | E | 0.418 | 4.86E-02 | 24 | LYM236 | 12594.3 | A | 0.008 | 1.51E-03 | 116.1 |
| LYM41 | 11831.1 | E | 0.41 | 5.41E-02 | 21.5 | LYM254 | 12471.1 | A | 0.008 | 2.78E-03 | 98.7 |
| LYM178 | 12161.1 | E | 0.403 | 7.68E-02 | 19.6 | LYM162 | 12231.1 | A | 0.006 | 3.13E-03 | 46.6 |
| LYM41 | 11833.1 | E | 0.415 | 8.54E-02 | 23.1 | LYM42 | 11992.2 | A | 0.006 | 4.31E-03 | 47.3 |
| CONTROL | — | E | 0.337 | — | 0 | LYM148 | 12171.2 | A | 0.006 | 5.66E-03 | 53.1 |
| LYM37 | 11801.1 | F | 6.047 | 6.62E-04 | 37 | LYM170 | 12452.3 | A | 0.008 | 1.06E-02 | 100.6 |
| LYM34 | 11902.4 | F | 5.246 | 9.78E-04 | 18.8 | LYM250 | 12613.2 | A | 0.008 | 1.81E-02 | 93.6 |
| LYM41 | 11831.5 | F | 5.45 | 2.57E-03 | 23.5 | LYM172 | 12301.3 | A | 0.005 | 2.24E-02 | 40.8 |
| LYM41 | 11831.1 | F | 5.583 | 4.31E-03 | 26.5 | LYM206 | 12603.2 | A | 0.007 | 2.33E-02 | 69.1 |
| LYM12 | 11873.4 | F | 5.776 | 1.16E-02 | 30.8 | LYM236 | 12592.3 | A | 0.011 | 2.33E-02 | 194.5 |
| LYM37 | 11801.2 | F | 5.411 | 1.89E-02 | 22.6 | LYM140 | 12261.4 | A | 0.005 | 2.36E-02 | 37.6 |
| LYM178 | 12161.1 | F | 5.197 | 2.62E-02 | 17.7 | LYM236 | 12591.1 | A | 0.008 | 4.87E-02 | 94.9 |
| LYM35 | 11813.5 | F | 5.421 | 3.01E-02 | 22.8 | LYM172 | 12304.1 | A | 0.006 | 5.05E-02 | 46 |
| LYM12 | 11871.1 | F | 4.91 | 3.40E-02 | 11.2 | LYM170 | 12453.3 | A | 0.008 | 5.28E-02 | 102.6 |
| LYM34 | 11903.3 | F | 5.271 | 5.80E-02 | 19.4 | LYM99 | 12244.2 | A | 0.005 | 5.35E-02 | 31.8 |
| LYM12 | 11872.1 | F | 4.933 | 9.08E-02 | 11.8 | LYM176 | 12385.1 | A | 0.008 | 6.09E-02 | 92.9 |
| LYM37 | 11803.2 | F | 5.325 | 9.97E-02 | 20.6 | LYM254 | 12473.1 | A | 0.006 | 6.78E-02 | 51.1 |
| CONTROL | — | F | 4.414 | — | 0 | LYM206 | 12601.3 | A | 0.005 | 8.81E-02 | 23.5 |
| LYM34 | 11902.2 | G | 0.51 | 1.12E-04 | 35.6 | CONTROL | — | A | 0.004 | — | 0 |
| LYM132 | 12271.4 | G | 0.535 | 1.40E-04 | 42.2 | LYM250 | 12613.2 | B | 0.155 | 1.17E-03 | 115.8 |
| LYM37 | 11801.1 | G | 0.53 | 3.38E-03 | 41.1 | LYM170 | 12452.3 | B | 0.15 | 1.88E-03 | 108.2 |
| LYM35 | 11813.5 | G | 0.532 | 4.76E-03 | 41.6 | LYM140 | 12261.4 | B | 0.103 | 2.97E-03 | 42.9 |
| LYM41 | 11831.5 | G | 0.485 | 5.92E-03 | 29.1 | LYM254 | 12471.1 | B | 0.146 | 4.61E-03 | 103.2 |
| LYM34 | 11904.3 | G | 0.511 | 1.03E-02 | 36 | LYM42 | 11992.2 | B | 0.112 | 6.00E-03 | 55 |
| LYM37 | 11801.2 | G | 0.553 | 2.50E-02 | 47.2 | LYM236 | 12594.3 | B | 0.166 | 7.83E-03 | 130.6 |
| LYM35 | 11814.1 | G | 0.496 | 4.22E-02 | 31.9 | LYM148 | 12171.2 | B | 0.118 | 9.52E-03 | 63.8 |
| LYM37 | 11803.2 | G | 0.46 | 4.24E-02 | 22.3 | LYM99 | 12244.2 | B | 0.094 | 1.23E-02 | 31 |
| LYM35 | 11812.4 | G | 0.495 | 4.88E-02 | 31.7 | LYM89 | 12211.2 | B | 0.157 | 1.54E-02 | 117.7 |
| LYM37 | 11802.2 | G | 0.698 | 5.08E-02 | 85.6 | LYM162 | 12231.1 | B | 0.109 | 1.59E-02 | 52 |
| LYM178 | 12161.1 | G | 0.432 | 5.38E-02 | 15 | LYM236 | 12592.3 | B | 0.218 | 1.74E-02 | 202.4 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM41 | 11831.1 | G | 0.467 | 8.64E−02 | 24.4 | LYM172 | 12304.1 | B | 0.118 | 2.52E−02 | 63.6 |
| LYM178 | 12163.3 | G | 0.439 | 8.80E−02 | 16.7 | LYM176 | 12385.1 | B | 0.147 | 2.76E−02 | 103.9 |
| LYM37 | 11803.1 | G | 0.445 | 9.23E−02 | 18.3 | LYM254 | 12473.1 | B | 0.123 | 3.29E−02 | 70.5 |
| CONTROL | — | G | 0.376 | — | 0 | LYM206 | 12603.2 | B | 0.139 | 3.64E−02 | 92.4 |
| LYM37 | 11802.2 | H | 0.071 | 8.35E−04 | 82.3 | LYM236 | 12591.1 | B | 0.148 | 3.71E−02 | 105.8 |
| LYM37 | 11801.1 | H | 0.056 | 2.75E−03 | 44.2 | LYM170 | 12453.3 | B | 0.156 | 4.30E−02 | 116.8 |
| LYM37 | 11801.2 | H | 0.054 | 6.30E−03 | 40.3 | LYM250 | 12614.1 | B | 0.09 | 4.32E−02 | 24.8 |
| LYM35 | 11813.5 | H | 0.051 | 1.52E−02 | 32.4 | LYM172 | 12302.2 | B | 0.089 | 4.68E−02 | 23.7 |
| LYM132 | 12271.4 | H | 0.052 | 1.70E−02 | 34.1 | LYM250 | 12613.4 | B | 0.099 | 4.78E−02 | 37 |
| LYM37 | 11803.2 | H | 0.05 | 2.33E−02 | 29.6 | LYM206 | 12601.3 | B | 0.1 | 5.38E−02 | 39.3 |
| LYM35 | 11812.4 | H | 0.052 | 2.59E−02 | 33.2 | LYM140 | 12261.2 | B | 0.089 | 5.71E−02 | 23.4 |
| LYM34 | 11902.2 | H | 0.049 | 2.97E−02 | 27.4 | LYM206 | 12603.1 | B | 0.088 | 6.78E−02 | 22.5 |
| LYM34 | 11904.3 | H | 0.05 | 7.81E−02 | 28.4 | LYM170 | 12453.2 | B | 0.094 | 7.55E−02 | 30.7 |
| LYM12 | 11874.1 | H | 0.05 | 9.07E−02 | 30.1 | LYM206 | 12602.1 | B | 0.123 | 8.33E−02 | 70.1 |
| LYM35 | 11814.1 | H | 0.047 | 9.82E−02 | 22.5 | LYM170 | 12452.4 | B | 0.128 | 8.37E−02 | 77.1 |
| CONTROL | — | H | 0.039 | — | 0 | LYM140 | 12262.2 | B | 0.09 | 9.03E−02 | 24.7 |
| LYM82 | 12203.5 | A | 0.011 | 1.26E−03 | 111.5 | LYM176 | 12384.1 | B | 0.096 | 9.40E−02 | 33 |
| LYM268 | 12482.1 | A | 0.007 | 2.56E−03 | 34.2 | CONTROL | — | B | 0.072 | — | 0 |
| LYM82 | 12201.2 | A | 0.008 | 5.53E−03 | 51.6 | LYM172 | 12301.3 | C | 0.909 | 0.00E+00 | 131.8 |
| LYM5 | 12436.1 | A | 0.006 | 8.15E−03 | 24.2 | LYM176 | 12384.1 | C | 0.869 | 0.00E+00 | 121.6 |
| LYM86 | 12183.1 | A | 0.007 | 8.76E−03 | 43.6 | LYM206 | 12603.2 | C | 0.962 | 0.00E+00 | 145.4 |
| LYM129 | 12573.1 | A | 0.01 | 1.15E−02 | 91.5 | LYM236 | 12591.1 | C | 1.008 | 0.00E+00 | 157.2 |
| LYM268 | 12484.2 | A | 0.009 | 2.45E−02 | 73.6 | LYM236 | 12592.3 | C | 0.999 | 0.00E+00 | 154.8 |
| LYM268 | 12483.4 | A | 0.014 | 2.66E−02 | 180.3 | LYM236 | 12594.3 | C | 0.862 | 0.00E+00 | 119.8 |
| LYM129 | 12572.2 | A | 0.007 | 2.78E−02 | 38.7 | LYM250 | 12613.2 | C | 0.937 | 0.00E+00 | 139 |
| LYM8 | 11984.1 | A | 0.011 | 3.56E−02 | 125.9 | LYM254 | 12471.1 | C | 0.832 | 0.00E+00 | 112.2 |
| LYM86 | 12183.3 | A | 0.007 | 9.36E−02 | 39.7 | LYM170 | 12452.4 | C | 0.784 | 1.00E−06 | 100.1 |
| CONTROL | — | A | 0.005 | — | 0 | LYM170 | 12452.3 | C | 0.826 | 1.00E−05 | 110.8 |
| LYM268 | 12482.1 | B | 0.138 | 1.55E−03 | 47.8 | LYM170 | 12453.2 | C | 0.789 | 1.00E−05 | 101.4 |
| LYM82 | 12203.5 | B | 0.189 | 5.29E−03 | 102.1 | LYM148 | 12171.2 | C | 0.809 | 1.10E−05 | 106.5 |
| LYM86 | 12183.1 | B | 0.142 | 1.04E−02 | 51.8 | LYM206 | 12602.1 | C | 0.895 | 1.10E−05 | 128.4 |
| LYM129 | 12573.1 | B | 0.171 | 1.16E−02 | 83.7 | LYM172 | 12304.1 | C | 0.71 | 1.30E−05 | 81 |
| LYM268 | 12484.2 | B | 0.146 | 1.19E−02 | 56.8 | LYM162 | 12231.1 | C | 0.898 | 1.70E−05 | 129 |
| LYM82 | 12201.2 | B | 0.133 | 1.75E−02 | 42.9 | LYM162 | 12231.2 | C | 0.856 | 2.40E−05 | 118.5 |
| LYM268 | 12483.4 | B | 0.243 | 2.03E−02 | 160.1 | LYM176 | 12381.3 | C | 0.691 | 4.30E−05 | 76.2 |
| LYM129 | 12572.2 | B | 0.126 | 4.67E−02 | 35.3 | LYM250 | 12614.1 | C | 0.74 | 8.00E−05 | 88.8 |
| LYM5 | 12436.1 | B | 0.11 | 7.62E−02 | 18.2 | LYM206 | 12603.3 | C | 0.736 | 1.02E−04 | 87.7 |
| CONTROL | — | B | 0.093 | — | 0 | LYM89 | 12214.2 | C | 0.713 | 1.44E−04 | 81.9 |
| LYM268 | 12483.4 | C | 1.193 | 0.00E+00 | 184.9 | LYM176 | 12385.1 | C | 0.847 | 1.46E−04 | 116 |
| LYM82 | 12203.5 | C | 0.933 | 1.00E−06 | 122.9 | LYM172 | 12302.2 | C | 0.777 | 1.54E−04 | 98.2 |
| LYM8 | 11984.1 | C | 0.846 | 1.20E−05 | 102.1 | LYM254 | 12471.2 | C | 0.657 | 2.37E−04 | 67.6 |
| LYM82 | 12203.2 | C | 1.047 | 2.30E−05 | 149.9 | LYM99 | 12244.2 | C | 0.665 | 5.09E−04 | 69.6 |
| LYM268 | 12484.2 | C | 0.749 | 4.40E−05 | 79 | LYM250 | 12611.3 | C | 0.666 | 5.70E−04 | 69.8 |
| LYM5 | 12436.2 | C | 0.708 | 1.17E−04 | 69 | LYM172 | 12301.2 | C | 0.621 | 6.43E−04 | 58.4 |
| LYM44 | 11884.3 | C | 0.683 | 5.09E−04 | 63.2 | LYM170 | 12453.3 | C | 0.709 | 6.67E−04 | 80.9 |
| LYM86 | 12183.3 | C | 0.599 | 4.64E−03 | 43.1 | LYM89 | 12214.1 | C | 0.694 | 7.89E−04 | 77.2 |
| LYM129 | 12573.1 | C | 0.634 | 4.95E−03 | 51.5 | LYM236 | 12592.4 | C | 0.698 | 8.40E−04 | 78 |
| LYM129 | 12572.2 | C | 0.616 | 5.99E−03 | 47.2 | LYM42 | 11992.2 | C | 0.75 | 8.94E−04 | 91.4 |
| LYM86 | 12182.3 | C | 0.585 | 1.21E−02 | 39.6 | LYM140 | 12261.2 | C | 0.634 | 1.55E−03 | 61.8 |
| LYM268 | 12481.3 | C | 0.655 | 1.25E−02 | 56.5 | LYM89 | 12214.3 | C | 0.636 | 1.76E−03 | 62.3 |
| LYM5 | 12436.1 | C | 0.592 | 1.26E−02 | 41.3 | LYM89 | 12211.2 | C | 0.69 | 1.81E−03 | 76 |
| LYM44 | 11882.1 | C | 0.612 | 1.33E−02 | 46.2 | LYM162 | 12233.2 | C | 0.594 | 2.55E−03 | 51.5 |
| LYM268 | 12482.1 | C | 0.558 | 3.20E−02 | 33.2 | LYM99 | 12244.1 | C | 0.631 | 3.12E−03 | 60.9 |
| LYM44 | 11885.3 | C | 0.546 | 5.94E−02 | 30.3 | LYM140 | 12261.4 | C | 0.614 | 3.48E−03 | 56.5 |
| CONTROL | — | C | 0.419 | — | 0 | LYM254 | 12472.3 | C | 0.609 | 4.02E−03 | 55.4 |
| LYM268 | 12483.4 | D | 10.319 | 2.40E−05 | 190.3 | LYM162 | 12234.3 | C | 0.591 | 4.28E−03 | 50.8 |
| LYM5 | 12436.2 | D | 6.069 | 1.53E−03 | 70.7 | LYM3 | 12041.2 | C | 0.584 | 5.59E−03 | 48.9 |
| LYM44 | 11884.3 | D | 5.876 | 2.29E−03 | 65.3 | LYM99 | 12241.1 | C | 0.573 | 6.37E−03 | 46.2 |
| LYM82 | 12203.5 | D | 8.17 | 2.69E−03 | 129.8 | LYM89 | 12214.4 | C | 0.601 | 7.47E−03 | 53.3 |
| LYM268 | 12484.2 | D | 6.627 | 3.76E−03 | 86.4 | LYM250 | 12613.4 | C | 0.598 | 7.72E−03 | 52.6 |
| LYM86 | 12183.3 | D | 5.313 | 3.87E−03 | 49.5 | LYM290 | 12502.1 | C | 0.635 | 8.21E−03 | 61.9 |
| LYM86 | 12182.3 | D | 4.996 | 8.33E−03 | 40.6 | LYM290 | 12501.3 | C | 0.636 | 1.00E−02 | 62.3 |
| LYM129 | 12572.2 | D | 5.336 | 1.25E−02 | 50.1 | LYM148 | 12173.5 | C | 0.608 | 1.17E−02 | 55.2 |
| LYM129 | 12573.1 | D | 5.39 | 1.80E−02 | 51.6 | LYM148 | 12173.1 | C | 0.555 | 1.44E−02 | 41.6 |
| LYM5 | 12436.1 | D | 5.203 | 2.16E−02 | 46.4 | LYM206 | 12601.3 | C | 0.606 | 1.63E−02 | 54.7 |
| LYM82 | 12203.2 | D | 9.172 | 2.69E−02 | 158 | LYM148 | 12172.1 | C | 0.544 | 3.03E−02 | 38.8 |
| LYM8 | 11984.1 | D | 7.277 | 3.07E−02 | 104.7 | LYM254 | 12474.3 | C | 0.543 | 3.66E−02 | 38.4 |
| LYM44 | 11885.3 | D | 4.768 | 3.08E−02 | 34.1 | LYM3 | 12041.1 | C | 0.531 | 3.68E−02 | 35.5 |
| LYM268 | 12482.1 | D | 4.714 | 3.75E−02 | 32.6 | LYM99 | 12243.2 | C | 0.584 | 4.06E−02 | 48.9 |
| LYM44 | 11882.1 | D | 5.205 | 6.64E−02 | 46.4 | CONTROL | — | C | 0.392 | — | 0 |
| CONTROL | — | D | 3.555 | — | 0 | LYM176 | 12384.1 | D | 7.655 | 0.00E+00 | 132.7 |
| LYM268 | 12483.4 | E | 0.529 | 1.08E−02 | 41.8 | LYM172 | 12304.1 | D | 6.298 | 1.30E−05 | 91.4 |
| LYM44 | 11884.3 | E | 0.504 | 2.21E−02 | 35.2 | LYM170 | 12452.4 | D | 6.863 | 3.10E−05 | 108.6 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM82 | 12203.2 | E | 0.528 | 2.55E−02 | 41.7 | LYM176 | 12381.3 | D | 6.039 | 3.20E−05 | 83.6 |
| LYM82 | 12203.5 | E | 0.494 | 6.19E−02 | 32.5 | LYM254 | 12471.2 | D | 5.663 | 1.13E−04 | 72.2 |
| LYM86 | 12182.3 | E | 0.474 | 7.22E−02 | 27.2 | LYM172 | 12301.3 | D | 7.853 | 3.12E−04 | 138.7 |
| LYM86 | 12183.3 | E | 0.469 | 9.75E−02 | 25.7 | LYM172 | 12301.2 | D | 5.347 | 3.95E−04 | 62.5 |
| CONTROL | — | E | 0.373 | — | 0 | LYM254 | 12471.1 | D | 7.28 | 5.95E−04 | 121.3 |
| LYM268 | 12483.4 | F | 6.551 | 4.20E−05 | 48.7 | LYM99 | 12241.1 | D | 4.885 | 1.02E−03 | 48.5 |
| LYM82 | 12203.5 | F | 6.54 | 4.30E−05 | 48.4 | LYM162 | 12233.2 | D | 5.095 | 1.13E−03 | 54.9 |
| LYM82 | 12203.2 | F | 6.366 | 2.44E−04 | 44.5 | LYM236 | 12591.1 | D | 8.655 | 1.52E−03 | 163.1 |
| LYM44 | 11884.3 | F | 5.875 | 6.63E−04 | 33.4 | LYM236 | 12594.3 | D | 7.796 | 2.20E−03 | 137 |
| LYM86 | 12182.3 | F | 5.586 | 2.72E−03 | 26.8 | LYM162 | 12234.3 | D | 5.023 | 2.44E−03 | 52.7 |
| LYM86 | 12183.3 | F | 5.724 | 3.20E−03 | 29.9 | LYM206 | 12603.2 | D | 8.33 | 2.58E−03 | 153.2 |
| LYM8 | 11983.1 | F | 5.556 | 3.24E−03 | 26.1 | LYM148 | 12173.1 | D | 4.692 | 2.92E−03 | 42.6 |
| LYM5 | 12436.1 | F | 5.831 | 3.79E−03 | 32.3 | LYM236 | 12592.3 | D | 8.564 | 2.99E−03 | 160.3 |
| LYM268 | 12484.2 | F | 5.898 | 5.85E−03 | 33.9 | LYM3 | 12041.2 | D | 5.083 | 3.81E−03 | 54.5 |
| LYM86 | 12181.2 | F | 5.396 | 7.40E−03 | 22.5 | LYM140 | 12261.4 | D | 5.321 | 3.93E−03 | 61.7 |
| LYM129 | 12572.2 | F | 5.555 | 8.48E−03 | 26.1 | LYM250 | 12613.2 | D | 8.022 | 4.46E−03 | 143.9 |
| LYM5 | 12432.2 | F | 5.252 | 2.59E−02 | 19.2 | LYM148 | 12171.2 | D | 7.076 | 4.80E−03 | 115.1 |
| LYM44 | 11882.1 | F | 5.409 | 3.28E−02 | 22.8 | LYM170 | 12453.2 | D | 6.92 | 5.21E−03 | 110.4 |
| LYM5 | 12432.1 | F | 5.116 | 3.85E−02 | 16.1 | LYM89 | 12214.3 | D | 5.75 | 6.25E−03 | 74.8 |
| LYM44 | 11885.4 | F | 5.085 | 4.84E−02 | 15.4 | LYM206 | 12603.3 | D | 6.599 | 8.50E−03 | 100.6 |
| LYM129 | 12573.1 | F | 5.082 | 5.14E−02 | 15.3 | LYM89 | 12214.2 | D | 6.285 | 1.03E−02 | 91 |
| LYM5 | 12436.2 | F | 5.772 | 5.31E−02 | 31 | LYM99 | 12244.2 | D | 5.742 | 1.05E−02 | 74.5 |
| LYM5 | 12435.1 | F | 5.498 | 6.21E−02 | 24.8 | LYM250 | 12614.1 | D | 6.308 | 1.09E−02 | 91.8 |
| LYM8 | 11982.6 | F | 5.089 | 7.04E−02 | 15.5 | LYM170 | 12452.3 | D | 7.21 | 1.17E−02 | 119.2 |
| LYM8 | 11984.1 | F | 5.999 | 9.59E−02 | 36.2 | LYM140 | 12261.2 | D | 5.41 | 1.38E−02 | 64.5 |
| CONTROL | — | F | 4.406 | — | 0 | LYM254 | 12472.3 | D | 5.268 | 1.47E−02 | 60.1 |
| LYM5 | 12436.1 | G | 0.638 | 1.29E−04 | 50.3 | LYM250 | 12611.3 | D | 5.796 | 1.51E−02 | 76.2 |
| LYM129 | 12573.1 | G | 0.849 | 1.56E−04 | 99.9 | LYM89 | 12214.1 | D | 6.21 | 1.65E−02 | 88.8 |
| LYM82 | 12203.5 | G | 0.847 | 2.51E−04 | 99.4 | LYM172 | 12302.2 | D | 6.672 | 1.89E−02 | 102.8 |
| LYM86 | 12183.3 | G | 0.687 | 4.03E−04 | 61.7 | LYM206 | 12602.1 | D | 7.772 | 1.91E−02 | 136.2 |
| LYM268 | 12482.1 | G | 0.603 | 5.49E−04 | 42 | LYM162 | 12231.1 | D | 7.885 | 1.92E−02 | 139.7 |
| LYM268 | 12483.4 | G | 1.054 | 6.89E−04 | 148 | LYM3 | 12041.1 | D | 4.684 | 2.07E−02 | 42.4 |
| LYM82 | 12201.2 | G | 0.643 | 1.52E−03 | 51.4 | LYM162 | 12231.2 | D | 7.359 | 2.76E−02 | 123.7 |
| LYM268 | 12484.2 | G | 0.768 | 1.52E−03 | 80.8 | LYM236 | 12592.4 | D | 6.224 | 2.84E−02 | 89.2 |
| LYM86 | 12183.1 | G | 0.602 | 2.17E−03 | 41.6 | LYM99 | 12244.1 | D | 5.467 | 2.84E−02 | 66.2 |
| LYM44 | 11882.1 | G | 0.544 | 4.43E−03 | 28.1 | LYM176 | 12385.1 | D | 7.503 | 2.87E−02 | 128.1 |
| LYM44 | 11885.3 | G | 0.552 | 4.98E−03 | 29.9 | LYM290 | 12501.2 | D | 4.367 | 2.94E−02 | 32.8 |
| LYM82 | 12204.6 | G | 0.558 | 7.03E−03 | 31.3 | LYM148 | 12172.1 | D | 4.711 | 3.20E−02 | 43.2 |
| LYM129 | 12572.3 | G | 0.671 | 7.23E−03 | 57.9 | LYM170 | 12453.2 | D | 6.282 | 3.38E−02 | 91 |
| LYM44 | 11884.3 | G | 0.532 | 7.42E−03 | 25.3 | LYM250 | 12613.4 | D | 5.345 | 3.40E−02 | 62.5 |
| LYM5 | 12436.2 | G | 0.545 | 8.39E−03 | 28.2 | LYM89 | 12211.2 | D | 6.247 | 4.75E−02 | 89.9 |
| LYM8 | 11984.1 | G | 0.849 | 1.84E−02 | 99.8 | LYM89 | 12214.4 | D | 4.932 | 4.87E−02 | 49.9 |
| LYM86 | 12182.3 | G | 0.526 | 2.43E−02 | 23.7 | LYM42 | 11992.2 | D | 6.54 | 5.04E−02 | 98.8 |
| LYM6 | 11735.2 | G | 0.49 | 8.02E−02 | 15.4 | LYM148 | 12173.5 | D | 5.372 | 6.79E−02 | 63.3 |
| LYM82 | 12203.2 | G | 0.834 | 8.07E−02 | 96.2 | LYM254 | 12474.3 | D | 4.625 | 6.91E−02 | 40.6 |
| CONTROL | — | G | 0.425 | — | 0 | LYM290 | 12502.1 | D | 5.37 | 7.87E−02 | 63.2 |
| LYM129 | 12573.1 | H | 0.085 | 0.00E+00 | 100.9 | LYM206 | 12601.3 | D | 5.296 | 8.29E−02 | 61 |
| LYM268 | 12483.4 | H | 0.108 | 0.00E+00 | 156.5 | CONTROL | — | D | 3.29 | — | 0 |
| LYM8 | 11984.1 | H | 0.089 | 0.00E+00 | 110.3 | LYM236 | 12591.1 | E | 0.594 | 2.26E−03 | 47.4 |
| LYM82 | 12203.5 | H | 0.088 | 1.00E−06 | 108.4 | LYM172 | 12302.2 | E | 0.596 | 3.04E−03 | 47.9 |
| LYM268 | 12484.2 | H | 0.074 | 2.30E−05 | 75.8 | LYM176 | 12381.3 | E | 0.577 | 4.24E−03 | 43.2 |
| LYM86 | 12183.3 | H | 0.066 | 2.60E−04 | 56.3 | LYM140 | 12261.2 | E | 0.566 | 4.95E−03 | 40.6 |
| LYM268 | 12482.1 | H | 0.062 | 1.28E−03 | 46.3 | LYM99 | 12244.1 | E | 0.566 | 6.16E−03 | 40.6 |
| LYM129 | 12572.2 | H | 0.065 | 1.65E−03 | 53.7 | LYM172 | 12304.1 | E | 0.564 | 7.50E−03 | 40.1 |
| LYM82 | 12203.2 | H | 0.087 | 1.78E−03 | 106.5 | LYM170 | 12453.2 | E | 0.563 | 7.87E−03 | 39.8 |
| LYM5 | 12436.1 | H | 0.06 | 2.89E−03 | 41.7 | LYM170 | 12452.4 | E | 0.567 | 8.02E−03 | 40.8 |
| LYM86 | 12183.1 | H | 0.06 | 5.56E−03 | 41 | LYM254 | 12472.3 | E | 0.553 | 8.60E−03 | 37.2 |
| LYM5 | 12436.2 | H | 0.059 | 8.00E−03 | 39 | LYM148 | 12171.2 | E | 0.563 | 9.63E−03 | 39.9 |
| LYM82 | 12201.2 | H | 0.059 | 8.96E−03 | 40.3 | LYM206 | 12602.1 | E | 0.562 | 1.25E−02 | 39.6 |
| LYM82 | 12204.6 | H | 0.057 | 1.25E−02 | 34.6 | LYM99 | 12244.2 | E | 0.54 | 1.39E−02 | 34 |
| LYM44 | 11884.3 | H | 0.056 | 1.64E−02 | 32.6 | LYM236 | 12592.3 | E | 0.555 | 2.06E−02 | 37.7 |
| LYM268 | 12481.3 | H | 0.061 | 2.53E−02 | 44.7 | LYM250 | 12613.2 | E | 0.542 | 2.10E−02 | 34.5 |
| LYM44 | 11885.3 | H | 0.056 | 2.57E−02 | 33.6 | LYM254 | 12471.2 | E | 0.55 | 2.13E−02 | 36.6 |
| LYM44 | 11882.2 | H | 0.055 | 3.23E−02 | 29.4 | LYM206 | 12603.2 | E | 0.557 | 2.43E−02 | 38.4 |
| LYM5 | 12432.2 | H | 0.057 | 5.25E−02 | 34.7 | LYM170 | 12452.3 | E | 0.538 | 2.59E−02 | 33.7 |
| LYM86 | 12182.3 | H | 0.053 | 7.08E−02 | 24.8 | LYM89 | 12214.4 | E | 0.557 | 2.64E−02 | 38.2 |
| CONTROL | — | H | 0.042 | — | 0 | LYM236 | 12592.4 | E | 0.534 | 2.66E−02 | 32.6 |
| LYM89 | 12214.3 | A | 0.006 | 5.91E−04 | 43.4 | LYM206 | 12603.3 | E | 0.542 | 2.79E−02 | 34.5 |
| LYM250 | 12611.3 | A | 0.006 | 4.67E−03 | 44.1 | LYM172 | 12301.3 | E | 0.527 | 3.29E−02 | 30.7 |
| CONTROL | — | A | 0.004 | — | 0 | LYM172 | 12301.2 | E | 0.523 | 3.72E−02 | 29.8 |
| LYM250 | 12611.3 | C | 0.724 | 1.68E−02 | 39.6 | LYM148 | 12173.1 | E | 0.547 | 3.85E−02 | 35.7 |
| CONTROL | — | C | 0.519 | — | 0 | LYM89 | 12214.1 | E | 0.554 | 3.89E−02 | 37.6 |
| LYM250 | 12611.3 | D | 6.633 | 3.09E−02 | 40.5 | LYM89 | 12211.2 | E | 0.529 | 3.96E−02 | 31.3 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| CONTROL | — | D | 4.721 | — | 0 | LYM250 | 12614.1 | E | 0.535 | 4.14E−02 | 32.8 |
| LYM250 | 12611.3 | E | 0.531 | 7.01E−02 | 18.9 | LYM162 | 12231.1 | E | 0.54 | 4.51E−02 | 34.1 |
| CONTROL | — | E | 0.447 | — | 0 | LYM42 | 11992.2 | E | 0.528 | 5.37E−02 | 31.2 |
| LYM250 | 12611.3 | F | 6.627 | 1.48E−03 | 22.7 | LYM206 | 12601.3 | E | 0.51 | 6.40E−02 | 26.6 |
| LYM236 | 12591.1 | F | 6.197 | 1.53E−02 | 14.7 | LYM250 | 12611.3 | E | 0.525 | 6.99E−02 | 30.4 |
| LYM99 | 12243.2 | F | 6.22 | 2.59E−02 | 15.1 | LYM206 | 12604.3 | E | 0.503 | 7.47E−02 | 24.9 |
| CONTROL | — | F | 5.402 | — | 0 | LYM236 | 12594.3 | E | 0.51 | 8.71E−02 | 26.7 |
| LYM250 | 12611.3 | G | 0.633 | 4.48E−03 | 30.7 | LYM176 | 12385.1 | E | 0.526 | 8.97E−02 | 30.6 |
| LYM89 | 12214.3 | G | 0.632 | 3.84E−02 | 30.6 | LYM254 | 12471.1 | E | 0.513 | 9.45E−02 | 27.4 |
| CONTROL | — | G | 0.484 | — | 0 | LYM176 | 12384.1 | E | 0.507 | 9.46E−02 | 26 |
| LYM250 | 12611.3 | H | 0.066 | 4.26E−02 | 29.7 | CONTROL | — | E | 0.403 | — | 0 |
| CONTROL | — | H | 0.051 | — | 0 | LYM170 | 12453.2 | F | 7.246 | 1.00E−06 | 71.9 |
| LYM130 | 12332.1 | A | 0.008 | 7.52E−04 | 183.7 | LYM170 | 12452.4 | F | 7.207 | 1.00E−06 | 71 |
| LYM102 | 12222.1 | A | 0.006 | 1.71E−03 | 86.6 | LYM236 | 12591.1 | F | 7.239 | 1.00E−06 | 71.7 |
| LYM130 | 12334.1 | A | 0.007 | 2.90E−03 | 123.4 | LYM148 | 12171.2 | F | 6.951 | 3.00E−06 | 64.9 |
| LYM138 | 12561.3 | A | 0.005 | 3.10E−03 | 74.1 | LYM172 | 12301.3 | F | 7.006 | 3.00E−06 | 66.2 |
| LYM141 | 12404.2 | A | 0.006 | 8.08E−03 | 106.7 | LYM99 | 12244.2 | F | 6.7 | 3.00E−06 | 59 |
| LYM106 | 12142.2 | A | 0.004 | 1.83E−02 | 48.1 | LYM236 | 12381.2 | F | 7.089 | 4.00E−06 | 68.2 |
| LYM138 | 12566.1 | A | 0.004 | 1.99E−02 | 46.4 | LYM176 | 12384.1 | F | 7.171 | 3.30E−05 | 70.1 |
| LYM100 | 12133.3 | A | 0.005 | 2.31E−02 | 62.3 | LYM99 | 12244.1 | F | 6.715 | 3.40E−05 | 59.3 |
| LYM141 | 12404.3 | A | 0.008 | 3.47E−02 | 151 | LYM254 | 12472.3 | F | 6.573 | 3.80E−05 | 56 |
| LYM106 | 12144.3 | A | 0.005 | 3.82E−02 | 59 | LYM172 | 12304.1 | F | 6.852 | 4.90E−05 | 62.6 |
| LYM119 | 12462.1 | A | 0.004 | 6.49E−02 | 46.4 | LYM140 | 12261.2 | F | 6.623 | 5.40E−05 | 57.1 |
| LYM130 | 12331.3 | A | 0.004 | 7.03E−02 | 48.1 | LYM170 | 12452.3 | F | 6.777 | 6.70E−05 | 60.8 |
| LYM137 | 12152.1 | A | 0.008 | 7.19E−02 | 160.3 | LYM3 | 12041.1 | F | 6.228 | 7.30E−05 | 47.8 |
| LYM100 | 12131.2 | A | 0.004 | 7.74E−02 | 45.6 | LYM148 | 12173.1 | F | 6.639 | 7.60E−05 | 57.5 |
| LYM102 | 12221.2 | A | 0.007 | 8.15E−02 | 117.6 | LYM206 | 12603.2 | F | 7.105 | 1.19E−04 | 68.6 |
| LYM130 | 12332.1 | A | 0.004 | 9.91E−02 | 48.1 | LYM254 | 12471.1 | F | 6.781 | 1.27E−04 | 60.9 |
| CONTROL | — | A | 0.003 | — | 0 | LYM89 | 12214.2 | F | 7.108 | 1.46E−04 | 68.6 |
| LYM141 | 12404.2 | B | 0.134 | 1.20E−05 | 79 | LYM206 | 12603.2 | F | 5.793 | 2.05E−04 | 37.4 |
| LYM138 | 12561.3 | B | 0.114 | 2.78E−04 | 52.9 | LYM250 | 12613.2 | F | 6.782 | 2.08E−04 | 60.9 |
| LYM102 | 12222.1 | B | 0.113 | 9.40E−04 | 51.4 | LYM140 | 12261.4 | F | 6.079 | 2.18E−04 | 44.2 |
| LYM130 | 12332.1 | B | 0.117 | 7.14E−03 | 55.7 | LYM172 | 12301.2 | F | 6.317 | 2.83E−04 | 49.9 |
| LYM130 | 12332.2 | B | 0.189 | 1.06E−02 | 152.1 | LYM290 | 12501.2 | F | 5.648 | 3.03E−04 | 34 |
| LYM106 | 12142.2 | B | 0.104 | 1.16E−02 | 38.3 | LYM290 | 12501.3 | F | 6.472 | 3.12E−04 | 53.6 |
| LYM130 | 12334.1 | B | 0.176 | 1.48E−02 | 135 | LYM236 | 12594.3 | F | 7.033 | 3.99E−04 | 66.9 |
| LYM141 | 12404.3 | B | 0.155 | 3.07E−02 | 106.5 | LYM89 | 12211.2 | F | 6.813 | 4.03E−04 | 61.6 |
| LYM138 | 12566.1 | B | 0.1 | 3.93E−02 | 33.3 | LYM162 | 12231.1 | F | 7.203 | 5.06E−04 | 70.9 |
| LYM137 | 12152.1 | B | 0.164 | 4.75E−02 | 119.7 | LYM148 | 12172.1 | F | 5.789 | 5.46E−04 | 37.3 |
| LYM100 | 12131.2 | B | 0.108 | 5.45E−02 | 44.1 | LYM99 | 12241.1 | F | 5.77 | 6.25E−04 | 36.9 |
| LYM119 | 12462.1 | B | 0.11 | 6.36E−02 | 46.8 | LYM206 | 12602.1 | F | 6.96 | 6.53E−04 | 65.1 |
| LYM113 | 12444.5 | B | 0.144 | 6.90E−02 | 91.8 | LYM236 | 12592.4 | F | 6.741 | 7.46E−04 | 59.9 |
| CONTROL | — | B | 0.075 | — | 0 | LYM236 | 12592.3 | F | 6.471 | 8.01E−04 | 53.5 |
| LYM137 | 12153.1 | C | 0.75 | 3.30E−05 | 73.3 | LYM162 | 12231.2 | F | 6.805 | 8.61E−04 | 61.4 |
| LYM102 | 12222.1 | C | 0.681 | 3.41E−04 | 57.4 | LYM250 | 12613.4 | F | 6.196 | 1.05E−03 | 47 |
| LYM141 | 12404.3 | C | 0.739 | 1.80E−03 | 70.8 | LYM176 | 12385.1 | F | 6.842 | 1.76E−03 | 62.3 |
| LYM137 | 12152.1 | C | 0.63 | 2.56E−03 | 45.6 | LYM172 | 12302.2 | F | 6.851 | 1.79E−03 | 62.5 |
| LYM138 | 12561.3 | C | 0.615 | 2.31E−02 | 42.1 | LYM250 | 12614.1 | F | 6.733 | 1.94E−03 | 59.7 |
| LYM130 | 12332.2 | C | 0.588 | 2.32E−02 | 36 | LYM206 | 12603.3 | F | 6.666 | 1.97E−03 | 58.2 |
| LYM102 | 12221.2 | C | 0.578 | 5.38E−02 | 33.7 | LYM42 | 11992.2 | F | 6.765 | 2.50E−03 | 60.5 |
| LYM100 | 12133.3 | C | 0.555 | 5.62E−02 | 28.4 | LYM89 | 12214.1 | F | 6.519 | 2.76E−03 | 54.7 |
| LYM141 | 12404.2 | C | 0.547 | 7.44E−02 | 26.5 | LYM254 | 12471.2 | F | 6.589 | 2.87E−03 | 56.3 |
| CONTROL | — | C | 0.433 | — | 0 | LYM162 | 12234.3 | F | 5.858 | 3.38E−03 | 39 |
| LYM102 | 12222.1 | D | 5.942 | 1.65E−03 | 46.8 | LYM3 | 12041.2 | F | 5.203 | 3.62E−03 | 23.4 |
| LYM137 | 12152.1 | D | 5.648 | 2.45E−03 | 39.5 | LYM250 | 12611.3 | F | 6.664 | 3.93E−03 | 58.1 |
| LYM137 | 12153.1 | D | 6.551 | 2.59E−03 | 61.8 | LYM206 | 12601.3 | F | 5.605 | 5.24E−03 | 33 |
| LYM100 | 12133.3 | D | 5.099 | 5.27E−02 | 26 | LYM89 | 12214.3 | F | 5.837 | 6.12E−03 | 38.5 |
| LYM130 | 12332.2 | D | 5.253 | 6.20E−02 | 29.8 | LYM162 | 12233.2 | F | 5.958 | 8.02E−03 | 41.4 |
| CONTROL | — | D | 4.048 | — | 0 | LYM254 | 12474.3 | F | 5.758 | 8.41E−03 | 36.6 |
| LYM137 | 12153.1 | E | 0.569 | 1.28E−03 | 41.7 | LYM3 | 12043.2 | F | 4.993 | 1.23E−02 | 18.5 |
| LYM141 | 12404.3 | E | 0.559 | 1.44E−02 | 39.3 | LYM42 | 11992.1 | F | 5.514 | 1.45E−02 | 30.8 |
| LYM138 | 12561.3 | E | 0.51 | 3.15E−02 | 27 | LYM290 | 12502.1 | F | 5.909 | 2.95E−02 | 40.2 |
| LYM102 | 12222.1 | E | 0.501 | 4.11E−02 | 24.8 | LYM148 | 12173.1 | F | 6.086 | 3.14E−02 | 44.4 |
| LYM100 | 12133.3 | E | 0.493 | 5.35E−02 | 22.9 | LYM206 | 12604.3 | F | 4.959 | 4.80E−02 | 17.7 |
| CONTROL | — | E | 0.401 | — | 0 | LYM148 | 12174.1 | F | 4.971 | 6.23E−02 | 17.9 |
| LYM138 | 12561.3 | F | 6.649 | 2.18E−03 | 31.5 | LYM99 | 12243.2 | F | 5.675 | 6.51E−02 | 34.6 |
| LYM100 | 12133.3 | F | 6.469 | 2.22E−03 | 27.9 | LYM140 | 12262.3 | F | 5.437 | 8.77E−02 | 29 |
| LYM138 | 12562.1 | F | 5.957 | 5.93E−03 | 17.8 | LYM42 | 11994.1 | F | 5.068 | 9.11E−02 | 20.2 |
| LYM102 | 12222.1 | F | 6.27 | 6.30E−03 | 24 | CONTROL | — | F | 4.215 | — | 0 |
| LYM137 | 12153.1 | F | 6.743 | 9.51E−03 | 33.3 | LYM254 | 12471.1 | G | 0.773 | 3.00E−06 | 72.9 |
| LYM113 | 12444.5 | F | 5.957 | 1.07E−02 | 17.8 | LYM99 | 12244.2 | G | 0.569 | 1.23E−03 | 27.3 |
| LYM102 | 12221.2 | F | 5.892 | 1.12E−02 | 16.5 | LYM206 | 12601.3 | G | 0.63 | 1.78E−03 | 40.9 |
| LYM137 | 12152.1 | F | 5.949 | 1.63E−02 | 17.6 | LYM170 | 12452.3 | G | 1.024 | 2.21E−03 | 129 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM119 | 12461.4 | F | 5.793 | 2.27E−02 | 14.5 | LYM176 | 12384.1 | G | 0.675 | 2.30E−03 | 51 |
| LYM130 | 12332.2 | F | 5.638 | 4.49E−02 | 11.5 | LYM250 | 12613.2 | G | 0.886 | 2.49E−03 | 98.2 |
| LYM113 | 12443.1 | F | 5.681 | 8.19E−02 | 12.3 | LYM42 | 11992.2 | G | 0.688 | 4.52E−03 | 53.8 |
| CONTROL | — | F | 5.058 | — | 0 | LYM172 | 12301.2 | G | 0.555 | 4.63E−03 | 24.2 |
| LYM102 | 12222.1 | G | 0.641 | 5.60E−03 | 61.2 | LYM236 | 12594.3 | G | 0.923 | 4.63E−03 | 106.6 |
| LYM138 | 12561.3 | G | 0.563 | 7.37E−03 | 41.4 | LYM162 | 12231.1 | G | 0.704 | 5.43E−03 | 57.5 |
| LYM130 | 12332.2 | G | 0.733 | 8.67E−03 | 84.3 | LYM148 | 12171.2 | G | 0.744 | 6.77E−03 | 66.5 |
| LYM137 | 12152.1 | G | 0.752 | 1.54E−02 | 88.9 | LYM236 | 12592.3 | G | 1.063 | 6.78E−03 | 137.7 |
| LYM141 | 12404.2 | G | 0.538 | 2.41E−02 | 35.3 | LYM172 | 12304.1 | G | 0.623 | 7.31E−03 | 39.4 |
| LYM138 | 12566.1 | G | 0.5 | 2.70E−02 | 25.7 | LYM206 | 12603.2 | G | 0.749 | 9.52E−03 | 67.5 |
| LYM130 | 12334.1 | G | 0.544 | 4.27E−02 | 36.6 | LYM176 | 12385.1 | G | 0.997 | 1.09E−02 | 123.1 |
| LYM143 | 12521.2 | G | 0.478 | 7.49E−02 | 20.2 | LYM250 | 12614.2 | G | 0.572 | 1.38E−02 | 27.9 |
| LYM138 | 12562.1 | G | 0.476 | 9.14E−02 | 19.7 | LYM89 | 12214.2 | G | 0.547 | 1.62E−02 | 22.4 |
| CONTROL | — | G | 0.398 | — | 0 | LYM250 | 12613.4 | G | 0.681 | 1.94E−02 | 52.3 |
| LYM141 | 12404.3 | H | 0.077 | 5.80E−05 | 96.5 | LYM170 | 12452.4 | G | 0.76 | 2.00E−02 | 70 |
| LYM102 | 12222.1 | H | 0.065 | 8.00E−05 | 65.8 | LYM89 | 12211.2 | G | 0.714 | 2.05E−02 | 59.8 |
| LYM137 | 12152.1 | H | 0.073 | 8.50E−05 | 85.8 | LYM140 | 12261.4 | G | 0.701 | 2.10E−02 | 56.9 |
| LYM130 | 12332.2 | H | 0.068 | 9.70E−05 | 73.7 | LYM170 | 12453.2 | G | 0.642 | 2.18E−02 | 43.5 |
| LYM137 | 12153.1 | H | 0.066 | 1.26E−03 | 66.9 | LYM140 | 12262.2 | G | 0.569 | 2.43E−02 | 27.3 |
| LYM138 | 12561.3 | H | 0.054 | 1.01E−02 | 37.1 | LYM170 | 12453.3 | G | 0.909 | 2.78E−02 | 103.3 |
| LYM141 | 12404.2 | H | 0.053 | 1.35E−02 | 34.4 | LYM236 | 12591.1 | G | 0.874 | 2.83E−02 | 95.5 |
| LYM102 | 12221.1 | H | 0.058 | 1.40E−02 | 46.1 | LYM89 | 12214.4 | G | 0.537 | 2.84E−02 | 20.2 |
| LYM130 | 12334.1 | H | 0.052 | 3.72E−02 | 30.7 | LYM99 | 12243.1 | G | 0.623 | 3.48E−02 | 39.3 |
| LYM138 | 12562.1 | H | 0.05 | 4.54E−02 | 26 | LYM89 | 12214.3 | G | 0.636 | 4.21E−02 | 42.2 |
| LYM138 | 12566.1 | H | 0.048 | 7.16E−02 | 22.8 | LYM176 | 12384.2 | G | 0.591 | 4.33E−02 | 32.1 |
| LYM100 | 12133.3 | H | 0.049 | 7.66E−02 | 25.2 | LYM206 | 12603.2 | G | 0.585 | 4.64E−02 | 31 |
| LYM106 | 12144.3 | H | 0.049 | 8.55E−02 | 24 | LYM140 | 12261.2 | G | 0.51 | 5.15E−02 | 14 |
| CONTROL | — | H | 0.039 | — | 0 | LYM176 | 12382.2 | G | 0.585 | 5.38E−02 | 30.8 |
| LYM153 | 12321.2 | A | 0.012 | 9.21E−03 | 102.4 | LYM42 | 11992.1 | G | 0.641 | 5.45E−02 | 43.4 |
| LYM152 | 12376.1 | A | 0.011 | 4.22E−02 | 75.2 | LYM148 | 12173.5 | G | 0.673 | 5.74E−02 | 50.6 |
| LYM148 | 12174.1 | A | 0.008 | 5.19E−02 | 28.7 | LYM89 | 12214.1 | G | 0.631 | 5.75E−02 | 41.2 |
| LYM140 | 12262.2 | A | 0.008 | 9.10E−02 | 23.8 | LYM206 | 12602.1 | G | 0.732 | 5.75E−02 | 63.6 |
| CONTROL | — | A | 0.006 | — | 0 | LYM254 | 12473.1 | G | 0.568 | 5.82E−02 | 27 |
| LYM153 | 12321.2 | B | 0.245 | 2.61E−03 | 69.9 | LYM3 | 12041.2 | G | 0.665 | 6.39E−02 | 48.8 |
| LYM152 | 12376.1 | B | 0.203 | 8.19E−02 | 40.9 | LYM42 | 11993.1 | G | 0.528 | 6.87E−02 | 18.2 |
| CONTROL | — | B | 0.144 | — | 0 | LYM172 | 12301.3 | G | 0.549 | 8.21E−02 | 22.8 |
| LYM152 | 12376.1 | C | 1.184 | 0.00E+00 | 138.6 | LYM176 | 12381.3 | G | 0.563 | 8.39E−02 | 26 |
| LYM153 | 12321.2 | C | 1.041 | 1.30E−05 | 109.9 | LYM290 | 12504.1 | G | 0.659 | 8.59E−02 | 47.4 |
| LYM170 | 12452.3 | C | 0.84 | 2.70E−05 | 69.4 | CONTROL | — | G | 0.447 | — | 0 |
| LYM149 | 12344.2 | C | 0.829 | 5.50E−05 | 67.1 | LYM170 | 12452.3 | H | 0.099 | 0.00E+00 | 113.2 |
| LYM172 | 12301.2 | C | 0.905 | 6.80E−05 | 82.3 | LYM236 | 12592.3 | H | 0.109 | 0.00E+00 | 135.8 |
| LYM174 | 12412.1 | C | 0.809 | 9.50E−05 | 63.2 | LYM250 | 12613.2 | H | 0.088 | 0.00E+00 | 90.5 |
| LYM153 | 12322.1 | C | 0.877 | 1.92E−04 | 76.8 | LYM236 | 12594.3 | H | 0.088 | 1.00E−06 | 89 |
| LYM172 | 12301.3 | C | 0.86 | 2.07E−04 | 73.3 | LYM254 | 12471.1 | H | 0.077 | 1.00E−06 | 64.9 |
| LYM176 | 12381.3 | C | 0.781 | 3.32E−04 | 57.5 | LYM176 | 12385.1 | H | 0.096 | 6.00E−06 | 106.2 |
| LYM170 | 12454.2 | C | 0.766 | 5.34E−04 | 54.4 | LYM206 | 12603.2 | H | 0.078 | 1.20E−05 | 68.2 |
| LYM174 | 12411.3 | C | 0.748 | 1.82E−03 | 50.8 | LYM170 | 12453.3 | H | 0.092 | 7.00E−05 | 97.6 |
| LYM162 | 12234.4 | C | 0.743 | 2.64E−03 | 49.7 | LYM170 | 12452.4 | H | 0.078 | 8.10E−05 | 67.9 |
| LYM289 | 12493.2 | C | 0.747 | 3.09E−03 | 50.6 | LYM236 | 12591.1 | H | 0.087 | 1.34E−04 | 87.2 |
| LYM174 | 12411.2 | C | 0.785 | 4.17E−03 | 58.3 | LYM162 | 12231.1 | H | 0.071 | 2.54E−04 | 52.4 |
| LYM111 | 12254.5 | C | 0.764 | 4.75E−03 | 54 | LYM89 | 12211.2 | H | 0.071 | 5.66E−04 | 52 |
| LYM148 | 12174.1 | C | 0.725 | 5.96E−03 | 46.1 | LYM42 | 11992.2 | H | 0.066 | 5.77E−04 | 43 |
| LYM162 | 12234.3 | C | 0.733 | 1.17E−02 | 47.7 | LYM206 | 12601.3 | H | 0.065 | 6.02E−04 | 39.1 |
| LYM148 | 12171.2 | C | 0.684 | 2.29E−02 | 37.8 | LYM148 | 12171.2 | H | 0.069 | 9.52E−04 | 49.3 |
| LYM105 | 12293.1 | C | 0.658 | 2.67E−02 | 32.6 | LYM176 | 12384.1 | H | 0.066 | 1.86E−03 | 42.7 |
| LYM162 | 12231.2 | C | 0.68 | 2.78E−02 | 37.1 | LYM206 | 12602.1 | H | 0.073 | 2.16E−03 | 58.3 |
| LYM174 | 12414.3 | C | 0.65 | 5.52E−02 | 30.9 | LYM172 | 12304.1 | H | 0.063 | 2.61E−03 | 36.2 |
| LYM170 | 12452.4 | C | 0.636 | 5.67E−02 | 28.2 | LYM250 | 12613.4 | H | 0.066 | 2.68E−03 | 43 |
| LYM153 | 12323.2 | C | 0.684 | 5.84E−02 | 37.9 | LYM170 | 12453.2 | H | 0.064 | 3.33E−03 | 38.6 |
| LYM148 | 12173.5 | C | 0.652 | 6.99E−02 | 31.4 | LYM140 | 12261.4 | H | 0.066 | 4.14E−03 | 41.3 |
| LYM290 | 12502.4 | C | 0.635 | 7.97E−02 | 28.1 | LYM99 | 12243.1 | H | 0.063 | 6.82E−03 | 35.1 |
| LYM254 | 12474.4 | C | 0.617 | 8.58E−02 | 24.4 | LYM99 | 12244.2 | H | 0.059 | 7.05E−03 | 27.3 |
| LYM148 | 12173.1 | C | 0.632 | 9.21E−02 | 27.3 | LYM89 | 12214.1 | H | 0.065 | 7.10E−03 | 40.5 |
| CONTROL | — | C | 0.496 | — | 0 | LYM206 | 12603.3 | H | 0.061 | 8.74E−03 | 31.6 |
| LYM152 | 12376.1 | D | 10.184 | 0.00E+00 | 134.7 | LYM250 | 12614.2 | H | 0.06 | 9.60E−03 | 29.4 |
| LYM170 | 12452.3 | D | 7.08 | 7.80E−05 | 63.2 | LYM42 | 11992.1 | H | 0.064 | 1.49E−02 | 37.4 |
| LYM176 | 12381.3 | D | 6.67 | 2.52E−04 | 53.7 | LYM254 | 12473.1 | H | 0.06 | 1.84E−02 | 28.6 |
| LYM149 | 12344.2 | D | 7.182 | 2.74E−04 | 65.5 | LYM290 | 12504.1 | H | 0.065 | 2.04E−02 | 39.9 |
| LYM174 | 12412.1 | D | 6.751 | 3.53E−04 | 55.6 | LYM89 | 12214.3 | H | 0.061 | 3.34E−02 | 30.8 |
| LYM170 | 12454.2 | D | 6.626 | 3.98E−04 | 52.7 | LYM172 | 12301.2 | H | 0.057 | 3.68E−02 | 22.3 |
| LYM174 | 12411.3 | D | 6.497 | 3.90E−03 | 49.7 | LYM42 | 11993.1 | H | 0.058 | 3.99E−02 | 24.2 |
| LYM289 | 12493.2 | D | 6.469 | 8.75E−03 | 49.1 | LYM89 | 12214.4 | H | 0.057 | 4.67E−02 | 22.5 |
| LYM162 | 12234.4 | D | 6.253 | 1.01E−02 | 44.1 | LYM148 | 12173.5 | H | 0.062 | 4.81E−02 | 33.2 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM105 | 12293.1 | D | 5.67 | 1.26E−02 | 30.7 | LYM140 | 12261.2 | H | 0.056 | 5.27E−02 | 19.9 |
| LYM172 | 12301.3 | D | 7.412 | 1.63E−02 | 70.8 | LYM236 | 12592.4 | H | 0.061 | 6.49E−02 | 30.4 |
| LYM172 | 12301.2 | D | 7.674 | 1.83E−02 | 76.9 | LYM250 | 12614.1 | H | 0.055 | 9.32E−02 | 19.6 |
| LYM153 | 12321.2 | D | 8.901 | 1.85E−02 | 105.2 | LYM176 | 12381.3 | H | 0.056 | 9.61E−02 | 20.1 |
| LYM153 | 12322.1 | D | 7.58 | 2.24E−02 | 74.7 | LYM290 | 12501.3 | H | 0.063 | 9.74E−02 | 35.7 |
| LYM148 | 12174.1 | D | 6.39 | 2.38E−02 | 47.3 | CONTROL | — | H | 0.046 | — | 0 |
| LYM254 | 12474.4 | D | 5.377 | 2.95E−02 | 23.9 | LYM90 | 12392.1 | A | 0.005 | 1.00E−06 | 108.9 |
| LYM111 | 12254.3 | D | 6.642 | 3.13E−02 | 53.1 | LYM213 | 12842.9 | A | 0.004 | 5.60E−05 | 48.5 |
| LYM170 | 12452.4 | D | 5.438 | 5.31E−02 | 25.3 | LYM107 | 12633.4 | A | 0.006 | 1.12E−04 | 153.5 |
| LYM148 | 12171.2 | D | 6.008 | 5.50E−02 | 38.5 | LYM157 | 13341.1 | A | 0.006 | 1.62E−03 | 130.7 |
| LYM174 | 12411.2 | D | 6.703 | 6.07E−02 | 54.5 | LYM90 | 12394.2 | A | 0.005 | 2.24E−03 | 78.2 |
| LYM162 | 12231.2 | D | 5.948 | 7.11E−02 | 37.1 | LYM107 | 12631.4 | A | 0.005 | 9.45E−03 | 104 |
| LYM162 | 12234.3 | D | 6.319 | 8.38E−02 | 45.6 | LYM180 | 13441.7 | A | 0.004 | 1.15E−02 | 58.4 |
| LYM172 | 12304.2 | D | 5.126 | 9.20E−02 | 18.2 | LYM90 | 12395.3 | A | 0.005 | 1.27E−02 | 115.8 |
| CONTROL | — | D | 4.339 | — | 0 | LYM248 | 13501.6 | A | 0.004 | 1.40E−02 | 74.3 |
| LYM176 | 12381.3 | E | 0.57 | 2.35E−02 | 42.8 | LYM52 | 12895.7 | A | 0.005 | 1.64E−02 | 87.1 |
| LYM172 | 12301.2 | E | 0.563 | 3.24E−02 | 41.1 | LYM52 | 12894.6 | A | 0.005 | 2.41E−02 | 93.1 |
| LYM174 | 12412.1 | E | 0.56 | 3.53E−02 | 40.3 | LYM213 | 12841.8 | A | 0.007 | 2.71E−02 | 161.4 |
| LYM153 | 12322.1 | E | 0.547 | 5.02E−02 | 37.1 | LYM68 | 11942.2 | A | 0.004 | 3.03E−02 | 77.2 |
| LYM254 | 12474.4 | E | 0.545 | 5.08E−02 | 36.5 | LYM157 | 13341.3 | A | 0.007 | 3.06E−02 | 193.1 |
| LYM111 | 12254.3 | E | 0.542 | 6.45E−02 | 35.8 | LYM180 | 13441.5 | A | 0.003 | 3.17E−02 | 20.8 |
| LYM170 | 12454.2 | E | 0.537 | 6.57E−02 | 34.5 | LYM52 | 12891.8 | A | 0.007 | 3.60E−02 | 183.2 |
| LYM172 | 12301.3 | E | 0.543 | 6.79E−02 | 36.1 | LYM68 | 11943.5 | A | 0.004 | 3.69E−02 | 46.5 |
| LYM148 | 12174.1 | E | 0.535 | 6.85E−02 | 34 | LYM213 | 12841.6 | A | 0.008 | 3.70E−02 | 235.6 |
| LYM152 | 12376.1 | E | 0.543 | 7.05E−02 | 36.1 | LYM117 | 13622.6 | A | 0.005 | 4.17E−02 | 85.1 |
| LYM174 | 12411.2 | E | 0.535 | 7.56E−02 | 34.1 | LYM117 | 13621.8 | A | 0.004 | 4.82E−02 | 57.4 |
| LYM153 | 12321.2 | E | 0.543 | 7.70E−02 | 36.1 | LYM52 | 12894.8 | A | 0.008 | 5.80E−02 | 217.8 |
| LYM170 | 12452.3 | E | 0.53 | 8.57E−02 | 32.8 | LYM68 | 11941.3 | A | 0.004 | 5.93E−02 | 41.6 |
| LYM148 | 12171.2 | E | 0.523 | 9.20E−02 | 31.1 | LYM248 | 13502.7 | A | 0.004 | 6.41E−02 | 65.3 |
| CONTROL | — | E | 0.399 | — | 0 | LYM117 | 13624.4 | A | 0.004 | 7.16E−02 | 72.3 |
| LYM149 | 12344.2 | F | 6.801 | 1.57E−03 | 33.2 | LYM52 | 12894.7 | A | 0.006 | 7.32E−02 | 152.5 |
| LYM152 | 12376.1 | F | 7.023 | 1.62E−03 | 37.5 | LYM157 | 13341.4 | A | 0.005 | 7.51E−02 | 106.9 |
| LYM148 | 12171.2 | F | 6.663 | 2.42E−03 | 30.5 | LYM213 | 12841.7 | A | 0.005 | 8.38E−02 | 114.9 |
| LYM254 | 12474.4 | F | 6.671 | 2.45E−03 | 30.7 | LYM180 | 13443.7 | A | 0.003 | 8.44E−02 | 28.7 |
| LYM174 | 12412.1 | F | 6.791 | 2.67E−03 | 33 | LYM180 | 13442.6 | A | 0.005 | 9.89E−02 | 50.5 |
| LYM170 | 12454.2 | F | 6.641 | 2.92E−03 | 30.1 | CONTROL | — | A | 0.003 | — | 0 |
| LYM170 | 12452.3 | F | 6.742 | 3.91E−03 | 32 | LYM90 | 12392.1 | B | 0.152 | 1.06E−03 | 81.1 |
| LYM172 | 12301.3 | F | 6.706 | 5.41E−03 | 31.3 | LYM107 | 12631.4 | B | 0.136 | 2.69E−03 | 61.9 |
| LYM148 | 12174.1 | F | 6.449 | 5.65E−03 | 26.3 | LYM90 | 12395.3 | B | 0.135 | 5.72E−03 | 60.8 |
| LYM153 | 12321.2 | F | 6.678 | 5.68E−03 | 30.8 | LYM157 | 13341.1 | B | 0.146 | 1.69E−02 | 73.9 |
| LYM153 | 12322.1 | F | 6.443 | 5.80E−03 | 26.2 | LYM213 | 12841.6 | B | 0.203 | 1.93E−02 | 141.6 |
| LYM176 | 12381.3 | F | 6.442 | 5.82E−03 | 26.2 | LYM117 | 13621.8 | B | 0.105 | 2.79E−02 | 24.6 |
| LYM289 | 12493.2 | F | 6.37 | 7.79E−03 | 24.8 | LYM107 | 12633.4 | B | 0.144 | 3.61E−02 | 71.1 |
| LYM172 | 12301.2 | F | 6.401 | 8.13E−03 | 25.4 | LYM68 | 11942.2 | B | 0.111 | 4.71E−02 | 31.8 |
| LYM174 | 12414.3 | F | 6.259 | 1.53E−02 | 22.6 | LYM52 | 12894.6 | B | 0.131 | 4.73E−02 | 55.6 |
| LYM174 | 12411.2 | F | 6.338 | 1.62E−02 | 24.1 | LYM52 | 12894.8 | B | 0.184 | 4.84E−02 | 118.7 |
| LYM148 | 12173.5 | F | 6.268 | 1.64E−02 | 22.7 | LYM157 | 13341.3 | B | 0.165 | 5.02E−02 | 96.8 |
| LYM140 | 12262.3 | F | 6.2 | 1.65E−02 | 21.4 | LYM52 | 12894.7 | B | 0.164 | 5.10E−02 | 94.7 |
| LYM111 | 12254.3 | F | 6.352 | 1.66E−02 | 24.4 | LYM52 | 12891.8 | B | 0.147 | 5.39E−02 | 75.3 |
| LYM176 | 12384.1 | F | 6.087 | 2.67E−02 | 19.2 | LYM90 | 12394.2 | B | 0.11 | 5.40E−02 | 30.6 |
| LYM170 | 12453.2 | F | 6.098 | 3.46E−02 | 19.4 | LYM52 | 12895.7 | B | 0.15 | 5.54E−02 | 78.1 |
| LYM111 | 12252.2 | F | 6.029 | 3.90E−02 | 18.1 | LYM248 | 13502.7 | B | 0.12 | 6.58E−02 | 43.3 |
| LYM162 | 12234.4 | F | 5.98 | 4.10E−02 | 17.1 | LYM213 | 12842.9 | B | 0.099 | 6.68E−02 | 17.3 |
| LYM153 | 12323.2 | F | 6.035 | 4.13E−02 | 18.2 | LYM117 | 13622.6 | B | 0.136 | 6.92E−02 | 61.7 |
| LYM162 | 12234.3 | F | 6.276 | 4.14E−02 | 22.9 | LYM213 | 12841.8 | B | 0.186 | 9.20E−02 | 121.5 |
| LYM170 | 12452.3 | F | 5.96 | 4.49E−02 | 16.7 | CONTROL | — | B | 0.084 | — | 0 |
| LYM149 | 12343.2 | F | 6.255 | 5.80E−02 | 22.5 | LYM107 | 12633.4 | C | 0.991 | 0.00E+00 | 94.3 |
| LYM162 | 12231.2 | F | 6.019 | 6.32E−02 | 17.9 | LYM107 | 12631.4 | C | 0.944 | 0.00E+00 | 85.1 |
| LYM152 | 12373.2 | F | 5.846 | 7.37E−02 | 14.5 | LYM52 | 12894.6 | C | 1.012 | 0.00E+00 | 98.3 |
| LYM289 | 12493.6 | F | 5.787 | 9.53E−02 | 13.3 | LYM52 | 12891.8 | C | 0.928 | 0.00E+00 | 81.9 |
| CONTROL | — | F | 5.106 | — | 0 | LYM68 | 11942.2 | C | 0.98 | 0.00E+00 | 92.1 |
| LYM152 | 12376.1 | G | 0.993 | 4.96E−04 | 50.8 | LYM52 | 12894.8 | C | 0.954 | 1.00E−06 | 87 |
| LYM153 | 12321.2 | G | 1.048 | 4.01E−03 | 59.2 | LYM213 | 12841.6 | C | 0.87 | 3.00E−06 | 70.5 |
| LYM148 | 12174.1 | G | 0.916 | 6.30E−03 | 39.2 | LYM90 | 12392.1 | C | 0.869 | 1.10E−05 | 70.4 |
| LYM290 | 12502.4 | G | 0.799 | 4.73E−02 | 21.3 | LYM157 | 13341.3 | C | 0.936 | 3.10E−05 | 83.5 |
| LYM172 | 12301.2 | G | 0.862 | 5.63E−02 | 30.9 | LYM157 | 13341.1 | C | 0.823 | 1.04E−04 | 61.3 |
| LYM140 | 12262.2 | G | 0.814 | 8.61E−02 | 23.6 | LYM90 | 12395.3 | C | 0.82 | 1.17E−04 | 60.6 |
| LYM174 | 12411.3 | G | 0.867 | 9.28E−02 | 31.7 | LYM157 | 13341.4 | C | 0.812 | 1.51E−04 | 59.2 |
| CONTROL | — | G | 0.658 | — | 0 | LYM90 | 12394.2 | C | 0.779 | 2.54E−04 | 52.8 |
| LYM152 | 12376.1 | H | 0.103 | 1.39E−04 | 65.4 | LYM68 | 11941.4 | C | 0.788 | 3.36E−04 | 54.5 |
| LYM153 | 12321.2 | H | 0.106 | 2.48E−04 | 69.7 | LYM248 | 13501.6 | C | 0.784 | 5.63E−04 | 53.7 |
| LYM172 | 12301.2 | H | 0.088 | 1.64E−02 | 41 | LYM107 | 12631.1 | C | 0.764 | 6.45E−04 | 49.7 |
| LYM148 | 12174.1 | H | 0.086 | 1.81E−02 | 38.1 | LYM117 | 13622.6 | C | 0.74 | 1.38E−03 | 45.1 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM174 | 12411.3 | H | 0.085 | 4.51E−02 | 36.4 | LYM52 | 12895.7 | C | 0.724 | 2.87E−03 | 42 |
| CONTROL | — | H | 0.063 | — | 0 | LYM52 | 12894.7 | C | 0.741 | 3.13E−03 | 45.2 |
| LYM175 | 12651.2 | A | 0.005 | 1.27E−03 | 85.3 | LYM90 | 12393.1 | C | 0.728 | 8.19E−03 | 42.6 |
| LYM107 | 12632.1 | A | 0.005 | 7.98E−03 | 96.3 | LYM157 | 13342.4 | C | 0.71 | 1.13E−02 | 39.2 |
| LYM203 | 12663.2 | A | 0.006 | 1.07E−02 | 104.6 | LYM107 | 12631.2 | C | 0.671 | 2.27E−02 | 31.6 |
| LYM128 | 12642.1 | A | 0.004 | 3.17E−02 | 53.2 | LYM213 | 12841.7 | C | 0.68 | 2.56E−02 | 33.4 |
| LYM128 | 12641.3 | A | 0.004 | 5.95E−02 | 64.2 | LYM68 | 11942.3 | C | 0.679 | 3.65E−02 | 33 |
| LYM175 | 12654.4 | A | 0.004 | 7.53E−02 | 47.7 | LYM90 | 12395.1 | C | 0.676 | 5.36E−02 | 32.6 |
| CONTROL | — | A | 0.003 | — | 0 | LYM68 | 11941.3 | C | 0.644 | 5.48E−02 | 26.2 |
| LYM107 | 12631.1 | B | 0.092 | 9.39E−03 | 28.3 | LYM248 | 13503.5 | C | 0.647 | 6.20E−02 | 26.8 |
| LYM175 | 12654.4 | B | 0.112 | 1.18E−02 | 55.8 | LYM117 | 13621.8 | C | 0.647 | 6.25E−02 | 26.8 |
| LYM203 | 12663.2 | B | 0.122 | 1.66E−02 | 69.5 | LYM117 | 13624.7 | C | 0.636 | 7.06E−02 | 24.6 |
| LYM107 | 12632.1 | B | 0.125 | 2.43E−02 | 73.7 | LYM117 | 13623.9 | C | 0.629 | 9.82E−02 | 23.2 |
| LYM175 | 12651.2 | B | 0.117 | 2.91E−02 | 62.4 | CONTROL | — | C | 0.51 | — | — |
| LYM128 | 12642.1 | B | 0.096 | 3.18E−02 | 33.2 | LYM213 | 12841.6 | D | 7.638 | 4.50E−05 | 69.8 |
| LYM128 | 12641.3 | B | 0.096 | 6.27E−02 | 33.4 | LYM117 | 13622.6 | D | 6.219 | 9.60E−05 | 38.3 |
| LYM203 | 12662.2 | B | 0.15 | 7.88E−02 | 108.2 | LYM107 | 12631.2 | D | 5.852 | 3.86E−04 | 30.1 |
| CONTROL | — | B | 0.072 | — | 0 | LYM68 | 11942.3 | D | 8.371 | 4.18E−04 | 86.1 |
| LYM128 | 12642.1 | C | 0.59 | 4.98E−04 | 67 | LYM52 | 12891.8 | D | 8.048 | 4.29E−04 | 78.9 |
| LYM203 | 12663.2 | C | 0.496 | 2.37E−02 | 40.5 | LYM90 | 12394.2 | D | 6.751 | 1.42E−03 | 50.1 |
| LYM203 | 12662.2 | C | 0.529 | 5.42E−02 | 49.7 | LYM107 | 12631.1 | D | 6.531 | 2.91E−03 | 45.2 |
| LYM128 | 12641.3 | C | 0.447 | 7.46E−02 | 26.7 | LYM52 | 12895.7 | D | 6.183 | 5.76E−03 | 37.5 |
| LYM107 | 12631.2 | C | 0.482 | 8.17E−02 | 36.6 | LYM52 | 12894.6 | D | 8.572 | 6.41E−03 | 90.6 |
| CONTROL | — | C | 0.353 | — | 0 | LYM107 | 12631.4 | D | 8.249 | 7.31E−03 | 83.4 |
| LYM128 | 12642.1 | D | 5.098 | 4.34E−03 | 62 | LYM90 | 12392.1 | D | 7.586 | 1.12E−02 | 68.6 |
| LYM128 | 12641.3 | D | 4.176 | 1.25E−02 | 32.7 | LYM52 | 12894.8 | D | 8.228 | 1.31E−02 | 82.9 |
| LYM203 | 12663.2 | D | 4.266 | 7.47E−02 | 35.6 | LYM107 | 12633.4 | D | 8.644 | 1.42E−02 | 92.2 |
| CONTROL | — | D | 3.146 | — | 0 | LYM90 | 12395.3 | D | 7.12 | 1.67E−02 | 58.3 |
| LYM128 | 12641.3 | E | 0.447 | 9.19E−04 | 33 | LYM157 | 13341.4 | D | 7.114 | 1.98E−02 | 58.2 |
| LYM128 | 12641.5 | E | 0.433 | 3.42E−03 | 28.7 | LYM68 | 11941.4 | D | 6.663 | 2.04E−02 | 48.1 |
| LYM128 | 12642.1 | E | 0.44 | 4.86E−03 | 30.8 | LYM117 | 13624.7 | D | 5.482 | 2.19E−02 | 21.9 |
| LYM203 | 12663.2 | E | 0.413 | 2.97E−02 | 22.8 | LYM68 | 11941.3 | D | 5.578 | 2.27E−02 | 24 |
| LYM203 | 12662.2 | E | 0.404 | 3.66E−02 | 20.3 | LYM157 | 13341.1 | D | 7.026 | 2.67E−02 | 56.2 |
| LYM128 | 12641.1 | E | 0.414 | 8.08E−02 | 23.3 | LYM248 | 13501.6 | D | 6.809 | 3.00E−02 | 51.4 |
| CONTROL | — | E | 0.336 | — | 0 | LYM117 | 13621.8 | D | 5.703 | 4.86E−02 | 26.8 |
| LYM128 | 12642.1 | F | 6.012 | 8.60E−05 | 45.8 | LYM52 | 12894.7 | D | 6.314 | 5.92E−02 | 40.4 |
| LYM128 | 12641.3 | F | 5.479 | 1.32E−04 | 32.9 | LYM157 | 13341.3 | D | 8.092 | 7.45E−02 | 79.9 |
| LYM203 | 12663.2 | F | 5.07 | 7.26E−03 | 23 | LYM213 | 12841.7 | D | 6.062 | 8.34E−02 | 34.8 |
| LYM203 | 12664.1 | F | 4.699 | 7.69E−03 | 14 | LYM180 | 13443.7 | D | 5.259 | 8.41E−02 | 16.9 |
| LYM203 | 12662.2 | F | 5.041 | 1.20E−02 | 22.3 | LYM157 | 13342.4 | D | 6.143 | 8.49E−02 | 36.6 |
| LYM128 | 12641.5 | F | 4.686 | 1.21E−02 | 13.7 | CONTROL | — | D | 4.498 | — | 0 |
| LYM175 | 12651.4 | F | 4.802 | 1.96E−02 | 16.5 | LYM68 | 11941.4 | E | 0.616 | 1.55E−03 | 41.7 |
| LYM107 | 12632.3 | F | 4.573 | 3.01E−02 | 10.9 | LYM107 | 12631.1 | E | 0.598 | 3.20E−03 | 37.5 |
| LYM107 | 12631.2 | F | 5.325 | 7.35E−02 | 29.1 | LYM68 | 11942.2 | E | 0.593 | 4.66E−03 | 36.4 |
| LYM128 | 12641.1 | F | 5.151 | 7.83E−02 | 24.9 | LYM52 | 12894.6 | E | 0.596 | 4.93E−03 | 37.2 |
| CONTROL | — | F | 4.123 | — | 0 | LYM248 | 13503.5 | E | 0.588 | 5.03E−03 | 35.2 |
| LYM107 | 12632.1 | G | 0.525 | 1.77E−03 | 47.2 | LYM90 | 12393.1 | E | 0.587 | 5.49E−03 | 34.9 |
| LYM128 | 12642.1 | G | 0.568 | 2.05E−03 | 59.3 | LYM52 | 12895.7 | E | 0.586 | 5.79E−03 | 34.7 |
| LYM128 | 12641.3 | G | 0.519 | 4.67E−03 | 45.3 | LYM68 | 11941.3 | E | 0.586 | 6.68E−03 | 34.7 |
| LYM203 | 12663.2 | G | 0.583 | 1.40E−02 | 63.4 | LYM52 | 12894.8 | E | 0.579 | 9.24E−03 | 33.1 |
| LYM107 | 12631.2 | G | 0.447 | 4.06E−02 | 25.4 | LYM90 | 12394.2 | E | 0.569 | 1.49E−02 | 30.9 |
| LYM175 | 12651.2 | G | 0.568 | 5.89E−02 | 59.1 | LYM157 | 13341.3 | E | 0.554 | 2.88E−02 | 27.3 |
| LYM203 | 12662.2 | G | 0.609 | 5.96E−02 | 70.7 | LYM213 | 12841.6 | E | 0.553 | 2.96E−02 | 27.1 |
| CONTROL | — | G | 0.357 | — | 0 | LYM248 | 13501.6 | E | 0.558 | 3.17E−02 | 28.3 |
| LYM128 | 12642.1 | H | 0.057 | 4.93E−03 | 57.5 | LYM107 | 12633.4 | E | 0.546 | 4.23E−02 | 25.5 |
| LYM203 | 12663.2 | H | 0.056 | 9.28E−03 | 55.3 | LYM157 | 13341.1 | E | 0.545 | 4.29E−02 | 25.2 |
| LYM203 | 12662.2 | H | 0.06 | 1.20E−02 | 65 | LYM180 | 13441.7 | E | 0.541 | 5.32E−02 | 24.4 |
| LYM128 | 12641.3 | H | 0.051 | 2.49E−02 | 40.3 | LYM157 | 13341.4 | E | 0.54 | 5.93E−02 | 24.2 |
| LYM175 | 12651.2 | H | 0.056 | 2.52E−02 | 55.8 | LYM107 | 12631.2 | E | 0.539 | 6.08E−02 | 24 |
| LYM107 | 12632.1 | H | 0.051 | 2.94E−02 | 40.3 | LYM90 | 12392.1 | E | 0.533 | 8.04E−02 | 22.5 |
| CONTROL | — | H | 0.036 | — | 0 | LYM68 | 11942.3 | E | 0.526 | 9.63E−02 | 20.9 |
| LYM224 | 13435.3 | A | 0.007 | 0.00E+00 | 90.7 | CONTROL | — | E | 0.435 | — | 0 |
| LYM217 | 13182.1 | A | 0.009 | 9.40E−05 | 160 | LYM107 | 12633.4 | F | 7.251 | 0.00E+00 | 30.4 |
| LYM23 | 12783.5 | A | 0.007 | 6.40E−04 | 99 | LYM68 | 11942.2 | F | 7.607 | 0.00E+00 | 36.8 |
| LYM164 | 12813.5 | A | 0.01 | 1.20E−03 | 169 | LYM90 | 12393.1 | F | 7.206 | 0.00E+00 | 29.6 |
| LYM164 | 12813.8 | A | 0.009 | 2.03E−03 | 143.6 | LYM52 | 12894.8 | F | 6.932 | 3.00E−06 | 24.7 |
| LYM251 | 13073.8 | A | 0.007 | 3.58E−03 | 84.6 | LYM157 | 13341.3 | F | 6.854 | 1.40E−05 | 23.3 |
| LYM122 | 13712.3 | A | 0.005 | 3.83E−03 | 45.5 | LYM90 | 12394.2 | F | 6.941 | 1.40E−05 | 24.9 |
| LYM274 | 13414.2 | A | 0.009 | 4.46E−03 | 138.1 | LYM68 | 11941.3 | F | 7.082 | 7.00E−05 | 27.4 |
| LYM217 | 13181.11 | A | 0.009 | 4.68E−03 | 136.7 | LYM180 | 13441.5 | F | 6.596 | 8.70E−05 | 18.6 |
| LYM79 | 13132.2 | A | 0.01 | 6.39E−03 | 166.9 | LYM157 | 13341.4 | F | 6.805 | 1.05E−04 | 22.4 |
| LYM273 | 13721.3 | A | 0.011 | 7.17E−03 | 201.2 | LYM248 | 13503.5 | F | 7.13 | 1.31E−04 | 28.3 |
| LYM273 | 13721.1 | A | 0.007 | 8.18E−03 | 81.8 | LYM52 | 12895.7 | F | 6.936 | 2.60E−04 | 24.8 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM249 | 13631.1 | A | 0.006 | 8.20E-03 | 64.7 | LYM90 | 12395.3 | F | 6.747 | 7.99E-04 | 21.4 |
| LYM23 | 12783.7 | A | 0.01 | 8.56E-03 | 162.1 | LYM107 | 12631.1 | F | 6.89 | 9.89E-04 | 23.9 |
| LYM122 | 13713.2 | A | 0.007 | 8.63E-03 | 80.4 | LYM180 | 13443.7 | F | 6.934 | 1.01E-03 | 24.7 |
| LYM249 | 13633.1 | A | 0.01 | 9.46E-03 | 172.4 | LYM52 | 12891.8 | F | 6.486 | 1.57E-03 | 16.7 |
| LYM193 | 13484.3 | A | 0.008 | 9.51E-03 | 127.8 | LYM248 | 13501.6 | F | 7.256 | 2.13E-03 | 30.5 |
| LYM245 | 13061.6 | A | 0.007 | 1.45E-02 | 82.5 | LYM213 | 12841.6 | F | 6.736 | 3.86E-03 | 21.2 |
| LYM273 | 13722.4 | A | 0.007 | 1.60E-02 | 90.1 | LYM157 | 13341.1 | F | 6.312 | 3.94E-03 | 13.6 |
| LYM251 | 13072.8 | A | 0.009 | 1.70E-02 | 138.1 | LYM90 | 12395.1 | F | 6.796 | 4.94E-03 | 22.2 |
| LYM217 | 13181.7 | A | 0.006 | 1.82E-02 | 53 | LYM107 | 12631.2 | F | 6.846 | 6.89E-03 | 23.2 |
| LYM23 | 12782.6 | A | 0.008 | 2.17E-02 | 114.8 | LYM248 | 13502.7 | F | 6.673 | 6.91E-03 | 20 |
| LYM122 | 13714.4 | A | 0.01 | 2.25E-02 | 166.2 | LYM157 | 13342.4 | F | 6.442 | 7.43E-03 | 15.9 |
| LYM245 | 13062.5 | A | 0.008 | 2.38E-02 | 131.2 | LYM107 | 12631.4 | F | 6.959 | 8.62E-03 | 25.2 |
| LYM79 | 13133.1 | A | 0.006 | 3.11E-02 | 62.6 | LYM52 | 12894.6 | F | 7.328 | 1.06E-02 | 31.8 |
| LYM23 | 12784.6 | A | 0.007 | 4.14E-02 | 95.5 | LYM68 | 11941.4 | F | 6.937 | 1.08E-02 | 24.8 |
| LYM251 | 13073.7 | A | 0.008 | 4.14E-02 | 126.4 | LYM68 | 11942.3 | F | 6.771 | 1.09E-02 | 21.8 |
| LYM273 | 13723.1 | A | 0.008 | 4.80E-02 | 123 | LYM117 | 13621.8 | F | 6.431 | 1.47E-02 | 15.7 |
| LYM224 | 13434.2 | A | 0.006 | 4.97E-02 | 59.9 | LYM180 | 13442.6 | F | 6.003 | 1.85E-02 | 8 |
| LYM251 | 13074.6 | A | 0.005 | 5.26E-02 | 49.6 | LYM213 | 12842.6 | F | 6.001 | 1.91E-02 | 7.9 |
| LYM274 | 13413.4 | A | 0.006 | 5.58E-02 | 76.3 | LYM180 | 13441.7 | F | 6.814 | 2.38E-02 | 22.6 |
| LYM273 | 13722.3 | A | 0.007 | 6.00E-02 | 80.4 | LYM90 | 12392.1 | F | 6.518 | 3.57E-02 | 17.2 |
| LYM224 | 13435.1 | A | 0.01 | 6.64E-02 | 177.9 | LYM52 | 12894.7 | F | 6.232 | 5.88E-02 | 12.1 |
| LYM217 | 13183.2 | A | 0.009 | 6.68E-02 | 156.6 | LYM213 | 12841.7 | F | 6.429 | 9.76E-02 | 15.6 |
| LYM217 | 13181.6 | A | 0.006 | 6.76E-02 | 62.6 | CONTROL | — | F | 5.559 | — | 0 |
| LYM79 | 13133.3 | A | 0.005 | 6.76E-02 | 41.3 | LYM68 | 11942.2 | G | 0.719 | 1.00E-06 | 54.5 |
| LYM23 | 12783.8 | A | 0.005 | 7.66E-02 | 30.4 | LYM90 | 12395.3 | G | 0.724 | 1.00E-06 | 55.5 |
| LYM122 | 13714.2 | A | 0.008 | 7.70E-02 | 114.8 | LYM117 | 13623.9 | G | 0.586 | 5.20E-05 | 25.8 |
| LYM249 | 13631.2 | A | 0.007 | 8.25E-02 | 105.1 | LYM248 | 13501.6 | G | 0.719 | 6.60E-05 | 54.4 |
| LYM274 | 13415.2 | A | 0.007 | 8.30E-02 | 83.2 | LYM117 | 13622.6 | G | 0.709 | 5.32E-04 | 52.2 |
| LYM249 | 13631.4 | A | 0.005 | 8.68E-02 | 31.7 | LYM107 | 12631.4 | G | 0.733 | 5.34E-04 | 57.3 |
| LYM251 | 13072.6 | A | 0.009 | 9.27E-02 | 159.3 | LYM180 | 13441.7 | G | 0.664 | 1.17E-03 | 42.6 |
| LYM240 | 12682.1 | A | 0.009 | 9.57E-02 | 148.4 | LYM52 | 12891.9 | G | 0.878 | 1.61E-03 | 88.5 |
| CONTROL | — | A | 0.004 | — | 0 | LYM213 | 12841.6 | G | 1.098 | 2.01E-03 | 135.7 |
| LYM251 | 13073.8 | B | 0.145 | 7.17E-04 | 59.3 | LYM68 | 11943.5 | G | 0.653 | 2.34E-03 | 40.2 |
| LYM164 | 12813.8 | B | 0.166 | 8.84E-04 | 82.4 | LYM117 | 13621.8 | G | 0.608 | 3.36E-03 | 30.6 |
| LYM122 | 13712.5 | B | 0.122 | 8.94E-04 | 33.4 | LYM90 | 12394.2 | G | 0.644 | 3.68E-03 | 38.4 |
| LYM217 | 13182.1 | B | 0.179 | 1.19E-03 | 96.3 | LYM52 | 12894.6 | G | 0.69 | 3.90E-03 | 48.2 |
| LYM273 | 13721.3 | B | 0.221 | 1.26E-03 | 142.7 | LYM157 | 13341.1 | G | 0.804 | 3.92E-03 | 72.7 |
| LYM249 | 13631.1 | B | 0.159 | 1.43E-03 | 74.6 | LYM107 | 12633.4 | G | 0.829 | 5.17E-03 | 78 |
| LYM273 | 13721.1 | B | 0.132 | 1.54E-03 | 44.4 | LYM52 | 12895.7 | G | 0.786 | 1.65E-02 | 68.8 |
| LYM193 | 13484.3 | B | 0.165 | 2.86E-03 | 80.7 | LYM52 | 12894.8 | G | 0.987 | 1.95E-02 | 111.9 |
| LYM79 | 13132.2 | B | 0.2 | 3.59E-03 | 119.3 | LYM117 | 13624.7 | G | 0.592 | 2.59E-02 | 27.2 |
| LYM217 | 13181.11 | B | 0.203 | 4.90E-03 | 123.1 | LYM213 | 12841.8 | G | 0.746 | 2.62E-02 | 60.2 |
| LYM122 | 13714.4 | B | 0.249 | 4.98E-03 | 172.7 | LYM180 | 13441.5 | G | 0.632 | 2.70E-02 | 35.7 |
| LYM273 | 13723.1 | B | 0.165 | 8.86E-03 | 80.7 | LYM117 | 13624.4 | G | 0.576 | 2.79E-02 | 23.6 |
| LYM274 | 13411.2 | B | 0.114 | 1.00E-02 | 24.9 | LYM248 | 13502.7 | G | 0.685 | 2.84E-02 | 47.1 |
| LYM274 | 13414.2 | B | 0.189 | 1.01E-02 | 107.4 | LYM107 | 12632.1 | G | 0.588 | 2.98E-02 | 26.3 |
| LYM249 | 13633.1 | B | 0.195 | 1.09E-02 | 114.2 | LYM157 | 13341.4 | G | 0.882 | 3.13E-02 | 89.4 |
| LYM245 | 13062.5 | B | 0.197 | 1.37E-02 | 116.1 | LYM68 | 11941.3 | G | 0.573 | 5.05E-02 | 23 |
| LYM274 | 13413.4 | B | 0.141 | 1.41E-02 | 54.1 | LYM157 | 13341.3 | G | 0.834 | 5.09E-02 | 79.2 |
| LYM23 | 12783.7 | B | 0.204 | 1.57E-02 | 123.9 | LYM107 | 12631.1 | G | 0.688 | 5.95E-02 | 47.8 |
| LYM224 | 13435.3 | B | 0.149 | 2.06E-02 | 63.9 | LYM90 | 12392.1 | G | 0.633 | 6.01E-02 | 35.9 |
| LYM79 | 13134.3 | B | 0.14 | 2.13E-02 | 53.9 | LYM157 | 13341.7 | G | 0.717 | 8.11E-02 | 54 |
| LYM251 | 13072.8 | B | 0.161 | 2.19E-02 | 76.5 | LYM52 | 12894.7 | G | 0.72 | 9.20E-02 | 54.6 |
| LYM23 | 12783.8 | B | 0.131 | 2.26E-02 | 43.9 | LYM213 | 12841.7 | G | 0.698 | 9.67E-02 | 49.9 |
| LYM164 | 12813.5 | B | 0.221 | 2.28E-02 | 142.7 | CONTROL | — | G | 0.466 | — | 0 |
| LYM23 | 12782.7 | B | 0.125 | 2.52E-02 | 36.8 | LYM107 | 12633.4 | H | 0.081 | 0.00E+00 | 83.3 |
| LYM217 | 13181.7 | B | 0.124 | 3.28E-02 | 35.6 | LYM107 | 12631.4 | H | 0.078 | 0.00E+00 | 75.7 |
| LYM23 | 12782.6 | B | 0.16 | 3.33E-02 | 76 | LYM117 | 13622.6 | H | 0.08 | 0.00E+00 | 79.3 |
| LYM273 | 13722.3 | B | 0.148 | 4.38E-02 | 62.3 | LYM157 | 13341.4 | H | 0.092 | 0.00E+00 | 108 |
| LYM122 | 13712.1 | B | 0.147 | 4.52E-02 | 61.4 | LYM157 | 13341.1 | H | 0.08 | 0.00E+00 | 80.9 |
| LYM251 | 13072.6 | B | 0.231 | 4.55E-02 | 153.2 | LYM213 | 12841.6 | H | 0.111 | 0.00E+00 | 149.2 |
| LYM251 | 13074.6 | B | 0.128 | 4.80E-02 | 40.5 | LYM52 | 12894.8 | H | 0.103 | 0.00E+00 | 131.6 |
| LYM131 | 12791.5 | B | 0.136 | 5.54E-02 | 49.2 | LYM52 | 12891.8 | H | 0.093 | 0.00E+00 | 108.9 |
| LYM240 | 12682.1 | B | 0.164 | 5.66E-02 | 80.3 | LYM52 | 12895.7 | H | 0.083 | 0.00E+00 | 87 |
| LYM122 | 13713.2 | B | 0.146 | 5.87E-02 | 60.6 | LYM90 | 12395.3 | H | 0.076 | 0.00E+00 | 71 |
| LYM23 | 12784.6 | B | 0.18 | 6.16E-02 | 97.8 | LYM68 | 11942.2 | H | 0.074 | 1.00E-06 | 67.4 |
| LYM79 | 13133.3 | B | 0.131 | 6.29E-02 | 43.3 | LYM52 | 12894.6 | H | 0.075 | 2.00E-06 | 68.1 |
| LYM122 | 13714.2 | B | 0.176 | 6.66E-02 | 93.6 | LYM157 | 13341.3 | H | 0.085 | 3.00E-06 | 92.7 |
| LYM249 | 13631.2 | B | 0.172 | 6.94E-02 | 88.8 | LYM213 | 12841.8 | H | 0.074 | 1.70E-05 | 66.3 |
| LYM224 | 13435.1 | B | 0.225 | 7.12E-02 | 146.6 | LYM248 | 13501.6 | H | 0.069 | 3.10E-05 | 56.2 |
| LYM217 | 13183.2 | B | 0.197 | 7.76E-02 | 115.6 | LYM90 | 12394.2 | H | 0.068 | 3.80E-05 | 54.1 |
| LYM23 | 12783.5 | B | 0.162 | 8.12E-02 | 77.2 | LYM107 | 12631.1 | H | 0.073 | 4.60E-05 | 65.3 |
| LYM217 | 13181.6 | B | 0.145 | 8.35E-02 | 59 | LYM68 | 11943.5 | H | 0.069 | 6.60E-05 | 54.6 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM40 | 13732.1 | B | 0.143 | 8.41E−02 | 56.4 | LYM52 | 12894.7 | H | 0.074 | 1.57E−04 | 66.8 |
| LYM79 | 13133.1 | B | 0.156 | 9.62E−02 | 20.9 | LYM90 | 12392.1 | H | 0.068 | 2.75E−04 | 52.6 |
| LYM273 | 13722.4 | B | 0.14 | 9.64E−02 | 54 | LYM213 | 12841.7 | H | 0.07 | 5.36E−04 | 58.5 |
| CONTROL | — | B | 0.091 | — | 0 | LYM157 | 13341.7 | H | 0.07 | 7.79E−04 | 57.3 |
| LYM122 | 13714.4 | C | 0.905 | 0.00E+00 | 135.4 | LYM117 | 13624.7 | H | 0.062 | 2.19E−03 | 39.2 |
| LYM122 | 13713.2 | C | 0.681 | 0.00E+00 | 77 | LYM117 | 13624.4 | H | 0.06 | 4.46E−03 | 35.7 |
| LYM131 | 12793.3 | C | 0.663 | 0.00E+00 | 72.4 | LYM248 | 13502.7 | H | 0.063 | 4.46E−03 | 41 |
| LYM164 | 12813.5 | C | 0.933 | 0.00E+00 | 142.7 | LYM180 | 13441.7 | H | 0.06 | 4.78E−03 | 35 |
| LYM193 | 13482.4 | C | 0.745 | 0.00E+00 | 93.9 | LYM117 | 13623.9 | H | 0.059 | 7.75E−03 | 31.9 |
| LYM217 | 13181.6 | C | 0.859 | 0.00E+00 | 123.4 | LYM68 | 11941.4 | H | 0.06 | 9.46E−03 | 36.1 |
| LYM23 | 12783.7 | C | 0.78 | 0.00E+00 | 102.9 | LYM180 | 13441.5 | H | 0.058 | 1.89E−02 | 30.4 |
| LYM245 | 13062.5 | C | 0.773 | 0.00E+00 | 101.1 | LYM107 | 12632.1 | H | 0.057 | 1.94E−02 | 29.2 |
| LYM245 | 13061.6 | C | 0.646 | 0.00E+00 | 68 | LYM90 | 12393.1 | H | 0.06 | 2.02E−02 | 36.1 |
| LYM249 | 13631.2 | C | 0.886 | 0.00E+00 | 130.4 | LYM68 | 11941.3 | H | 0.057 | 2.16E−02 | 29.1 |
| LYM249 | 13633.1 | C | 0.844 | 0.00E+00 | 119.6 | LYM157 | 13342.4 | H | 0.059 | 2.17E−02 | 33.1 |
| LYM251 | 13073.8 | C | 1.06 | 0.00E+00 | 175.7 | LYM68 | 11942.3 | H | 0.063 | 2.18E−02 | 42.3 |
| LYM251 | 13073.7 | C | 0.918 | 0.00E+00 | 138.9 | LYM180 | 13442.6 | H | 0.057 | 3.88E−02 | 27.7 |
| LYM251 | 13072.6 | C | 0.777 | 0.00E+00 | 102.2 | LYM117 | 13621.8 | H | 0.055 | 5.30E−02 | 24.2 |
| LYM251 | 13072.8 | C | 0.77 | 0.00E+00 | 100.4 | CONTROL | — | H | 0.044 | — | 0 |
| LYM251 | 13074.6 | C | 0.755 | 0.00E+00 | 96.5 | LYM268 | 12482.3 | A | 0.004 | 6.00E−06 | 66.2 |
| LYM273 | 13723.1 | C | 0.886 | 0.00E+00 | 130.5 | LYM140 | 12261.2 | A | 0.004 | 5.80E−05 | 59.4 |
| LYM273 | 13721.3 | C | 0.755 | 0.00E+00 | 96.3 | LYM162 | 12231.3 | A | 0.006 | 7.40E−05 | 130.9 |
| LYM273 | 13722.4 | C | 0.665 | 0.00E+00 | 73 | LYM13 | 11774.1 | A | 0.006 | 1.23E−04 | 132.9 |
| LYM274 | 13414.2 | C | 0.855 | 0.00E+00 | 122.3 | LYM140 | 12261.1 | A | 0.005 | 2.00E−04 | 74.9 |
| LYM274 | 13415.2 | C | 0.847 | 0.00E+00 | 120.2 | LYM134 | 12314.2 | A | 0.004 | 3.70E−04 | 68.1 |
| LYM274 | 13413.4 | C | 0.824 | 0.00E+00 | 114.4 | LYM162 | 12234.3 | A | 0.008 | 7.16E−04 | 204.3 |
| LYM40 | 13734.2 | C | 0.611 | 0.00E+00 | 58.9 | LYM132 | 12271.4 | A | 0.005 | 8.37E−04 | 79.7 |
| LYM79 | 13132.2 | C | 0.811 | 0.00E+00 | 110.9 | LYM140 | 12261.4 | A | 0.004 | 1.14E−03 | 47.8 |
| LYM79 | 13133.1 | C | 0.71 | 0.00E+00 | 84.6 | LYM289 | 12491.1 | A | 0.005 | 1.21E−03 | 110.6 |
| LYM79 | 13134.3 | C | 0.638 | 0.00E+00 | 66 | LYM290 | 12504.1 | A | 0.004 | 2.88E−03 | 49.8 |
| LYM249 | 13631.4 | C | 0.594 | 1.00E−06 | 54.4 | LYM290 | 12502.4 | A | 0.005 | 3.71E−03 | 101.9 |
| LYM122 | 13712.3 | C | 0.624 | 2.00E−06 | 62.3 | LYM113 | 12444.4 | A | 0.005 | 3.73E−03 | 104.8 |
| LYM273 | 13722.3 | C | 0.65 | 2.00E−06 | 69.2 | LYM140 | 12262.2 | A | 0.007 | 4.11E−03 | 187.9 |
| LYM23 | 12784.6 | C | 0.625 | 3.00E−06 | 62.5 | LYM134 | 12312.4 | A | 0.006 | 5.01E−03 | 122.2 |
| LYM224 | 13435.1 | C | 0.691 | 4.00E−06 | 79.7 | LYM268 | 12483.4 | A | 0.006 | 5.96E−03 | 150.2 |
| LYM249 | 13631.1 | C | 0.574 | 7.00E−06 | 49.3 | LYM132 | 12275.3 | A | 0.005 | 7.41E−03 | 73.9 |
| LYM40 | 13732.1 | C | 0.728 | 1.00E−05 | 89.4 | LYM268 | 12482.1 | A | 0.009 | 1.25E−02 | 246.9 |
| LYM79 | 13133.3 | C | 0.589 | 1.50E−05 | 53.1 | LYM102 | 12222.3 | A | 0.013 | 1.32E−02 | 387.9 |
| LYM240 | 12682.1 | C | 0.898 | 1.80E−05 | 133.5 | LYM3 | 12041.2 | A | 0.005 | 1.33E−02 | 107.1 |
| LYM131 | 12791.8 | C | 0.734 | 3.10E−05 | 90.9 | LYM289 | 12493.2 | A | 0.006 | 1.44E−02 | 144.4 |
| LYM274 | 13413.1 | C | 0.617 | 4.50E−05 | 60.5 | LYM3 | 12042.1 | A | 0.005 | 1.46E−02 | 108.7 |
| LYM260 | 13095.7 | C | 0.586 | 7.10E−05 | 52.5 | LYM162 | 12234.4 | A | 0.005 | 1.69E−02 | 101 |
| LYM23 | 12782.6 | C | 0.635 | 8.80E−05 | 65.2 | LYM113 | 12444.5 | A | 0.005 | 1.98E−02 | 96.1 |
| LYM40 | 13732.2 | C | 0.57 | 1.08E−04 | 48.4 | LYM113 | 12442.2 | A | 0.005 | 2.39E−02 | 95.2 |
| LYM260 | 13095.1 | C | 0.769 | 1.25E−04 | 100 | LYM289 | 12492.2 | A | 0.008 | 2.43E−02 | 194.7 |
| LYM122 | 13712.1 | C | 0.594 | 1.35E−04 | 54.4 | LYM106 | 12142.1 | A | 0.009 | 2.45E−02 | 261.4 |
| LYM164 | 12814.8 | C | 0.565 | 2.55E−04 | 47 | LYM113 | 12442.1 | A | 0.006 | 2.58E−02 | 136.7 |
| LYM245 | 13064.8 | C | 0.579 | 3.35E−04 | 50.6 | LYM132 | 12273.2 | A | 0.003 | 2.75E−02 | 25.6 |
| LYM122 | 13714.2 | C | 0.618 | 3.64E−04 | 60.6 | LYM134 | 12312.3 | A | 0.007 | 2.91E−02 | 155.1 |
| LYM164 | 12814.7 | C | 0.568 | 5.97E−04 | 47.6 | LYM148 | 12173.1 | A | 0.006 | 2.96E−02 | 130 |
| LYM224 | 13434.2 | C | 0.545 | 8.91E−04 | 41.8 | LYM13 | 11772.2 | A | 0.004 | 2.97E−02 | 36.2 |
| LYM164 | 12813.8 | C | 0.534 | 9.49E−04 | 38.8 | LYM132 | 12276.1 | A | 0.008 | 3.01E−02 | 206.3 |
| LYM224 | 13435.5 | C | 0.554 | 1.23E−03 | 44 | LYM129 | 12573.1 | A | 0.004 | 3.03E−02 | 71 |
| LYM193 | 13484.4 | C | 0.531 | 1.25E−03 | 38 | LYM102 | 12222.1 | A | 0.012 | 3.89E−02 | 345.4 |
| LYM23 | 12783.8 | C | 0.515 | 1.59E−03 | 33.9 | LYM134 | 12311.2 | A | 0.006 | 4.57E−02 | 122.2 |
| LYM193 | 13484.3 | C | 0.537 | 2.28E−03 | 39.7 | LYM268 | 12481.1 | A | 0.004 | 5.25E−02 | 72.9 |
| LYM217 | 13182.1 | C | 0.544 | 3.30E−03 | 41.4 | LYM10 | 11744.5 | A | 0.004 | 5.94E−02 | 47.8 |
| LYM249 | 13631.3 | C | 0.494 | 5.23E−03 | 28.5 | LYM148 | 12172.1 | A | 0.006 | 6.12E−02 | 116.4 |
| LYM79 | 13134.2 | C | 0.504 | 8.40E−03 | 31.1 | LYM113 | 12443.1 | A | 0.008 | 6.54E−02 | 197.6 |
| LYM273 | 13721.1 | C | 0.505 | 1.06E−02 | 31.4 | LYM289 | 12491.4 | A | 0.004 | 6.60E−02 | 52.7 |
| LYM260 | 13095.8 | C | 0.497 | 1.36E−02 | 29.2 | LYM102 | 12222.2 | A | 0.008 | 7.00E−02 | 222.7 |
| LYM23 | 12782.7 | C | 0.503 | 1.53E−02 | 30.9 | LYM10 | 11742.2 | A | 0.004 | 8.72E−02 | 44 |
| LYM245 | 13061.8 | C | 0.483 | 1.73E−02 | 25.7 | LYM13 | 11772.1 | A | 0.005 | 9.00E−02 | 77.8 |
| LYM23 | 12783.5 | C | 0.487 | 1.88E−02 | 26.7 | LYM129 | 12573.5 | A | 0.005 | 9.06E−02 | 85.5 |
| LYM217 | 13181.7 | C | 0.479 | 3.48E−02 | 24.7 | LYM102 | 12221.1 | A | 0.007 | 9.14E−02 | 183.1 |
| LYM224 | 13432.1 | C | 0.465 | 3.71E−02 | 21 | LYM106 | 12144.4 | A | 0.004 | 9.31E−02 | 66.2 |
| CONTROL | — | C | 0.384 | — | 0 | LYM3 | 12043.2 | A | 0.004 | 9.69E−02 | 70 |
| LYM122 | 13713.2 | D | 6.388 | 0.00E+00 | 77 | CONTROL | — | A | 0.003 | — | 0 |
| LYM249 | 13631.4 | D | 5.398 | 0.00E+00 | 49.6 | LYM13 | 11774.1 | B | 0.132 | 3.00E−06 | 64.6 |
| LYM273 | 13723.1 | D | 7.907 | 0.00E+00 | 119.1 | LYM3 | 12041.2 | B | 0.134 | 2.20E−04 | 66.7 |
| LYM249 | 13631.3 | D | 4.599 | 3.10E−05 | 27.4 | LYM162 | 12234.3 | B | 0.186 | 4.15E−04 | 131.8 |
| LYM249 | 13631.1 | D | 5.215 | 4.80E−05 | 44.5 | LYM162 | 12234.4 | B | 0.12 | 6.94E−04 | 49.1 |
| LYM251 | 13073.8 | D | 9.276 | 2.48E−04 | 157 | LYM140 | 12261.2 | B | 0.103 | 8.53E−04 | 28 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM131 | 12793.3 | D | 5.817 | 2.93E−04 | 61.2 | LYM3 | 12043.2 | B | 0.104 | 3.07E−03 | 29.9 |
| LYM164 | 12813.5 | D | 8.334 | 4.25E−04 | 130.9 | LYM290 | 12502.4 | B | 0.13 | 3.23E−03 | 61.6 |
| LYM245 | 13061.6 | D | 6.163 | 1.03E−03 | 70.8 | LYM132 | 12276.1 | B | 0.159 | 3.74E−03 | 98.1 |
| LYM273 | 13722.4 | D | 5.997 | 1.03E−03 | 66.2 | LYM162 | 12231.3 | B | 0.136 | 5.97E−03 | 69.7 |
| LYM23 | 12783.8 | D | 4.631 | 2.39E−03 | 28.3 | LYM134 | 12312.3 | B | 0.157 | 6.63E−03 | 95.2 |
| LYM40 | 13734.2 | D | 5.446 | 2.86E−03 | 50.9 | LYM289 | 12491.1 | B | 0.128 | 7.98E−03 | 59 |
| LYM217 | 13181.6 | D | 7.556 | 3.51E−03 | 109.4 | LYM140 | 12262.2 | B | 0.174 | 8.75E−03 | 117.3 |
| LYM224 | 13432.1 | D | 4.165 | 4.08E−03 | 15.4 | LYM132 | 12275.3 | B | 0.114 | 8.82E−03 | 41.5 |
| LYM274 | 13415.2 | D | 7.419 | 4.10E−03 | 105.6 | LYM289 | 12492.2 | B | 0.19 | 1.16E−02 | 137.4 |
| LYM251 | 13074.6 | D | 6.666 | 4.94E−03 | 84.7 | LYM268 | 12482.1 | B | 0.192 | 1.21E−02 | 139.2 |
| LYM249 | 13633.1 | D | 8 | 4.95E−03 | 121.7 | LYM113 | 12442.1 | B | 0.145 | 1.30E−02 | 80.3 |
| LYM23 | 12783.7 | D | 7.137 | 6.65E−03 | 97.7 | LYM268 | 12483.4 | B | 0.132 | 1.32E−02 | 64.2 |
| LYM79 | 13134.3 | D | 5.54 | 7.39E−03 | 53.5 | LYM3 | 12042.1 | B | 0.142 | 1.38E−02 | 77.1 |
| LYM122 | 13714.2 | D | 8.315 | 8.23E−03 | 130.4 | LYM290 | 12504.1 | B | 0.095 | 1.49E−02 | 17.8 |
| LYM79 | 13133.1 | D | 6.179 | 1.22E−02 | 71.2 | LYM148 | 12173.1 | B | 0.141 | 1.51E−02 | 75.8 |
| LYM79 | 13132.2 | D | 7.315 | 1.42E−02 | 102.7 | LYM134 | 12312.4 | B | 0.139 | 1.55E−02 | 73.1 |
| LYM251 | 13072.6 | D | 7.175 | 1.42E−02 | 98.8 | LYM290 | 12502.1 | B | 0.096 | 1.59E−02 | 20 |
| LYM251 | 13073.7 | D | 8.23 | 1.56E−02 | 128 | LYM106 | 12144.4 | B | 0.103 | 1.67E−02 | 28.3 |
| LYM251 | 13072.8 | D | 6.896 | 1.59E−02 | 91.1 | LYM102 | 12222.3 | B | 0.252 | 2.42E−02 | 213.8 |
| LYM273 | 13721.3 | D | 6.844 | 1.74E−02 | 89.6 | LYM148 | 12172.1 | B | 0.127 | 2.50E−02 | 58.1 |
| LYM274 | 13414.2 | D | 7.667 | 1.85E−02 | 112.4 | LYM106 | 12142.1 | B | 0.194 | 2.73E−02 | 141.6 |
| LYM245 | 13062.5 | D | 6.543 | 2.21E−02 | 81.3 | LYM102 | 12221.1 | B | 0.237 | 3.04E−02 | 195.1 |
| LYM40 | 13732.2 | D | 5.373 | 2.26E−02 | 48.9 | LYM113 | 12444.5 | B | 0.133 | 3.89E−02 | 65.3 |
| LYM122 | 13712.3 | D | 5.384 | 2.45E−02 | 49.2 | LYM129 | 12573.5 | B | 0.135 | 3.90E−02 | 67.9 |
| LYM224 | 13435.1 | D | 6.554 | 2.96E−02 | 81.6 | LYM129 | 12571.3 | B | 0.151 | 4.13E−02 | 88.4 |
| LYM249 | 13631.2 | D | 7.72 | 3.46E−02 | 113.9 | LYM268 | 12482.3 | B | 0.094 | 4.38E−02 | 17.1 |
| LYM273 | 13722.3 | D | 5.777 | 3.61E−02 | 60.1 | LYM113 | 12444.4 | B | 0.136 | 4.55E−02 | 69.1 |
| LYM79 | 13133.3 | D | 5.126 | 3.67E−02 | 42 | LYM289 | 12493.2 | B | 0.13 | 4.69E−02 | 62.4 |
| LYM23 | 12784.6 | D | 5.428 | 3.91E−02 | 50.4 | LYM113 | 12443.1 | B | 0.186 | 5.16E−02 | 131.8 |
| LYM193 | 13482.4 | D | 6.654 | 4.51E−02 | 84.4 | LYM134 | 12311.2 | B | 0.139 | 5.91E−02 | 73.4 |
| LYM193 | 13484.4 | D | 4.895 | 4.61E−02 | 35.6 | LYM132 | 12271.4 | B | 0.105 | 6.45E−02 | 31.3 |
| LYM274 | 13413.4 | D | 7.889 | 4.88E−02 | 118.6 | LYM129 | 12573.1 | B | 0.114 | 6.88E−02 | 41.7 |
| LYM193 | 13481.2 | D | 4.14 | 5.04E−02 | 14.7 | LYM140 | 12261.4 | B | 0.096 | 7.22E−02 | 19.9 |
| LYM40 | 13732.1 | D | 6.939 | 5.19E−02 | 92.3 | LYM106 | 12141.4 | B | 0.121 | 7.36E−02 | 50.4 |
| LYM122 | 13712.2 | D | 5.608 | 5.71E−02 | 55.4 | LYM102 | 12222.1 | B | 0.192 | 7.66E−02 | 139.1 |
| LYM164 | 12813.8 | D | 4.766 | 6.09E−02 | 32 | LYM162 | 12233.2 | B | 0.114 | 8.96E−02 | 42.5 |
| LYM164 | 12814.8 | D | 5.126 | 6.17E−02 | 42 | LYM140 | 12261.1 | B | 0.096 | 9.02E−02 | 19.5 |
| LYM240 | 12682.1 | D | 8.444 | 6.37E−02 | 134 | LYM13 | 11772.2 | B | 0.131 | 9.05E−02 | 63.5 |
| LYM260 | 13095.7 | D | 5.147 | 6.73E−02 | 42.6 | CONTROL | — | B | 0.08 | — | 0 |
| LYM274 | 13413.1 | D | 5.528 | 7.60E−02 | 53.2 | LYM102 | 12222.3 | C | 1.242 | 0.00E+00 | 203.7 |
| LYM23 | 12783.5 | D | 4.388 | 7.70E−02 | 21.6 | LYM102 | 12222.1 | C | 1.148 | 0.00E+00 | 180.7 |
| LYM131 | 12791.8 | D | 6.882 | 8.02E−02 | 90.7 | LYM106 | 12142.1 | C | 0.744 | 0.00E+00 | 82.1 |
| LYM193 | 13484.3 | D | 5.019 | 9.01E−02 | 39.1 | LYM113 | 12444.4 | C | 0.805 | 0.00E+00 | 96.9 |
| CONTROL | — | D | 3.609 | — | 0 | LYM113 | 12443.1 | C | 0.794 | 0.00E+00 | 94.1 |
| LYM251 | 13073.8 | E | 0.584 | 1.00E−06 | 58.3 | LYM129 | 12573.5 | C | 0.861 | 0.00E+00 | 110.7 |
| LYM251 | 13074.6 | E | 0.577 | 1.00E−06 | 56.3 | LYM132 | 12276.1 | C | 0.749 | 0.00E+00 | 83.3 |
| LYM249 | 13631.2 | E | 0.582 | 4.00E−06 | 57.8 | LYM148 | 12173.1 | C | 0.798 | 0.00E+00 | 95.1 |
| LYM164 | 12811.8 | E | 0.551 | 6.00E−06 | 49.2 | LYM148 | 12172.1 | C | 0.734 | 0.00E+00 | 79.5 |
| LYM217 | 13181.6 | E | 0.567 | 1.50E−05 | 53.6 | LYM162 | 12234.3 | C | 0.978 | 0.00E+00 | 139.2 |
| LYM245 | 13062.5 | E | 0.537 | 3.50E−05 | 45.6 | LYM162 | 12231.2 | C | 0.732 | 0.00E+00 | 79 |
| LYM245 | 13064.8 | E | 0.522 | 1.42E−04 | 41.5 | LYM268 | 12482.1 | C | 0.784 | 0.00E+00 | 91.8 |
| LYM122 | 13713.2 | E | 0.522 | 2.35E−04 | 41.5 | LYM268 | 12483.4 | C | 0.762 | 0.00E+00 | 86.3 |
| LYM164 | 12813.5 | E | 0.544 | 2.41E−04 | 47.5 | LYM268 | 12483.2 | C | 0.74 | 0.00E+00 | 81 |
| LYM122 | 13712.3 | E | 0.519 | 2.99E−04 | 40.7 | LYM289 | 12492.2 | C | 0.845 | 0.00E+00 | 106.7 |
| LYM251 | 13073.7 | E | 0.527 | 4.09E−04 | 42.7 | LYM289 | 12491.6 | C | 0.789 | 0.00E+00 | 92.9 |
| LYM273 | 13722.4 | E | 0.505 | 9.21E−04 | 36.9 | LYM289 | 12493.6 | C | 0.785 | 0.00E+00 | 92 |
| LYM273 | 13723.1 | E | 0.502 | 1.54E−03 | 36.1 | LYM289 | 12493.2 | C | 0.721 | 0.00E+00 | 76.4 |
| LYM23 | 12783.7 | E | 0.493 | 2.29E−03 | 33.5 | LYM290 | 12502.4 | C | 0.777 | 0.00E+00 | 90 |
| LYM131 | 12791.8 | E | 0.487 | 2.71E−03 | 31.9 | LYM148 | 12173.5 | C | 0.711 | 1.00E−06 | 73.9 |
| LYM251 | 13072.8 | E | 0.498 | 2.78E−03 | 35 | LYM268 | 12482.1 | C | 0.772 | 1.00E−06 | 88.9 |
| LYM260 | 13095.7 | E | 0.491 | 3.02E−03 | 32.9 | LYM290 | 12501.2 | C | 0.724 | 1.00E−06 | 77.1 |
| LYM249 | 13631.1 | E | 0.489 | 3.23E−03 | 32.5 | LYM129 | 12571.3 | C | 0.776 | 2.00E−06 | 89.9 |
| LYM249 | 13631.4 | E | 0.498 | 3.49E−03 | 34.8 | LYM162 | 12231.3 | C | 0.746 | 2.00E−06 | 82.5 |
| LYM131 | 12793.3 | E | 0.486 | 3.59E−03 | 31.8 | LYM102 | 12222.2 | C | 0.748 | 5.00E−06 | 83.1 |
| LYM251 | 13072.6 | E | 0.483 | 4.03E−03 | 31 | LYM10 | 11744.5 | C | 0.711 | 7.00E−06 | 73.8 |
| LYM79 | 13132.2 | E | 0.478 | 5.43E−03 | 29.6 | LYM134 | 12314.2 | C | 0.658 | 2.30E−05 | 61 |
| LYM79 | 13134.3 | E | 0.473 | 7.86E−03 | 28 | LYM10 | 11741.4 | C | 0.683 | 2.80E−05 | 67 |
| LYM193 | 13482.4 | E | 0.478 | 8.17E−03 | 29.6 | LYM113 | 12442.1 | C | 0.648 | 3.30E−05 | 58.5 |
| LYM79 | 13133.1 | E | 0.481 | 8.28E−03 | 30.4 | LYM13 | 11774.1 | C | 0.641 | 3.30E−05 | 56.7 |
| LYM274 | 13415.2 | E | 0.475 | 9.01E−03 | 28.6 | LYM134 | 12311.2 | C | 0.651 | 7.30E−05 | 59.3 |
| LYM40 | 13734.2 | E | 0.469 | 9.05E−03 | 27.2 | LYM289 | 12491.4 | C | 0.654 | 1.15E−04 | 60 |
| LYM260 | 13095.1 | E | 0.496 | 1.32E−02 | 34.3 | LYM148 | 12171.2 | C | 0.608 | 1.49E−04 | 48.7 |
| LYM224 | 13434.2 | E | 0.466 | 1.34E−02 | 26.4 | LYM140 | 12261.4 | C | 0.622 | 1.52E−04 | 52.1 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM79 | 13133.3 | E | 0.465 | 1.55E−02 | 25.9 | LYM134 | 12312.4 | C | 0.616 | 1.68E−04 | 50.6 |
| LYM164 | 12814.7 | E | 0.467 | 1.71E−02 | 26.5 | LYM148 | 12174.1 | C | 0.608 | 1.69E−04 | 48.6 |
| LYM274 | 13413.4 | E | 0.475 | 2.10E−02 | 28.6 | LYM106 | 12142.2 | C | 0.647 | 2.21E−04 | 58.2 |
| LYM40 | 13732.1 | E | 0.475 | 2.15E−02 | 28.7 | LYM268 | 12481.1 | C | 0.639 | 2.23E−04 | 56.3 |
| LYM40 | 13732.2 | E | 0.46 | 2.66E−02 | 24.6 | LYM290 | 12502.1 | C | 0.61 | 4.18E−04 | 49.3 |
| LYM260 | 13095.8 | E | 0.462 | 2.67E−02 | 25.3 | LYM290 | 12504.1 | C | 0.609 | 6.87E−04 | 48.9 |
| LYM23 | 12784.6 | E | 0.453 | 2.97E−02 | 22.8 | LYM113 | 12444.5 | C | 0.596 | 7.01E−04 | 45.7 |
| LYM274 | 13414.2 | E | 0.457 | 2.97E−02 | 23.7 | LYM102 | 12221.1 | C | 0.648 | 1.55E−03 | 58.5 |
| LYM240 | 12682.1 | E | 0.462 | 4.66E−02 | 25.1 | LYM3 | 12042.1 | C | 0.57 | 2.95E−03 | 39.4 |
| LYM23 | 12782.6 | E | 0.451 | 5.25E−02 | 22.2 | LYM129 | 12573.1 | C | 0.581 | 3.85E−03 | 42.1 |
| LYM193 | 13481.2 | E | 0.439 | 6.58E−02 | 18.9 | LYM140 | 12262.3 | C | 0.574 | 4.08E−03 | 40.5 |
| LYM23 | 12783.8 | E | 0.438 | 8.19E−02 | 18.6 | LYM134 | 12312.3 | C | 0.567 | 4.13E−03 | 38.6 |
| LYM224 | 13435.5 | E | 0.438 | 8.43E−02 | 18.8 | LYM10 | 11741.2 | C | 0.559 | 4.92E−03 | 36.8 |
| LYM273 | 13722.3 | E | 0.44 | 9.76E−02 | 19.3 | LYM132 | 12273.2 | C | 0.563 | 5.24E−03 | 37.6 |
| CONTROL | — | E | 0.369 | — | 0 | LYM290 | 12501.3 | C | 0.552 | 5.82E−03 | 34.9 |
| LYM131 | 12791.8 | F | 6.809 | 0.00E+00 | 41.1 | LYM106 | 12141.4 | C | 0.577 | 7.47E−03 | 41.2 |
| LYM251 | 13073.8 | F | 7.178 | 0.00E+00 | 48.8 | LYM140 | 12261.1 | C | 0.54 | 1.12E−02 | 32.2 |
| LYM251 | 13074.6 | F | 7.042 | 0.00E+00 | 46 | LYM3 | 12041.1 | C | 0.547 | 1.19E−02 | 33.7 |
| LYM251 | 13073.7 | F | 6.988 | 0.00E+00 | 44.9 | LYM132 | 12271.4 | C | 0.565 | 1.23E−02 | 38.3 |
| LYM251 | 13072.6 | F | 6.465 | 0.00E+00 | 34 | LYM10 | 11742.2 | C | 0.569 | 1.23E−02 | 39.3 |
| LYM40 | 13734.2 | F | 5.902 | 0.00E+00 | 22.3 | LYM140 | 12262.2 | C | 0.56 | 1.42E−02 | 36.9 |
| LYM249 | 13631.1 | F | 5.617 | 1.00E−06 | 16.4 | LYM13 | 11772.1 | C | 0.53 | 1.46E−02 | 29.6 |
| LYM164 | 12811.8 | F | 5.941 | 2.00E−06 | 23.1 | LYM3 | 12041.2 | C | 0.524 | 2.55E−02 | 28.1 |
| LYM79 | 13134.3 | F | 5.852 | 2.00E−06 | 21.3 | LYM129 | 12572.2 | C | 0.521 | 3.13E−02 | 27.5 |
| LYM245 | 13064.8 | F | 6.215 | 3.00E−06 | 28.8 | LYM102 | 12222.6 | C | 0.522 | 3.24E−02 | 27.7 |
| LYM274 | 13415.2 | F | 6.454 | 1.40E−05 | 33.8 | LYM13 | 11772.2 | C | 0.516 | 4.80E−02 | 26.2 |
| LYM274 | 13413.4 | F | 6.963 | 4.00E−05 | 44.3 | LYM132 | 12275.1 | C | 0.501 | 6.79E−02 | 22.6 |
| LYM193 | 13481.2 | F | 5.96 | 8.50E−05 | 23.5 | LYM162 | 12234.4 | C | 0.501 | 6.95E−02 | 22.5 |
| LYM79 | 13132.2 | F | 6.122 | 1.83E−04 | 26.9 | LYM13 | 11771.6 | C | 0.519 | 7.56E−02 | 26.9 |
| LYM122 | 13714.4 | F | 6.254 | 3.39E−04 | 29.6 | LYM140 | 12261.2 | C | 0.502 | 8.74E−02 | 22.7 |
| LYM122 | 13712.1 | F | 6.19 | 3.43E−04 | 28.3 | LYM3 | 12043.2 | C | 0.494 | 9.78E−02 | 20.9 |
| LYM245 | 13062.5 | F | 5.768 | 3.71E−04 | 19.6 | CONTROL | — | C | 0.409 | — | 0 |
| LYM249 | 13631.2 | F | 6.987 | 4.32E−04 | 44.8 | LYM268 | 12482.3 | D | 6.516 | 0.00E+00 | 87.6 |
| LYM193 | 13482.4 | F | 6.308 | 4.55E−04 | 30.8 | LYM268 | 12483.4 | D | 6.288 | 2.00E−06 | 81 |
| LYM217 | 13181.6 | F | 6.753 | 5.78E−04 | 40 | LYM148 | 12171.2 | D | 5.189 | 4.00E−05 | 49.4 |
| LYM164 | 12814.8 | F | 5.561 | 7.94E−04 | 15.3 | LYM289 | 12492.2 | D | 7.223 | 7.40E−05 | 107.9 |
| LYM131 | 12793.3 | F | 6.003 | 1.10E−03 | 24.4 | LYM148 | 12174.1 | D | 5.096 | 9.60E−05 | 46.7 |
| LYM23 | 12783.7 | F | 6.275 | 1.34E−03 | 30.1 | LYM140 | 12261.1 | D | 4.512 | 3.53E−04 | 29.9 |
| LYM122 | 13713.2 | F | 6.765 | 1.65E−03 | 40.2 | LYM13 | 11772.2 | D | 4.467 | 8.33E−04 | 28.6 |
| LYM245 | 13061.6 | F | 6.117 | 3.30E−03 | 26.8 | LYM148 | 12173.1 | D | 6.767 | 1.30E−03 | 94.8 |
| LYM273 | 13722.4 | F | 6.089 | 3.52E−03 | 26.2 | LYM290 | 12502.4 | D | 6.425 | 2.00E−03 | 85 |
| LYM164 | 12813.5 | F | 6.915 | 5.03E−03 | 43.3 | LYM162 | 12234.3 | D | 8.82 | 2.51E−03 | 153.9 |
| LYM249 | 13631.1 | F | 5.83 | 5.49E−03 | 20.8 | LYM162 | 12231.2 | D | 6.026 | 2.51E−03 | 73.5 |
| LYM273 | 13723.1 | F | 6.303 | 5.56E−03 | 30.6 | LYM289 | 12493.6 | D | 6.413 | 2.68E−03 | 84.6 |
| LYM40 | 13732.1 | F | 6.446 | 6.08E−03 | 33.6 | LYM289 | 12493.2 | D | 5.997 | 3.69E−03 | 72.6 |
| LYM224 | 13435.1 | F | 6.001 | 6.99E−03 | 24.4 | LYM132 | 12276.1 | D | 6.257 | 4.48E−03 | 80.1 |
| LYM240 | 12682.1 | F | 6.594 | 9.82E−03 | 36.7 | LYM113 | 12442.1 | D | 5.435 | 4.57E−03 | 56.5 |
| LYM122 | 13712.3 | F | 5.822 | 1.17E−02 | 20.7 | LYM290 | 12501.3 | D | 4.573 | 5.64E−03 | 31.7 |
| LYM224 | 13435.5 | F | 5.726 | 1.24E−02 | 18.7 | LYM13 | 11774.1 | D | 5.363 | 6.31E−03 | 54.4 |
| LYM249 | 13633.1 | F | 6.405 | 1.51E−02 | 32.8 | LYM132 | 12275.3 | D | 4.076 | 6.87E−03 | 17.3 |
| LYM40 | 13732.2 | F | 6.015 | 1.52E−02 | 24.7 | LYM148 | 12173.5 | D | 5.836 | 6.99E−03 | 68 |
| LYM274 | 13414.2 | F | 5.792 | 1.60E−02 | 20.1 | LYM106 | 12142.1 | D | 6.279 | 7.68E−03 | 80.8 |
| LYM224 | 13432.1 | F | 5.184 | 1.77E−02 | 7.5 | LYM113 | 12444.4 | D | 6.706 | 9.46E−03 | 93 |
| LYM249 | 13631.4 | F | 6.1 | 2.05E−02 | 26.4 | LYM113 | 12444.5 | D | 4.965 | 1.05E−02 | 42.9 |
| LYM260 | 13095.7 | F | 5.943 | 2.05E−02 | 23.2 | LYM102 | 12222.3 | D | 10.347 | 1.06E−02 | 197.9 |
| LYM260 | 13095.1 | F | 6.165 | 2.12E−02 | 27.8 | LYM289 | 12491.1 | D | 6.56 | 1.24E−02 | 88.8 |
| LYM251 | 13072.8 | F | 5.901 | 2.20E−02 | 22.3 | LYM113 | 12443.1 | D | 6.784 | 1.25E−02 | 95.3 |
| LYM164 | 12814.7 | F | 5.8 | 2.60E−02 | 20.2 | LYM268 | 12483.2 | D | 6.263 | 1.30E−02 | 80.3 |
| LYM274 | 13413.1 | F | 5.834 | 2.70E−02 | 20.9 | LYM134 | 12312.4 | D | 5.224 | 1.38E−02 | 50.4 |
| LYM193 | 13484.4 | F | 5.599 | 3.59E−02 | 16.1 | LYM134 | 12314.2 | D | 5.609 | 1.45E−02 | 61.5 |
| LYM79 | 13133.1 | F | 5.782 | 4.30E−02 | 19.8 | LYM148 | 12172.1 | D | 6.055 | 1.59E−02 | 74.3 |
| LYM273 | 13721.3 | F | 5.386 | 4.48E−02 | 11.6 | LYM140 | 12261.4 | D | 5.192 | 1.62E−02 | 49.5 |
| LYM79 | 13133.3 | F | 5.452 | 4.87E−02 | 13 | LYM290 | 12501.2 | D | 6.097 | 1.82E−02 | 75.5 |
| LYM23 | 12782.7 | F | 5.251 | 6.38E−02 | 8.8 | LYM129 | 12573.2 | D | 7.107 | 2.09E−02 | 104.6 |
| LYM260 | 13095.8 | F | 5.588 | 9.86E−02 | 15.8 | LYM290 | 12502.1 | D | 5.038 | 2.88E−02 | 45 |
| CONTROL | — | F | 4.824 | — | 0 | LYM3 | 12042.1 | D | 4.823 | 3.26E−02 | 38.8 |
| LYM224 | 13435.3 | G | 0.764 | 0.00E+00 | 72.3 | LYM162 | 12231.3 | D | 6.434 | 3.53E−02 | 85.2 |
| LYM40 | 13734.2 | G | 0.567 | 1.08E−04 | 27.9 | LYM134 | 12311.2 | D | 5.558 | 3.62E−02 | 60 |
| LYM273 | 13722.4 | G | 0.856 | 4.09E−04 | 93.1 | LYM102 | 12222.1 | D | 9.506 | 3.77E−02 | 173.6 |
| LYM273 | 13721.1 | G | 0.701 | 6.35E−04 | 58.1 | LYM129 | 12572.2 | D | 4.35 | 3.96E−02 | 25.2 |
| LYM273 | 13721.3 | G | 1.063 | 7.82E−04 | 139.6 | LYM10 | 11741.4 | D | 5.712 | 4.08E−02 | 64.4 |
| LYM122 | 13712.3 | G | 0.632 | 8.84E−04 | 42.4 | LYM129 | 12571.3 | D | 6.495 | 4.89E−02 | 87 |
| LYM251 | 13073.8 | G | 0.879 | 1.02E−03 | 98.3 | LYM3 | 12043.2 | D | 4.152 | 5.04E−02 | 19.5 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM23 | 12783.5 | G | 0.663 | 1.60E−03 | 49.5 | LYM10 | 11744.5 | D | 5.886 | 5.04E−02 | 69.4 |
| LYM164 | 12813.5 | G | 0.824 | 3.06E−03 | 85.8 | LYM132 | 12275.1 | D | 4.228 | 5.06E−02 | 21.7 |
| LYM249 | 13633.1 | G | 0.944 | 3.80E−03 | 112.9 | LYM10 | 11741.2 | D | 4.701 | 5.08E−02 | 35.3 |
| LYM79 | 13132.2 | G | 0.881 | 4.30E−03 | 98.7 | LYM268 | 12482.1 | D | 6.36 | 5.11E−02 | 83.1 |
| LYM217 | 13182.1 | G | 0.797 | 5.62E−03 | 79.6 | LYM134 | 12312.3 | D | 4.742 | 5.15E−02 | 36.5 |
| LYM23 | 12783.7 | G | 0.871 | 6.19E−03 | 96.5 | LYM102 | 12222.2 | D | 6.476 | 5.30E−02 | 86.4 |
| LYM193 | 13484.3 | G | 0.77 | 7.00E−03 | 73.6 | LYM268 | 12481.1 | D | 5.364 | 5.40E−02 | 54.4 |
| LYM249 | 13631.1 | G | 0.696 | 7.39E−03 | 56.9 | LYM162 | 12234.4 | D | 4.154 | 5.73E−02 | 19.6 |
| LYM251 | 13072.8 | G | 0.807 | 8.13E−03 | 82 | LYM290 | 12504.1 | D | 5.105 | 5.84E−02 | 47 |
| LYM122 | 13713.2 | G | 0.721 | 8.93E−03 | 62.6 | LYM3 | 12041.1 | D | 4.538 | 6.02E−02 | 30.7 |
| LYM274 | 13414.2 | G | 0.895 | 1.25E−02 | 101.9 | LYM132 | 12273.2 | D | 4.755 | 6.21E−02 | 36.9 |
| LYM224 | 13435.5 | G | 0.549 | 1.36E−02 | 23.7 | LYM106 | 12142.2 | D | 5.335 | 6.22E−02 | 53.6 |
| LYM79 | 13133.3 | G | 0.652 | 1.38E−02 | 47.1 | LYM289 | 12491.4 | D | 5.472 | 6.26E−02 | 57.5 |
| LYM217 | 13181.11 | G | 0.677 | 1.41E−02 | 52.7 | LYM3 | 12041.2 | D | 4.402 | 6.70E−02 | 26.7 |
| LYM273 | 13723.1 | G | 0.825 | 1.50E−02 | 86 | LYM102 | 12222.6 | D | 4.518 | 8.47E−02 | 30.1 |
| LYM122 | 13714.4 | G | 0.939 | 1.71E−02 | 111.7 | LYM140 | 12262.3 | D | 4.826 | 8.91E−02 | 38.9 |
| LYM251 | 13073.7 | G | 0.964 | 1.78E−02 | 117.4 | LYM129 | 12573.1 | D | 4.888 | 9.60E−02 | 40.7 |
| LYM274 | 13411.2 | G | 0.53 | 2.47E−02 | 19.6 | CONTROL | — | D | 3.474 | — | 0 |
| LYM245 | 13062.5 | G | 0.742 | 2.75E−02 | 67.4 | LYM129 | 12573.5 | E | 0.709 | 4.00E−06 | 62.2 |
| LYM23 | 12782.6 | G | 0.794 | 2.84E−02 | 79.1 | LYM289 | 12493.6 | E | 0.697 | 7.00E−06 | 59.3 |
| LYM274 | 13413.4 | G | 0.791 | 3.21E−02 | 78.4 | LYM162 | 12231.2 | E | 0.659 | 7.90E−05 | 50.8 |
| LYM122 | 13712.1 | G | 0.695 | 3.25E−02 | 56.7 | LYM102 | 12222.3 | E | 0.675 | 8.60E−05 | 54.3 |
| LYM245 | 13061.6 | G | 0.82 | 3.44E−02 | 84.9 | LYM290 | 12502.4 | E | 0.632 | 2.93E−04 | 44.5 |
| LYM23 | 12784.6 | G | 0.752 | 3.82E−02 | 69.6 | LYM148 | 12173.5 | E | 0.625 | 5.90E−04 | 43 |
| LYM251 | 13072.6 | G | 0.907 | 3.90E−02 | 104.5 | LYM102 | 12222.1 | E | 0.638 | 7.08E−04 | 46 |
| LYM251 | 13074.6 | G | 0.643 | 3.93E−02 | 45.1 | LYM290 | 12501.2 | E | 0.622 | 7.15E−04 | 41.2 |
| LYM40 | 13732.2 | G | 0.563 | 4.57E−02 | 27 | LYM268 | 12482.3 | E | 0.613 | 1.36E−03 | 40.2 |
| LYM23 | 12782.7 | G | 0.541 | 4.89E−02 | 22 | LYM10 | 11744.5 | E | 0.607 | 1.97E−03 | 38.8 |
| LYM217 | 13181.7 | G | 0.562 | 5.20E−02 | 26.7 | LYM148 | 12172.1 | E | 0.6 | 2.71E−03 | 37.1 |
| LYM217 | 13183.2 | G | 0.913 | 5.21E−02 | 106 | LYM148 | 12174.1 | E | 0.591 | 3.47E−03 | 35.1 |
| LYM164 | 12813.8 | G | 0.65 | 5.77E−02 | 46.5 | LYM140 | 12261.4 | E | 0.59 | 4.44E−03 | 34.9 |
| LYM273 | 13722.3 | G | 0.639 | 5.87E−02 | 44.1 | LYM268 | 12483.4 | E | 0.595 | 4.63E−03 | 36.1 |
| LYM224 | 13435.1 | G | 0.927 | 5.89E−02 | 108.9 | LYM268 | 12483.2 | E | 0.586 | 5.11E−03 | 34.1 |
| LYM217 | 13181.6 | G | 0.622 | 6.07E−02 | 40.2 | LYM113 | 12443.1 | E | 0.58 | 7.96E−03 | 32.6 |
| LYM274 | 13415.2 | G | 0.718 | 6.41E−02 | 61.8 | LYM289 | 12491.1 | E | 0.572 | 1.03E−02 | 30.8 |
| LYM240 | 12682.1 | G | 0.808 | 6.42E−02 | 82.2 | LYM289 | 12492.2 | E | 0.582 | 1.07E−02 | 33.1 |
| LYM79 | 13133.1 | G | 0.604 | 6.96E−02 | 36.2 | LYM132 | 12273.2 | E | 0.566 | 1.31E−02 | 29.5 |
| LYM224 | 13434.2 | G | 0.643 | 7.21E−02 | 44.9 | LYM290 | 12501.3 | E | 0.566 | 1.39E−02 | 29.4 |
| LYM122 | 13714.2 | G | 0.78 | 8.03E−02 | 75.9 | LYM106 | 12142.2 | E | 0.565 | 1.55E−02 | 29.3 |
| LYM245 | 13064.8 | G | 0.569 | 8.26E−02 | 28.3 | LYM10 | 11742.2 | E | 0.568 | 1.60E−02 | 30 |
| LYM40 | 13732.1 | G | 0.68 | 8.52E−02 | 53.3 | LYM13 | 11774.1 | E | 0.562 | 1.77E−02 | 28.5 |
| LYM249 | 13631.2 | G | 0.804 | 8.60E−02 | 81.3 | LYM113 | 12444.4 | E | 0.554 | 2.37E−02 | 26.7 |
| LYM23 | 12783.6 | G | 0.5 | 8.97E−02 | 12.7 | LYM134 | 12311.2 | E | 0.553 | 2.63E−02 | 26.4 |
| LYM79 | 13134.3 | G | 0.557 | 9.71E−02 | 25.7 | LYM10 | 11741.4 | E | 0.554 | 2.69E−02 | 26.7 |
| CONTROL | — | G | 0.443 | — | 0 | LYM10 | 11741.2 | E | 0.548 | 3.19E−02 | 25.4 |
| LYM122 | 13714.4 | H | 0.095 | 0.00E+00 | 118.7 | LYM132 | 12275.1 | E | 0.551 | 3.90E−02 | 26 |
| LYM122 | 13713.2 | H | 0.072 | 0.00E+00 | 66.2 | LYM132 | 12276.1 | E | 0.55 | 3.90E−02 | 25.8 |
| LYM122 | 13712.3 | H | 0.064 | 0.00E+00 | 47 | LYM290 | 12504.1 | E | 0.548 | 4.08E−02 | 25.2 |
| LYM164 | 12813.5 | H | 0.08 | 0.00E+00 | 84.1 | LYM129 | 12571.3 | E | 0.549 | 4.67E−02 | 25.5 |
| LYM193 | 13484.3 | H | 0.073 | 0.00E+00 | 67 | LYM289 | 12493.2 | E | 0.541 | 5.42E−02 | 23.7 |
| LYM217 | 13183.2 | H | 0.089 | 0.00E+00 | 104.8 | LYM289 | 12491.4 | E | 0.543 | 5.79E−02 | 24.1 |
| LYM217 | 13182.1 | H | 0.084 | 0.00E+00 | 93 | LYM113 | 12442.1 | E | 0.54 | 6.19E−02 | 23.4 |
| LYM217 | 13181.11 | H | 0.069 | 0.00E+00 | 58.8 | LYM102 | 12222.2 | E | 0.541 | 6.54E−02 | 23.6 |
| LYM224 | 13435.3 | H | 0.07 | 0.00E+00 | 60.5 | LYM134 | 12314.2 | E | 0.53 | 7.02E−02 | 21.2 |
| LYM23 | 12783.7 | H | 0.089 | 0.00E+00 | 104 | LYM102 | 12222.6 | E | 0.524 | 9.02E−02 | 19.9 |
| LYM23 | 12782.6 | H | 0.082 | 0.00E+00 | 89 | LYM140 | 12262.3 | E | 0.531 | 9.82E−02 | 21.4 |
| LYM23 | 12784.6 | H | 0.073 | 0.00E+00 | 68.3 | CONTROL | — | E | 0.437 | — | 0 |
| LYM23 | 12783.5 | H | 0.066 | 0.00E+00 | 51.8 | LYM129 | 12573.5 | F | 7.529 | 0.00E+00 | 48.8 |
| LYM245 | 13061.6 | H | 0.081 | 0.00E+00 | 85.2 | LYM148 | 12174.1 | F | 6.576 | 0.00E+00 | 30 |
| LYM245 | 13062.5 | H | 0.078 | 0.00E+00 | 79.4 | LYM102 | 12222.6 | F | 6.331 | 1.00E−06 | 25.2 |
| LYM249 | 13633.1 | H | 0.098 | 0.00E+00 | 123.9 | LYM134 | 12311.2 | F | 6.314 | 1.00E−06 | 24.8 |
| LYM249 | 13631.1 | H | 0.068 | 0.00E+00 | 56.9 | LYM290 | 12502.4 | F | 6.934 | 3.00E−06 | 37.1 |
| LYM251 | 13073.7 | H | 0.097 | 0.00E+00 | 122.4 | LYM132 | 12273.2 | F | 6.468 | 8.00E−06 | 27.9 |
| LYM251 | 13073.8 | H | 0.088 | 0.00E+00 | 102.1 | LYM289 | 12491.1 | F | 6.657 | 2.20E−05 | 31.6 |
| LYM251 | 13072.6 | H | 0.087 | 0.00E+00 | 100.7 | LYM290 | 12501.3 | F | 6.059 | 4.00E−05 | 19.8 |
| LYM251 | 13072.8 | H | 0.087 | 0.00E+00 | 99.1 | LYM134 | 12314.2 | F | 6.204 | 7.70E−05 | 22.6 |
| LYM251 | 13074.6 | H | 0.068 | 0.00E+00 | 56.4 | LYM148 | 12173.1 | F | 6.77 | 1.40E−04 | 33.8 |
| LYM273 | 13721.3 | H | 0.106 | 0.00E+00 | 143.3 | LYM13 | 11774.1 | F | 6.459 | 1.53E−04 | 27.7 |
| LYM273 | 13723.1 | H | 0.089 | 0.00E+00 | 104 | LYM290 | 12501.2 | F | 6.823 | 1.66E−04 | 34.9 |
| LYM273 | 13722.4 | H | 0.081 | 0.00E+00 | 85.6 | LYM113 | 12444.4 | F | 6.325 | 1.73E−04 | 25 |
| LYM273 | 13721.1 | H | 0.074 | 0.00E+00 | 70.2 | LYM10 | 11744.5 | F | 7.044 | 1.83E−04 | 39.3 |
| LYM273 | 13722.3 | H | 0.067 | 0.00E+00 | 54.8 | LYM268 | 12483.2 | F | 6.83 | 1.89E−04 | 35 |
| LYM274 | 13414.2 | H | 0.094 | 0.00E+00 | 115.6 | LYM289 | 12492.2 | F | 6.926 | 2.40E−04 | 36.9 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM274 | 13413.4 | H | 0.078 | 0.00E+00 | 78.9 | LYM289 | 12493.6 | F | 7.108 | 4.29E−04 | 40.5 |
| LYM79 | 13132.2 | H | 0.095 | 0.00E+00 | 117 | LYM148 | 12172.1 | F | 6.754 | 6.38E−04 | 33.5 |
| LYM79 | 13133.3 | H | 0.07 | 0.00E+00 | 60.2 | LYM268 | 12482.3 | F | 6.814 | 7.13E−04 | 34.7 |
| LYM217 | 13181.6 | H | 0.066 | 1.00E−06 | 51.9 | LYM113 | 12443.1 | F | 6.925 | 9.38E−04 | 36.9 |
| LYM249 | 13631.4 | H | 0.085 | 1.00E−06 | 95.9 | LYM140 | 12261.4 | F | 6.847 | 1.17E−03 | 35.4 |
| LYM274 | 13415.2 | H | 0.074 | 1.00E−06 | 69.9 | LYM148 | 12173.5 | F | 6.568 | 1.48E−03 | 29.8 |
| LYM79 | 13133.1 | H | 0.064 | 1.00E−06 | 47.7 | LYM113 | 12444.5 | F | 6.079 | 1.72E−03 | 20.2 |
| LYM164 | 12813.8 | H | 0.067 | 2.00E−06 | 54 | LYM102 | 12222.1 | F | 7.226 | 2.12E−03 | 42.8 |
| LYM224 | 13435.1 | H | 0.089 | 2.00E−06 | 104.8 | LYM10 | 11741.2 | F | 5.976 | 2.26E−03 | 18.1 |
| LYM240 | 12682.1 | H | 0.082 | 2.00E−06 | 89 | LYM106 | 12142.2 | F | 6.158 | 2.57E−03 | 21.7 |
| LYM122 | 13714.2 | H | 0.077 | 5.00E−06 | 77.8 | LYM162 | 12231.2 | F | 6.899 | 2.78E−03 | 36.4 |
| LYM40 | 13734.2 | H | 0.056 | 5.00E−06 | 28.3 | LYM10 | 11741.4 | F | 6.128 | 3.19E−03 | 21.2 |
| LYM122 | 13712.1 | H | 0.063 | 1.70E−05 | 43.7 | LYM148 | 12171.2 | F | 6.276 | 4.06E−03 | 24.1 |
| LYM224 | 13434.2 | H | 0.064 | 2.70E−05 | 47.3 | LYM162 | 12234.3 | F | 6.651 | 5.16E−03 | 31.5 |
| LYM40 | 13732.1 | H | 0.068 | 3.00E−05 | 55.4 | LYM268 | 12483.4 | F | 6.746 | 5.50E−03 | 33.4 |
| LYM217 | 13181.7 | H | 0.057 | 9.40E−05 | 31.2 | LYM102 | 12222.3 | F | 7.198 | 7.29E−03 | 42.3 |
| LYM79 | 13134.3 | H | 0.057 | 1.09E−04 | 31.8 | LYM289 | 12493.2 | F | 6.305 | 7.70E−03 | 24.6 |
| LYM260 | 13095.7 | H | 0.063 | 1.15E−04 | 45.5 | LYM113 | 12442.1 | F | 6.438 | 1.27E−02 | 27.3 |
| LYM23 | 12782.7 | H | 0.056 | 1.57E−04 | 28 | LYM102 | 12222.2 | F | 6.677 | 1.28E−02 | 32 |
| LYM40 | 13732.2 | H | 0.056 | 1.93E−04 | 28.4 | LYM290 | 12504.1 | F | 6.296 | 1.34E−02 | 24.5 |
| LYM131 | 12791.5 | H | 0.06 | 3.33E−04 | 37.3 | LYM132 | 12275.1 | F | 6.322 | 1.46E−02 | 25 |
| LYM245 | 13064.8 | H | 0.057 | 4.25E−04 | 29.9 | LYM132 | 12275.3 | F | 5.863 | 1.47E−02 | 15.9 |
| LYM274 | 13411.2 | H | 0.053 | 6.16E−04 | 22.6 | LYM132 | 12276.1 | F | 6.536 | 1.48E−02 | 29.2 |
| LYM79 | 13134.2 | H | 0.054 | 1.51E−03 | 24.6 | LYM106 | 12142.1 | F | 6.22 | 1.59E−02 | 23 |
| LYM260 | 13095.1 | H | 0.07 | 2.31E−03 | 61.7 | LYM10 | 11742.2 | F | 6.226 | 1.66E−02 | 23.1 |
| LYM23 | 12783.8 | H | 0.052 | 2.84E−03 | 18.8 | LYM106 | 12141.4 | F | 5.811 | 2.02E−02 | 14.9 |
| LYM274 | 13413.1 | H | 0.055 | 9.12E−03 | 25.3 | LYM162 | 12231.3 | F | 6.508 | 2.18E−02 | 28.7 |
| LYM249 | 13631.4 | H | 0.051 | 9.60E−03 | 17.4 | LYM129 | 12571.3 | F | 6.499 | 3.26E−02 | 28.5 |
| LYM164 | 12814.8 | H | 0.061 | 1.06E−02 | 39.9 | LYM13 | 11772.2 | F | 6.13 | 3.39E−02 | 21.2 |
| LYM224 | 13435.5 | H | 0.05 | 1.25E−02 | 15.3 | LYM132 | 12271.4 | F | 5.814 | 4.00E−02 | 14.9 |
| LYM131 | 12791.8 | H | 0.064 | 1.66E−02 | 47.4 | LYM13 | 11772.1 | F | 5.743 | 6.50E−02 | 13.5 |
| LYM193 | 13482.4 | H | 0.055 | 2.52E−02 | 26.1 | LYM129 | 12573.1 | F | 5.783 | 6.75E−02 | 14.3 |
| LYM260 | 13095.8 | H | 0.052 | 4.62E−02 | 19.8 | LYM13 | 11773.2 | F | 5.505 | 6.85E−02 | 8.8 |
| LYM224 | 13432.1 | H | 0.049 | 4.71E−02 | 13 | LYM3 | 12042.1 | F | 5.673 | 6.99E−02 | 12.1 |
| CONTROL | — | H | 0.044 | — | 0 | LYM268 | 12481.1 | F | 6.056 | 7.44E−02 | 19.7 |
| LYM122 | 13711.3 | A | 0.011 | 1.00E−06 | 231.7 | LYM134 | 12312.4 | F | 6.028 | 9.99E−02 | 19.2 |
| LYM234 | 14093.2 | A | 0.01 | 2.10E−05 | 192.5 | CONTROL | — | F | 5.058 | — | 0 |
| LYM189 | 13315.2 | A | 0.01 | 5.08E−04 | 197.1 | LYM134 | 12312.4 | G | 0.704 | 0.00E+00 | 57.1 |
| LYM217 | 13183.2 | A | 0.008 | 5.11E−04 | 130.3 | LYM140 | 12261.2 | G | 0.636 | 0.00E+00 | 42 |
| LYM189 | 13314.5 | A | 0.005 | 9.45E−04 | 67.4 | LYM162 | 12234.3 | G | 0.912 | 1.00E−06 | 103.5 |
| LYM79 | 13134.3 | A | 0.005 | 9.97E−04 | 62 | LYM290 | 12502.4 | G | 0.667 | 1.30E−05 | 48.9 |
| LYM161 | 13233.5 | A | 0.007 | 1.28E−03 | 124.2 | LYM162 | 12234.4 | G | 0.75 | 5.67E−04 | 67.5 |
| LYM217 | 13186.1 | A | 0.012 | 1.32E−03 | 275.4 | LYM140 | 12262.2 | G | 0.903 | 6.14E−04 | 101.7 |
| LYM217 | 13181.9 | A | 0.008 | 1.81E−03 | 134.2 | LYM132 | 12276.1 | G | 0.821 | 1.92E−03 | 83.4 |
| LYM32 | 13964.1 | A | 0.008 | 2.09E−03 | 144.9 | LYM140 | 12261.4 | G | 0.543 | 2.25E−03 | 21.2 |
| LYM234 | 14092.5 | A | 0.012 | 2.20E−03 | 277 | LYM13 | 11772.2 | G | 0.634 | 3.99E−03 | 41.6 |
| LYM240 | 12683.5 | A | 0.01 | 2.37E−03 | 192.5 | LYM289 | 12492.2 | G | 0.88 | 4.21E−03 | 96.5 |
| LYM219 | 13332.9 | A | 0.011 | 3.78E−03 | 233.2 | LYM132 | 12271.4 | G | 0.609 | 4.24E−03 | 36 |
| LYM278 | 13364.5 | A | 0.004 | 3.79E−03 | 24.4 | LYM289 | 12491.1 | G | 0.691 | 5.40E−03 | 54.3 |
| LYM245 | 13061.8 | A | 0.013 | 3.90E−03 | 306.9 | LYM268 | 12482.1 | G | 0.936 | 6.27E−03 | 108.9 |
| LYM234 | 14092.1 | A | 0.005 | 5.44E−03 | 42 | LYM3 | 12041.2 | G | 0.661 | 6.62E−03 | 47.6 |
| LYM74 | 13954.1 | A | 0.014 | 8.73E−03 | 315.4 | LYM162 | 12231.3 | G | 0.748 | 7.40E−03 | 67 |
| LYM74 | 13954.2 | A | 0.009 | 1.17E−02 | 175.6 | LYM268 | 12483.4 | G | 0.717 | 7.99E−03 | 60.2 |
| LYM188 | 13244.6 | A | 0.005 | 1.21E−02 | 53.6 | LYM290 | 12504.1 | G | 0.562 | 8.97E−03 | 25.4 |
| LYM189 | 13311.3 | A | 0.009 | 1.35E−02 | 186.4 | LYM3 | 12043.2 | G | 0.635 | 9.85E−03 | 41.8 |
| LYM189 | 13311.2 | A | 0.01 | 1.83E−02 | 194.8 | LYM148 | 12173.1 | G | 0.849 | 1.05E−02 | 89.5 |
| LYM274 | 13415.2 | A | 0.012 | 1.98E−02 | 273.9 | LYM13 | 11774.1 | G | 0.789 | 1.16E−02 | 76.1 |
| LYM79 | 13132.2 | A | 0.013 | 2.07E−02 | 300 | LYM140 | 12261.1 | G | 0.521 | 1.27E−02 | 16.3 |
| LYM217 | 13182.1 | A | 0.012 | 2.10E−02 | 269.3 | LYM106 | 12142.1 | G | 0.919 | 1.37E−02 | 105.3 |
| LYM240 | 12682.1 | A | 0.012 | 2.22E−02 | 264.7 | LYM134 | 12312.3 | G | 0.781 | 1.42E−02 | 74.4 |
| LYM189 | 13315.1 | A | 0.017 | 2.23E−02 | 422.8 | LYM3 | 12042.1 | G | 0.693 | 2.41E−02 | 54.8 |
| LYM188 | 13244.7 | A | 0.006 | 2.61E−02 | 87.3 | LYM113 | 12442.1 | G | 0.702 | 2.51E−02 | 56.8 |
| LYM79 | 13133.2 | A | 0.009 | 3.08E−02 | 161.8 | LYM102 | 12222.3 | G | 1.04 | 2.56E−02 | 132.2 |
| LYM79 | 13133.5 | A | 0.009 | 3.18E−02 | 183.3 | LYM113 | 12444.5 | G | 0.672 | 3.11E−02 | 50 |
| LYM189 | 13314.4 | A | 0.009 | 3.27E−02 | 167.9 | LYM289 | 12493.2 | G | 0.747 | 3.12E−02 | 66.7 |
| LYM188 | 13244.4 | A | 0.01 | 3.40E−02 | 220.2 | LYM129 | 12573.5 | G | 0.69 | 3.20E−02 | 54.1 |
| LYM79 | 13134.1 | A | 0.01 | 3.50E−02 | 194.8 | LYM113 | 12444.4 | G | 0.647 | 3.21E−02 | 44.4 |
| LYM274 | 13413.1 | A | 0.009 | 3.63E−02 | 166.4 | LYM134 | 12311.2 | G | 0.702 | 3.87E−02 | 56.7 |
| LYM234 | 14092.8 | A | 0.012 | 3.81E−02 | 268.5 | LYM129 | 12573.1 | G | 0.582 | 3.90E−02 | 30 |
| LYM74 | 13952.2 | A | 0.009 | 3.97E−02 | 181 | LYM132 | 12275.3 | G | 0.614 | 3.97E−02 | 37 |
| LYM32 | 13963.4 | A | 0.008 | 4.02E−02 | 151.8 | LYM113 | 12443.1 | G | 0.865 | 4.24E−02 | 93.2 |
| LYM274 | 13413.4 | A | 0.009 | 4.20E−02 | 169.5 | LYM102 | 12222.1 | G | 1.124 | 4.88E−02 | 151 |
| LYM234 | 14091.1 | A | 0.008 | 4.79E−02 | 131.1 | LYM106 | 12144.4 | G | 0.638 | 5.62E−02 | 42.4 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM161 | 13233.6 | A | 0.01 | 5.45E−02 | 220.9 | LYM102 | 12222.2 | G | 0.887 | 6.97E−02 | 98.1 |
| LYM240 | 12683.9 | A | 0.004 | 5.60E−02 | 28.2 | LYM148 | 12172.1 | G | 0.649 | 7.46E−02 | 44.8 |
| LYM79 | 13131.1 | A | 0.007 | 6.26E−02 | 116.5 | LYM102 | 12221.1 | G | 0.744 | 7.72E−02 | 66.1 |
| LYM32 | 13963.1 | A | 0.005 | 6.95E−02 | 49.7 | LYM10 | 11744.5 | G | 0.556 | 8.52E−02 | 24.1 |
| LYM273 | 13721.3 | A | 0.006 | 7.08E−02 | 80.4 | LYM290 | 12501.2 | G | 0.664 | 9.90E−02 | 48.2 |
| LYM79 | 13134.2 | A | 0.004 | 7.89E−02 | 32.8 | CONTROL | — | G | 0.448 | — | 0 |
| LYM217 | 13181.6 | A | 0.005 | 8.18E−02 | 61.2 | LYM102 | 12222.1 | H | 0.118 | 0.00E+00 | 160.6 |
| LYM122 | 13713.4 | A | 0.005 | 9.83E−02 | 51.2 | LYM102 | 12222.3 | H | 0.113 | 0.00E+00 | 149.3 |
| CONTROL | — | A | 0.003 | — | 0 | LYM106 | 12142.1 | H | 0.091 | 0.00E+00 | 101.4 |
| LYM161 | 13233.6 | B | 0.146 | 0.00E+00 | 123.8 | LYM132 | 12276.1 | H | 0.084 | 0.00E+00 | 85.3 |
| LYM189 | 13314.5 | B | 0.103 | 0.00E+00 | 57.6 | LYM140 | 12262.2 | H | 0.088 | 0.00E+00 | 94.1 |
| LYM234 | 14093.2 | B | 0.181 | 3.00E−06 | 177.1 | LYM148 | 12173.1 | H | 0.084 | 0.00E+00 | 86.3 |
| LYM32 | 13964.1 | B | 0.145 | 5.12E−04 | 122.8 | LYM162 | 12234.3 | H | 0.091 | 0.00E+00 | 100.3 |
| LYM234 | 14092.5 | B | 0.219 | 6.15E−04 | 235.5 | LYM268 | 12482.1 | H | 0.094 | 0.00E+00 | 108.2 |
| LYM122 | 13711.3 | B | 0.225 | 6.83E−04 | 245.3 | LYM289 | 12492.2 | H | 0.092 | 0.00E+00 | 104 |
| LYM240 | 12683.5 | B | 0.179 | 8.14E−04 | 173.6 | LYM13 | 11774.1 | H | 0.079 | 1.00E−06 | 74.4 |
| LYM245 | 13061.8 | B | 0.24 | 1.32E−03 | 268.1 | LYM162 | 12234.4 | H | 0.074 | 3.00E−06 | 64.8 |
| LYM217 | 13186.1 | B | 0.197 | 1.61E−03 | 202.2 | LYM268 | 12483.4 | H | 0.076 | 3.00E−06 | 68.5 |
| LYM217 | 13183.2 | B | 0.144 | 1.66E−03 | 120.5 | LYM134 | 12312.3 | H | 0.077 | 4.00E−06 | 70 |
| LYM189 | 13315.2 | B | 0.212 | 4.60E−03 | 224.4 | LYM113 | 12443.1 | H | 0.087 | 5.00E−06 | 91.5 |
| LYM219 | 13332.9 | B | 0.194 | 5.69E−03 | 197.9 | LYM162 | 12231.3 | H | 0.074 | 8.00E−06 | 63.1 |
| LYM74 | 13954.2 | B | 0.157 | 7.07E−03 | 141.3 | LYM290 | 12502.4 | H | 0.071 | 1.30E−05 | 57.2 |
| LYM217 | 13182.1 | B | 0.231 | 7.34E−03 | 253.5 | LYM129 | 12573.5 | H | 0.075 | 2.20E−05 | 66.3 |
| LYM234 | 14092.1 | B | 0.087 | 7.90E−03 | 33 | LYM134 | 12312.4 | H | 0.069 | 3.10E−05 | 52.5 |
| LYM278 | 13364.5 | B | 0.076 | 8.29E−03 | 17 | LYM102 | 12222.2 | H | 0.087 | 7.00E−05 | 91.6 |
| LYM74 | 13954.1 | B | 0.248 | 8.32E−03 | 280 | LYM289 | 12491.1 | H | 0.069 | 9.40E−05 | 53.2 |
| LYM217 | 13181.9 | B | 0.151 | 8.57E−03 | 130.7 | LYM113 | 12444.4 | H | 0.071 | 1.12E−04 | 56.9 |
| LYM189 | 13311.2 | B | 0.174 | 8.79E−03 | 166.7 | LYM134 | 12311.2 | H | 0.071 | 1.62E−04 | 57.5 |
| LYM32 | 13963.4 | B | 0.163 | 8.96E−03 | 149.3 | LYM102 | 12221.1 | H | 0.076 | 2.25E−04 | 68.8 |
| LYM240 | 12683.9 | B | 0.077 | 9.39E−03 | 18.7 | LYM289 | 12493.2 | H | 0.071 | 2.37E−04 | 57.5 |
| LYM189 | 13311.3 | B | 0.176 | 1.20E−02 | 169 | LYM3 | 12042.1 | H | 0.068 | 4.18E−04 | 49.7 |
| LYM79 | 13134.1 | B | 0.173 | 1.36E−02 | 165.4 | LYM113 | 12442.1 | H | 0.067 | 7.34E−04 | 49.1 |
| LYM79 | 13133.3 | B | 0.169 | 1.42E−02 | 158.3 | LYM148 | 12172.1 | H | 0.068 | 8.70E−04 | 50.9 |
| LYM240 | 12682.1 | B | 0.202 | 1.49E−02 | 209.5 | LYM129 | 12571.3 | H | 0.07 | 1.22E−03 | 54.8 |
| LYM79 | 13132.2 | B | 0.237 | 1.69E−02 | 262.6 | LYM113 | 12444.4 | H | 0.066 | 1.82E−03 | 45.3 |
| LYM188 | 13244.7 | B | 0.116 | 1.77E−02 | 77.9 | LYM290 | 12501.2 | H | 0.068 | 1.94E−03 | 50 |
| LYM188 | 13244.6 | B | 0.102 | 2.08E−02 | 56.2 | LYM3 | 12041.2 | H | 0.063 | 2.54E−03 | 38.7 |
| LYM189 | 13315.1 | B | 0.281 | 2.09E−02 | 330 | LYM140 | 12261.2 | H | 0.061 | 4.70E−03 | 34.5 |
| LYM79 | 13134.2 | B | 0.087 | 2.10E−02 | 33.3 | LYM3 | 12043.2 | H | 0.061 | 6.01E−03 | 35.8 |
| LYM189 | 13314.4 | B | 0.158 | 2.19E−02 | 141.4 | LYM132 | 12275.3 | H | 0.061 | 9.29E−03 | 34.2 |
| LYM188 | 13244.4 | B | 0.196 | 2.23E−02 | 200.6 | LYM13 | 11772.2 | H | 0.06 | 9.79E−03 | 32.3 |
| LYM161 | 13233.6 | B | 0.185 | 2.28E−02 | 183.3 | LYM106 | 12141.4 | H | 0.063 | 1.25E−02 | 39.7 |
| LYM274 | 13415.2 | B | 0.217 | 2.29E−02 | 232.4 | LYM106 | 12144.4 | H | 0.06 | 1.94E−02 | 32.6 |
| LYM274 | 13413.4 | B | 0.152 | 2.34E−02 | 133.3 | LYM268 | 12481.1 | H | 0.061 | 2.01E−02 | 34.4 |
| LYM234 | 14091.1 | B | 0.149 | 2.38E−02 | 129 | LYM134 | 12314.2 | H | 0.059 | 2.35E−02 | 29.9 |
| LYM79 | 13133.2 | B | 0.156 | 2.45E−02 | 139.7 | LYM129 | 12573.1 | H | 0.057 | 3.09E−02 | 27.1 |
| LYM79 | 13134.3 | B | 0.109 | 2.50E−02 | 67.5 | LYM132 | 12271.4 | H | 0.057 | 3.88E−02 | 25.2 |
| LYM273 | 13721.3 | B | 0.112 | 2.82E−02 | 71.3 | LYM113 | 12442.2 | H | 0.059 | 3.90E−02 | 30 |
| LYM274 | 13413.1 | B | 0.167 | 3.18E−02 | 156.6 | LYM10 | 11744.5 | H | 0.056 | 5.50E−02 | 24.8 |
| LYM217 | 13181.6 | B | 0.1 | 3.59E−02 | 53.3 | LYM290 | 12504.1 | H | 0.056 | 5.52E−02 | 23 |
| LYM234 | 14092.8 | B | 0.208 | 3.90E−02 | 219.4 | LYM129 | 12572.2 | H | 0.055 | 9.34E−02 | 21.4 |
| LYM32 | 13963.1 | B | 0.093 | 5.12E−02 | 42.1 | LYM289 | 12491.4 | H | 0.056 | 9.88E−02 | 23.2 |
| LYM74 | 13952.2 | B | 0.154 | 5.75E−02 | 136.2 | CONTROL | — | H | 0.045 | — | 0 |
| LYM79 | 13131.1 | B | 0.152 | 6.99E−02 | 133.1 | LYM248 | 13502.6 | A | 0.004 | 1.00E−05 | 49 |
| LYM161 | 13234.6 | B | 0.136 | 7.51E−02 | 108.5 | LYM79 | 13134.7 | A | 0.004 | 6.75E−04 | 67 |
| LYM219 | 13334.8 | B | 0.114 | 7.99E−02 | 74.8 | LYM157 | 13341.4 | A | 0.006 | 1.12E−03 | 127 |
| LYM219 | 13331.1 | B | 0.149 | 9.01E−02 | 127.7 | LYM180 | 13442.7 | A | 0.004 | 1.29E−03 | 75 |
| CONTROL | — | B | 0.065 | — | 0 | LYM180 | 13442.6 | A | 0.004 | 2.39E−03 | 78 |
| LYM122 | 13711.3 | C | 0.947 | 0.00E+00 | 73.9 | LYM52 | 12894.6 | A | 0.004 | 3.08E−03 | 50 |
| LYM161 | 13233.6 | C | 1.001 | 0.00E+00 | 83.9 | LYM157 | 13341.1 | A | 0.007 | 3.26E−03 | 182 |
| LYM189 | 13315.1 | C | 1.281 | 0.00E+00 | 135.3 | LYM79 | 13131.6 | A | 0.006 | 3.45E−03 | 146 |
| LYM189 | 13315.2 | C | 1.278 | 0.00E+00 | 134.6 | LYM213 | 12842.8 | A | 0.009 | 5.95E−03 | 260 |
| LYM189 | 13311.2 | C | 1.043 | 0.00E+00 | 91.5 | LYM157 | 13341.3 | A | 0.013 | 6.38E−03 | 420 |
| LYM219 | 13332.9 | C | 1.169 | 0.00E+00 | 114.6 | LYM120 | 13382.2 | A | 0.007 | 1.08E−02 | 192 |
| LYM234 | 14092.5 | C | 1.196 | 0.00E+00 | 119.5 | LYM213 | 12842.9 | A | 0.008 | 1.10E−02 | 235 |
| LYM240 | 12683.5 | C | 1.114 | 0.00E+00 | 104.6 | LYM117 | 13624.7 | A | 0.004 | 1.29E−02 | 59 |
| LYM240 | 12682.1 | C | 1.053 | 0.00E+00 | 93.4 | LYM79 | 13132.6 | A | 0.004 | 1.41E−02 | 64 |
| LYM274 | 13413.4 | C | 1.205 | 0.00E+00 | 121.3 | LYM52 | 12895.7 | A | 0.009 | 1.45E−02 | 262 |
| LYM274 | 13415.2 | C | 1.108 | 0.00E+00 | 103.4 | LYM107 | 12631.1 | A | 0.007 | 1.50E−02 | 189 |
| LYM32 | 13964.1 | C | 1.001 | 0.00E+00 | 83.9 | LYM120 | 13382.8 | A | 0.007 | 1.53E−02 | 160 |
| LYM74 | 13954.1 | C | 1.346 | 0.00E+00 | 147.2 | LYM120 | 13382.1 | A | 0.006 | 1.71E−02 | 157 |
| LYM74 | 13954.2 | C | 1.133 | 0.00E+00 | 108.1 | LYM213 | 12841.8 | A | 0.005 | 1.96E−02 | 114 |
| LYM79 | 13132.2 | C | 1.066 | 0.00E+00 | 95.8 | LYM227 | 14542.1 | A | 0.004 | 2.27E−02 | 43 |

TABLE 34-continued

Results obtained in a T2 experiment at the tissue culture assay

| Gene name | Event | ID | Mean | P value | % incr. vs. cont. | Gene name | Event ID | Mean | P value | % incr. vs. cont. |
|---|---|---|---|---|---|---|---|---|---|---|
| LYM79 | 13134.1 | C | 1.018 | 0.00E+00 | 86.9 | LYM120 | 13382.3 A | 0.008 | 2.67E−02 | 225 |
| LYM217 | 13181.6 | C | 0.974 | 1.00E−06 | 78.9 | LYM52 | 12894.7 A | 0.011 | 3.21E−02 | 334 |
| LYM245 | 13061.8 | C | 0.949 | 1.00E−06 | 74.3 | LYM227 | 14544.2 A | 0.004 | 3.26E−02 | 53 |
| LYM32 | 13963.4 | C | 0.949 | 2.00E−06 | 74.3 | LYM52 | 12894.8 A | 0.005 | 3.45E−02 | 88 |
| LYM188 | 13244.4 | C | 0.907 | 3.00E−06 | 66.6 | LYM180 | 13441.7 A | 0.009 | 3.65E−02 | 259 |
| LYM189 | 13311.3 | C | 0.923 | 3.00E−06 | 69.5 | LYM248 | 13503.5 A | 0.004 | 3.65E−02 | 75 |
| LYM234 | 14091.1 | C | 0.981 | 1.40E−05 | 80.1 | LYM213 | 12841.6 A | 0.006 | 3.85E−02 | 125 |
| LYM217 | 13186.1 | C | 0.889 | 1.90E−05 | 63.3 | LYM107 | 12633.4 A | 0.004 | 3.86E−02 | 71 |
| LYM234 | 14092.8 | C | 0.957 | 1.90E−05 | 75.7 | LYM117 | 13622.6 A | 0.004 | 3.99E−02 | 51 |
| LYM234 | 14093.2 | C | 0.872 | 3.90E−05 | 60.1 | LYM227 | 14542.3 A | 0.003 | 4.02E−02 | 37 |
| LYM79 | 13133.2 | C | 0.903 | 5.00E−05 | 65.8 | LYM227 | 14542.5 A | 0.003 | 4.55E−02 | 32 |
| LYM74 | 13952.2 | C | 0.95 | 1.17E−04 | 74.4 | LYM120 | 13382.4 A | 0.004 | 4.58E−02 | 59 |
| LYM161 | 13233.5 | C | 0.793 | 3.92E−04 | 45.6 | LYM248 | 13504.6 A | 0.003 | 4.71E−02 | 29 |
| LYM274 | 13413.1 | C | 0.919 | 7.62E−04 | 68.8 | LYM52 | 12891.8 A | 0.004 | 5.01E−02 | 62 |
| LYM219 | 13331.1 | C | 0.788 | 2.74E−03 | 44.8 | LYM79 | 13131.5 A | 0.004 | 5.09E−02 | 54 |
| LYM79 | 13131.1 | C | 0.825 | 3.08E−03 | 51.6 | LYM107 | 12632.1 A | 0.004 | 5.18E−02 | 55 |
| LYM240 | 12683.9 | C | 0.753 | 3.59E−03 | 38.2 | LYM248 | 13502.7 A | 0.003 | 5.65E−02 | 27 |
| LYM188 | 13244.7 | C | 0.767 | 4.32E−03 | 40.8 | LYM117 | 13623.9 A | 0.004 | 5.72E−02 | 63 |
| LYM161 | 13234.6 | C | 0.771 | 5.36E−03 | 41.5 | LYM157 | 13342.4 A | 0.003 | 6.07E−02 | 30 |
| LYM79 | 13133.3 | C | 0.765 | 9.03E−03 | 40.4 | LYM117 | 13621.8 A | 0.004 | 6.42E−02 | 41 |
| LYM189 | 13314.4 | C | 0.75 | 9.65E−03 | 37.7 | LYM180 | 13441.5 A | 0.007 | 9.29E−02 | 178 |
| LYM273 | 13721.3 | C | 0.706 | 2.08E−02 | 29.7 | CONTROL | — A | 0.003 | — | 0 |
| LYM79 | 13134.3 | C | 0.708 | 2.18E−02 | 30 | LYM79 | 13132.6 B | 0.097 | 0.00E+00 | 57 |
| LYM188 | 13244.6 | C | 0.676 | 6.45E−02 | 24.2 | LYM248 | 13502.6 B | 0.084 | 3.80E−05 | 36.3 |
| LYM234 | 14092.1 | C | 0.66 | 8.67E−02 | 21.2 | LYM52 | 12894.6 B | 0.077 | 1.17E−03 | 24.1 |
| LYM32 | 13963.1 | C | 0.686 | 9.24E−02 | 26 | LYM120 | 13382.8 B | 0.143 | 1.23E−03 | 130.6 |
| CONTROL | — | C | 0.545 | — | 0 | LYM213 | 12842.8 B | 0.197 | 1.73E−03 | 218 |
| LYM32 | 13964.1 | D | 8.651 | 0.00E+00 | 79.9 | LYM157 | 13341.4 B | 0.117 | 3.42E−03 | 88.4 |
| LYM219 | 13332.9 | D | 10.491 | 1.00E−05 | 118.2 | LYM227 | 14544.2 B | 0.093 | 4.06E−03 | 50.6 |
| LYM122 | 13711.3 | D | 8.611 | 5.80E−05 | 79.1 | LYM120 | 13382.2 B | 0.164 | 4.26E−03 | 164.9 |
| LYM161 | 13233.5 | D | 7.326 | 1.20E−04 | 52.3 | LYM107 | 12633.4 B | 0.102 | 4.42E−03 | 65.5 |
| LYM188 | 13244.4 | D | 8.097 | 2.06E−04 | 68.4 | LYM52 | 12895.7 B | 0.185 | 4.74E−03 | 198.5 |
| LYM234 | 14092.5 | D | 10.54 | 7.64E−04 | 119.2 | LYM117 | 13621.8 B | 0.083 | 5.00E−03 | 33.8 |
| LYM79 | 13132.2 | D | 9.36 | 3.54E−03 | 94.6 | LYM180 | 13442.6 B | 0.095 | 5.31E−03 | 53.8 |
| LYM74 | 13954.2 | D | 9.855 | 5.72E−03 | 104.9 | LYM107 | 12631.1 B | 0.182 | 5.88E−03 | 193.5 |
| LYM189 | 13315.2 | D | 10.946 | 5.76E−03 | 127.6 | LYM248 | 13504.6 B | 0.08 | 6.04E−03 | 29.8 |
| LYM74 | 13954.1 | D | 11.981 | 6.16E−03 | 149.1 | LYM157 | 13341.1 B | 0.176 | 6.92E−03 | 183.8 |
| LYM274 | 13413.4 | D | 10.317 | 7.08E−03 | 114.5 | LYM157 | 13341.3 B | 0.289 | 8.30E−03 | 367.8 |
| LYM161 | 13233.6 | D | 8.869 | 8.43E−03 | 84.4 | LYM120 | 13382.4 B | 0.087 | 8.44E−03 | 41.4 |
| LYM274 | 13415.2 | D | 9.623 | 8.58E−03 | 100.1 | LYM79 | 13131.6 B | 0.153 | 9.73E−03 | 146.6 |
| LYM245 | 13061.8 | D | 8.368 | 8.65E−03 | 74 | LYM117 | 13622.5 B | 0.089 | 1.06E−02 | 44 |
| LYM189 | 13315.1 | D | 11.293 | 1.02E−02 | 134.8 | LYM157 | 13342.4 B | 0.092 | 1.14E−02 | 49 |
| LYM234 | 14093.2 | D | 7.632 | 1.08E−02 | 58.7 | LYM120 | 13383.2 B | 0.189 | 1.26E−02 | 205.1 |
| LYM240 | 12683.9 | D | 6.761 | 1.26E−02 | 40.6 | LYM52 | 12891.8 B | 0.099 | 1.29E−02 | 60.4 |
| LYM189 | 13311.3 | D | 8.149 | 1.49E−02 | 69.5 | LYM227 | 14541.5 B | 0.086 | 1.29E−02 | 39.2 |
| LYM79 | 13134.1 | D | 9.347 | 1.65E−02 | 94.4 | LYM213 | 12842.9 B | 0.183 | 1.30E−02 | 195.5 |
| LYM32 | 13963.4 | D | 8.288 | 1.66E−02 | 72.4 | LYM180 | 13441.7 B | 0.203 | 1.33E−02 | 227.8 |
| LYM240 | 12682.1 | D | 9.747 | 1.72E−02 | 102.7 | LYM120 | 13382.1 B | 0.149 | 1.38E−02 | 140.6 |
| LYM189 | 13311.2 | D | 8.99 | 1.94E−02 | 87 | LYM213 | 12841.6 B | 0.125 | 1.59E−02 | 102.2 |
| LYM79 | 13134.3 | D | 6.431 | 1.94E−02 | 33.7 | LYM180 | 13442.7 B | 0.102 | 2.04E−02 | 64.6 |
| LYM217 | 13186.1 | D | 7.5 | 1.95E−02 | 56 | LYM52 | 12894.7 B | 0.237 | 2.09E−02 | 282.8 |
| LYM217 | 13181.6 | D | 8.443 | 1.96E−02 | 75.6 | LYM117 | 13622.6 B | 0.095 | 2.67E−02 | 53.3 |
| LYM273 | 13721.3 | D | 6.132 | 3.30E−02 | 27.5 | LYM213 | 12841.8 B | 0.118 | 2.79E−02 | 91.6 |
| LYM234 | 14092.1 | D | 5.878 | 3.41E−02 | 22.2 | LYM248 | 13503.5 B | 0.1 | 2.95E−02 | 62 |
| LYM240 | 12683.5 | D | 9.957 | 3.82E−02 | 107.1 | LYM227 | 14542.1 B | 0.096 | 4.16E−02 | 55.3 |
| LYM79 | 13133.2 | D | 8.252 | 4.16E−02 | 71.6 | LYM213 | 12841.5 B | 0.089 | 4.72E−02 | 43.5 |
| LYM234 | 14091.1 | D | 8.586 | 5.33E−02 | 78.5 | LYM117 | 13623.9 B | 0.089 | 4.77E−02 | 44.2 |
| LYM234 | 14092.8 | D | 8.373 | 5.62E−02 | 74.1 | LYM248 | 13502.7 B | 0.076 | 5.33E−02 | 23.7 |
| LYM161 | 13234.6 | D | 7.15 | 7.26E−02 | 48.7 | LYM107 | 12632.1 B | 0.098 | 6.41E−02 | 57.9 |
| LYM219 | 13331.1 | D | 7.096 | 7.41E−02 | 47.6 | LYM180 | 13441.5 B | 0.162 | 6.47E−02 | 162.6 |
| LYM188 | 13244.7 | D | 6.69 | 8.77E−02 | 39.1 | LYM227 | 14542.5 B | 0.071 | 7.28E−02 | 15.4 |
| CONTROL | — | D | 4.809 | — | 0 | LYM52 | 12894.8 B | 0.111 | 7.53E−02 | 79.6 |
| LYM189 | 13315.2 | E | 0.662 | 3.29E−03 | 29.1 | LYM117 | 13624.7 B | 0.082 | 7.84E−02 | 33 |
| LYM274 | 13413.4 | E | 0.646 | 1.08E−02 | 26.1 | LYM248 | 13501.6 B | 0.077 | 8.28E−02 | 24.4 |
| LYM189 | 13315.1 | E | 0.641 | 1.59E−02 | 25 | CONTROL | — B | 0.062 | — | 0 |
| LYM219 | 13332.9 | E | 0.613 | 4.07E−02 | 19.6 | LYM107 | 12631.1 C | 0.831 | 0.00E+00 | 94.2 |
| LYM161 | 13233.6 | E | 0.602 | 7.90E−02 | 17.4 | LYM120 | 13382.3 C | 1.038 | 0.00E+00 | 142.4 |
| LYM32 | 13964.1 | E | 0.6 | 7.97E−02 | 17 | LYM157 | 13341.3 C | 1.141 | 0.00E+00 | 166.5 |
| CONTROL | — | E | 0.513 | — | 0 | LYM157 | 13341.4 C | 0.918 | 0.00E+00 | 114.5 |
| LYM219 | 13332.9 | F | 7.586 | 1.00E−06 | 29 | LYM213 | 12842.8 C | 1.035 | 0.00E+00 | 141.7 |
| LYM32 | 13964.1 | F | 6.962 | 7.00E−06 | 18.4 | LYM52 | 12894.7 C | 0.8 | 0.00E+00 | 86.9 |
| LYM240 | 12682.1 | F | 6.843 | 3.90E−05 | 16.4 | LYM213 | 12842.9 C | 0.762 | 1.00E−06 | 77.9 |
| LYM74 | 13954.1 | F | 7.085 | 4.60E−05 | 20.5 | LYM120 | 13382.2 C | 0.828 | 6.00E−06 | 93.3 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM79 | 13134.1 | F | 7.2 | 1.08E-03 | 22.5 | LYM248 | 13503.5 | C | 0.741 | 6.00E-06 | 73 |
| LYM274 | 13413.4 | F | 7.262 | 1.40E-03 | 23.5 | LYM52 | 12895.7 | C | 0.724 | 2.50E-05 | 69.1 |
| LYM79 | 13132.2 | F | 6.662 | 1.94E-03 | 13.3 | LYM213 | 12841.6 | C | 0.7 | 3.20E-05 | 63.5 |
| LYM189 | 13315.2 | F | 7.591 | 1.99E-03 | 29.1 | LYM120 | 13382.1 | C | 0.695 | 6.10E-05 | 62.3 |
| LYM234 | 14092.5 | F | 7.117 | 2.84E-03 | 21.1 | LYM180 | 13441.7 | C | 0.763 | 8.30E-05 | 78.3 |
| LYM189 | 13315.1 | F | 7.396 | 2.91E-03 | 25.8 | LYM180 | 13442.7 | C | 0.675 | 1.83E-04 | 57.6 |
| LYM74 | 13954.2 | F | 7.089 | 5.06E-03 | 20.6 | LYM79 | 13131.5 | C | 0.68 | 2.64E-04 | 58.9 |
| LYM161 | 13233.6 | F | 6.978 | 1.61E-02 | 18.7 | LYM157 | 13341.1 | C | 0.666 | 5.55E-04 | 55.6 |
| LYM161 | 13233.5 | F | 6.502 | 2.85E-02 | 10.6 | LYM117 | 13621.8 | C | 0.659 | 8.30E-04 | 53.8 |
| LYM122 | 13711.3 | F | 6.643 | 3.74E-02 | 13 | LYM79 | 13131.6 | C | 0.659 | 1.51E-03 | 53.9 |
| LYM240 | 12683.5 | F | 6.978 | 4.00E-02 | 18.7 | LYM52 | 12894.8 | C | 0.67 | 1.78E-03 | 56.5 |
| LYM79 | 13134.3 | F | 6.403 | 5.79E-02 | 8.9 | LYM52 | 12891.8 | C | 0.624 | 1.88E-03 | 45.8 |
| LYM274 | 13415.2 | F | 6.39 | 6.01E-02 | 8.7 | LYM227 | 14542.3 | C | 0.647 | 2.21E-03 | 51.2 |
| LYM245 | 13061.8 | F | 6.366 | 7.89E-02 | 8.3 | LYM157 | 13342.4 | C | 0.616 | 4.48E-03 | 43.8 |
| LYM217 | 13181.6 | F | 6.766 | 8.26E-02 | 15.1 | LYM79 | 13132.6 | C | 0.605 | 4.76E-03 | 41.3 |
| CONTROL | — | F | 5.879 | — | 0 | LYM120 | 13382.8 | C | 0.607 | 5.79E-03 | 41.7 |
| LYM189 | 13315.2 | G | 1.284 | 1.90E-05 | 167.8 | LYM180 | 13441.5 | C | 0.611 | 8.13E-03 | 42.7 |
| LYM217 | 13183.2 | G | 0.973 | 4.10E-05 | 103 | LYM117 | 13622.6 | C | 0.593 | 8.16E-03 | 38.5 |
| LYM74 | 13954.2 | G | 0.931 | 6.30E-05 | 94.1 | LYM248 | 13501.6 | C | 0.604 | 8.30E-03 | 41.1 |
| LYM234 | 14092.5 | G | 1.204 | 1.92E-04 | 151.1 | LYM213 | 12841.5 | C | 0.594 | 9.39E-03 | 38.7 |
| LYM122 | 13711.3 | G | 1.159 | 3.08E-04 | 141.7 | LYM227 | 14544.2 | C | 0.593 | 1.48E-02 | 38.6 |
| LYM240 | 12683.5 | G | 1.042 | 7.28E-04 | 117.2 | LYM107 | 12631.2 | C | 0.588 | 1.80E-02 | 37.4 |
| LYM79 | 13134.3 | G | 0.808 | 1.09E-03 | 68.5 | LYM117 | 13622.5 | C | 0.604 | 1.90E-02 | 41 |
| LYM245 | 13061.8 | G | 1.271 | 1.20E-03 | 165.1 | LYM107 | 12633.4 | C | 0.564 | 2.80E-02 | 31.8 |
| LYM79 | 13132.2 | G | 1.32 | 1.33E-03 | 175.3 | LYM52 | 12894.6 | C | 0.548 | 4.99E-02 | 27.9 |
| LYM234 | 14093.2 | G | 0.943 | 1.41E-03 | 96.7 | LYM79 | 13134.7 | C | 0.536 | 7.39E-02 | 25.2 |
| LYM74 | 13954.1 | G | 1.313 | 1.81E-03 | 173.7 | CONTROL | — | C | 0.428 | — | — |
| LYM217 | 13186.1 | G | 0.911 | 1.88E-03 | 90.1 | LYM157 | 13341.4 | D | 8.101 | 0.00E+00 | 121.4 |
| LYM32 | 13963.1 | G | 0.665 | 2.56E-03 | 38.7 | LYM213 | 12842.9 | D | 6.777 | 1.47E-04 | 85.2 |
| LYM161 | 13233.6 | G | 1.064 | 2.90E-03 | 121.9 | LYM213 | 12841.6 | D | 6.039 | 2.00E-04 | 65 |
| LYM217 | 13182.1 | G | 1.083 | 3.10E-03 | 125.8 | LYM52 | 12894.7 | D | 7.314 | 8.85E-04 | 99.9 |
| LYM219 | 13332.9 | G | 1.063 | 4.10E-03 | 121.8 | LYM117 | 13622.6 | D | 5.113 | 1.50E-03 | 39.7 |
| LYM161 | 13233.5 | G | 1.099 | 4.42E-03 | 129.2 | LYM107 | 12631.1 | D | 7.346 | 1.55E-03 | 100.8 |
| LYM274 | 13415.2 | G | 1.15 | 4.92E-03 | 139.8 | LYM180 | 13442.7 | D | 6.266 | 1.64E-03 | 71.2 |
| LYM274 | 13413.4 | G | 0.899 | 6.80E-03 | 87.4 | LYM120 | 13382.1 | D | 6.103 | 2.38E-03 | 66.8 |
| LYM189 | 13315.1 | G | 1.437 | 7.49E-03 | 199.8 | LYM157 | 13341.3 | D | 9.886 | 2.61E-03 | 170.2 |
| LYM189 | 13311.2 | G | 1.029 | 7.55E-03 | 114.6 | LYM52 | 12891.8 | D | 5.279 | 3.81E-03 | 44.3 |
| LYM32 | 13964.1 | G | 0.844 | 7.69E-03 | 76 | LYM248 | 13503.5 | D | 6.501 | 4.31E-03 | 77.7 |
| LYM79 | 13134.1 | G | 0.99 | 1.05E-02 | 106.5 | LYM107 | 12633.6 | D | 5.081 | 6.28E-03 | 38.9 |
| LYM234 | 14091.1 | G | 0.919 | 1.09E-02 | 91.6 | LYM79 | 13132.6 | D | 5.272 | 7.18E-03 | 44.1 |
| LYM188 | 13244.4 | G | 1.049 | 1.17E-02 | 118.7 | LYM79 | 13134.7 | D | 4.844 | 7.92E-03 | 32.4 |
| LYM217 | 13181.9 | G | 0.775 | 1.18E-02 | 61.6 | LYM79 | 13131.5 | D | 5.961 | 1.41E-02 | 62.9 |
| LYM240 | 12683.9 | G | 0.579 | 1.27E-02 | 20.7 | LYM52 | 12895.7 | D | 6.302 | 1.43E-02 | 72.2 |
| LYM189 | 13311.3 | G | 0.98 | 1.37E-02 | 104.4 | LYM157 | 13341.1 | D | 6.127 | 1.48E-02 | 67.4 |
| LYM278 | 13364.5 | G | 0.574 | 1.37E-02 | 19.7 | LYM213 | 12842.8 | D | 9.745 | 1.57E-02 | 166.3 |
| LYM240 | 12682.1 | G | 1.132 | 1.51E-02 | 136.1 | LYM157 | 13342.4 | D | 5.418 | 1.58E-02 | 48.1 |
| LYM79 | 13133.3 | G | 0.974 | 1.51E-02 | 103.1 | LYM120 | 13382.9 | D | 5.233 | 2.06E-02 | 43 |
| LYM234 | 14092.8 | G | 1.15 | 2.17E-02 | 139.7 | LYM120 | 13382.3 | D | 9.172 | 3.14E-02 | 150.7 |
| LYM188 | 13244.6 | G | 0.58 | 2.18E-02 | 20.9 | LYM213 | 12841.5 | D | 5.044 | 3.32E-02 | 37.9 |
| LYM79 | 13134.2 | G | 0.622 | 2.53E-02 | 29.6 | LYM117 | 13621.8 | D | 5.513 | 4.02E-02 | 50.7 |
| LYM32 | 13963.2 | G | 0.967 | 2.55E-02 | 101.8 | LYM120 | 13382.2 | D | 7.207 | 4.05E-02 | 97 |
| LYM79 | 13133.2 | G | 0.95 | 2.59E-02 | 98 | LYM79 | 13133.6 | D | 4.404 | 4.15E-02 | 20.4 |
| LYM189 | 13314.5 | G | 0.604 | 2.68E-02 | 26 | LYM52 | 12894.6 | D | 4.637 | 4.35E-02 | 26.7 |
| LYM161 | 13234.6 | G | 0.989 | 2.76E-02 | 106.3 | LYM248 | 13501.6 | D | 5.178 | 5.20E-02 | 41.5 |
| LYM74 | 13952.2 | G | 0.837 | 3.56E-02 | 74.5 | LYM180 | 13441.5 | D | 5.621 | 5.27E-02 | 53.6 |
| LYM189 | 13314.4 | G | 0.803 | 3.63E-02 | 67.4 | LYM180 | 13441.7 | D | 6.616 | 5.74E-02 | 80.8 |
| LYM274 | 13413.1 | G | 0.823 | 4.32E-02 | 71.6 | LYM79 | 13131.6 | D | 5.672 | 6.56E-02 | 55 |
| LYM79 | 13131.1 | G | 0.941 | 5.88E-02 | 96.2 | LYM227 | 14542.3 | D | 5.398 | 8.39E-02 | 47.5 |
| LYM188 | 13244.7 | G | 0.741 | 6.09E-02 | 54.5 | CONTROL | — | D | 3.659 | — | 0 |
| LYM234 | 14092.1 | G | 0.616 | 6.23E-02 | 28.6 | LYM157 | 13341.4 | E | 0.563 | 8.32E-03 | 39.2 |
| LYM219 | 13331.1 | G | 0.778 | 8.27E-02 | 62.3 | LYM248 | 13503.5 | E | 0.544 | 1.60E-02 | 34.6 |
| CONTROL | — | G | 0.48 | — | 0 | LYM248 | 13501.6 | E | 0.531 | 2.70E-02 | 31.5 |
| LYM122 | 13711.3 | H | 0.121 | 0.00E+00 | 155.6 | LYM120 | 13382.2 | E | 0.522 | 4.43E-02 | 29.2 |
| LYM161 | 13233.6 | H | 0.112 | 0.00E+00 | 136 | LYM120 | 13382.8 | E | 0.523 | 6.14E-02 | 29.4 |
| LYM161 | 13233.5 | H | 0.11 | 0.00E+00 | 133.1 | LYM107 | 12631.1 | E | 0.511 | 6.15E-02 | 26.4 |
| LYM161 | 13234.6 | H | 0.105 | 0.00E+00 | 122 | LYM120 | 13382.8 | E | 0.511 | 6.32E-02 | 26.4 |
| LYM188 | 13244.4 | H | 0.105 | 0.00E+00 | 121.6 | LYM52 | 12891.8 | E | 0.498 | 9.65E-02 | 23.4 |
| LYM189 | 13315.1 | H | 0.146 | 0.00E+00 | 207.9 | CONTROL | — | E | 0.404 | — | 0 |
| LYM189 | 13315.2 | H | 0.133 | 0.00E+00 | 181.1 | LYM107 | 12631.1 | F | 6.517 | 0.00E+00 | 32.4 |
| LYM189 | 13311.2 | H | 0.106 | 0.00E+00 | 123.6 | LYM157 | 13341.4 | F | 6.663 | 0.00E+00 | 35.4 |
| LYM189 | 13311.3 | H | 0.099 | 0.00E+00 | 109.8 | LYM79 | 13131.5 | F | 6.658 | 2.30E-05 | 35.3 |
| LYM217 | 13182.1 | H | 0.117 | 0.00E+00 | 146.7 | LYM79 | 13132.6 | F | 6.269 | 6.80E-05 | 27.4 |
| LYM217 | 13183.2 | H | 0.096 | 0.00E+00 | 102.8 | LYM248 | 13503.5 | F | 6.849 | 7.40E-05 | 39.1 |

TABLE 34-continued

Results obtained in a T2 experiment at the tissue culture assay

| Gene name | Event | ID | Mean | P value | % incr. vs. cont. | Gene name | Event ID | Mean | P value | % incr. vs. cont. |
|---|---|---|---|---|---|---|---|---|---|---|
| LYM217 | 13186.1 | H | 0.09 | 0.00E+00 | 91 | LYM107 | 12633.4 F | 6.42 | 1.94E-04 | 30.4 |
| LYM219 | 13332.9 | H | 0.11 | 0.00E+00 | 132.5 | LYM248 | 13501.6 F | 6.55 | 2.54E-04 | 33.1 |
| LYM234 | 14092.5 | H | 0.123 | 0.00E+00 | 160.3 | LYM213 | 12842.8 F | 7.029 | 2.62E-04 | 42.8 |
| LYM234 | 14092.8 | H | 0.119 | 0.00E+00 | 151.6 | LYM180 | 13442.7 F | 6.274 | 3.41E-04 | 27.5 |
| LYM234 | 14093.2 | H | 0.101 | 0.00E+00 | 113.6 | LYM213 | 12842.9 F | 6.028 | 4.41E-04 | 22.4 |
| LYM234 | 14091.1 | H | 0.094 | 0.00E+00 | 98.2 | LYM213 | 12841.6 F | 5.836 | 5.41E-04 | 18.6 |
| LYM240 | 12683.5 | H | 0.109 | 0.00E+00 | 130.7 | LYM120 | 13382.2 F | 6.345 | 1.79E-03 | 28.9 |
| LYM240 | 12682.1 | H | 0.109 | 0.00E+00 | 130 | LYM157 | 13341.1 F | 5.677 | 2.64E-03 | 15.3 |
| LYM245 | 13061.8 | H | 0.128 | 0.00E+00 | 170.9 | LYM157 | 13341.3 F | 6.752 | 3.09E-03 | 37.2 |
| LYM274 | 13415.2 | H | 0.119 | 0.00E+00 | 152.5 | LYM180 | 13441.7 F | 5.935 | 3.68E-03 | 20.6 |
| LYM274 | 13413.4 | H | 0.095 | 0.00E+00 | 101.8 | LYM180 | 13441.5 F | 6.071 | 4.41E-03 | 23.3 |
| LYM274 | 13413.1 | H | 0.087 | 0.00E+00 | 84.2 | LYM52 | 12894.7 F | 6.008 | 5.17E-03 | 22.1 |
| LYM32 | 13963.4 | H | 0.102 | 0.00E+00 | 116.1 | LYM120 | 13382.3 F | 6.674 | 8.09E-03 | 35.6 |
| LYM32 | 13964.1 | H | 0.089 | 0.00E+00 | 87.8 | LYM52 | 12891.8 F | 5.774 | 9.79E-03 | 17.3 |
| LYM74 | 13954.1 | H | 0.128 | 0.00E+00 | 171.4 | LYM79 | 13134.7 F | 5.601 | 1.44E-02 | 13.8 |
| LYM74 | 13954.2 | H | 0.093 | 0.00E+00 | 96.9 | LYM227 | 14542.3 F | 5.91 | 1.57E-02 | 20.1 |
| LYM79 | 13132.2 | H | 0.134 | 0.00E+00 | 183.6 | LYM79 | 13133.6 F | 5.778 | 2.12E-02 | 17.4 |
| LYM79 | 13133.3 | H | 0.101 | 0.00E+00 | 114.2 | LYM107 | 12631.2 F | 5.764 | 2.69E-02 | 17.1 |
| LYM79 | 13134.1 | H | 0.1 | 0.00E+00 | 111.5 | LYM120 | 13382.1 F | 5.448 | 2.96E-02 | 10.7 |
| LYM79 | 13133.2 | H | 0.097 | 0.00E+00 | 104.7 | LYM117 | 13621.8 F | 5.541 | 3.11E-02 | 12.6 |
| LYM79 | 13134.3 | H | 0.082 | 0.00E+00 | 73.1 | LYM117 | 13622.6 F | 5.578 | 3.16E-02 | 13.3 |
| LYM189 | 13314.4 | H | 0.083 | 1.00E-06 | 75.5 | LYM157 | 13342.4 F | 5.906 | 4.04E-02 | 20 |
| LYM74 | 13952.2 | H | 0.085 | 1.00E-06 | 80.6 | LYM52 | 12894.6 F | 5.686 | 5.87E-02 | 15.5 |
| LYM79 | 13131.1 | H | 0.097 | 1.00E-06 | 104.4 | LYM157 | 13341.1 F | 5.647 | 6.06E-02 | 14.7 |
| LYM219 | 13331.1 | H | 0.082 | 1.20E-05 | 73.8 | LYM120 | 13382.8 F | 5.597 | 7.48E-02 | 13.7 |
| LYM188 | 13244.7 | H | 0.079 | 1.40E-05 | 66.2 | LYM248 | 13502.7 F | 5.617 | 7.50E-02 | 14.1 |
| LYM217 | 13181.9 | H | 0.071 | 7.40E-05 | 50 | CONTROL | — F | 4.923 | — | 0 |
| LYM219 | 13334.8 | H | 0.075 | 4.81E-04 | 59.2 | LYM79 | 13134.7 G | 0.783 | 0.00E+00 | 69 |
| LYM32 | 13963.1 | H | 0.064 | 1.00E-03 | 34.7 | LYM120 | 13382.8 G | 0.937 | 6.00E-06 | 102.4 |
| LYM273 | 13721.3 | H | 0.067 | 1.42E-03 | 40.7 | LYM180 | 13442.6 G | 0.708 | 1.72E-04 | 52.9 |
| LYM189 | 13314.5 | H | 0.063 | 1.80E-03 | 33.5 | LYM79 | 13132.6 G | 0.635 | 2.20E-04 | 37.1 |
| LYM234 | 14092.1 | H | 0.064 | 2.49E-03 | 34.5 | LYM248 | 13502.6 G | 0.6 | 3.71E-04 | 29.4 |
| LYM217 | 13181.6 | H | 0.067 | 2.63E-03 | 41 | LYM227 | 14544.2 G | 0.612 | 4.69E-04 | 32 |
| LYM188 | 13244.6 | H | 0.062 | 3.19E-03 | 30.8 | LYM107 | 12633.4 G | 0.695 | 6.12E-04 | 50.1 |
| LYM219 | 13334.7 | H | 0.065 | 6.05E-03 | 37.1 | LYM120 | 13382.1 G | 1.056 | 8.03E-04 | 128 |
| LYM79 | 13134.2 | H | 0.061 | 6.73E-03 | 28.6 | LYM227 | 14542.1 G | 0.625 | 8.16E-04 | 34.9 |
| LYM240 | 12683.9 | H | 0.059 | 1.03E-02 | 25.6 | LYM117 | 13622.6 G | 0.678 | 8.66E-04 | 46.3 |
| LYM122 | 13713.4 | H | 0.061 | 1.40E-02 | 29.1 | LYM157 | 13341.1 G | 1.038 | 1.08E-03 | 124.2 |
| LYM278 | 13364.5 | H | 0.058 | 2.02E-02 | 23.2 | LYM157 | 13341.4 G | 0.737 | 1.15E-03 | 59.1 |
| LYM274 | 13413.3 | H | 0.06 | 2.07E-02 | 27.2 | LYM157 | 13341.3 G | 1.528 | 1.56E-03 | 229.9 |
| LYM240 | 12684.8 | H | 0.059 | 5.27E-02 | 24.1 | LYM120 | 13382.2 G | 1.057 | 1.65E-03 | 128.2 |
| CONTROL | — | H | 0.047 | — | 0 | LYM107 | 12631.1 G | 1.085 | 2.28E-03 | 134.2 |
| LYM1 | 11603.2 | A | 0.006 | 2.00E-06 | 74.1 | LYM227 | 14545.2 G | 0.61 | 2.98E-03 | 31.8 |
| LYM1 | 11601.1 | A | 0.007 | 1.20E-05 | 83.9 | LYM120 | 13382.4 G | 0.614 | 4.29E-03 | 32.6 |
| LYM132 | 12275.3 | A | 0.007 | 1.63E-04 | 96.5 | LYM213 | 12842.8 G | 1.205 | 4.34E-03 | 160.1 |
| LYM178 | 12164.2 | A | 0.006 | 2.14E-03 | 58 | LYM248 | 13503.5 G | 0.751 | 4.94E-03 | 62.2 |
| LYM132 | 12271.4 | A | 0.007 | 3.64E-03 | 97.2 | LYM180 | 13442.7 G | 0.839 | 5.84E-03 | 81.2 |
| LYM1 | 11604.4 | A | 0.005 | 3.68E-03 | 29.4 | LYM52 | 12895.7 G | 1.044 | 6.49E-03 | 125.4 |
| LYM268 | 12483.2 | A | 0.008 | 6.62E-03 | 111.2 | LYM157 | 13342.4 G | 0.609 | 6.86E-03 | 31.5 |
| LYM5 | 12432.2 | A | 0.005 | 6.64E-03 | 28.7 | LYM180 | 13441.5 G | 1.027 | 7.31E-03 | 121.8 |
| LYM178 | 12164.3 | A | 0.011 | 1.01E-02 | 206.3 | LYM213 | 12841.8 G | 0.732 | 7.99E-03 | 58 |
| LYM134 | 12314.2 | A | 0.006 | 1.05E-02 | 77.6 | LYM120 | 13382.3 G | 1.099 | 8.19E-03 | 137.3 |
| LYM268 | 12482.3 | A | 0.006 | 1.08E-02 | 58.7 | LYM52 | 12894.7 G | 1.153 | 8.28E-03 | 148.8 |
| LYM129 | 12571.3 | A | 0.006 | 1.11E-02 | 54.5 | LYM213 | 12842.9 G | 1.143 | 8.30E-03 | 146.8 |
| LYM178 | 12163.3 | A | 0.011 | 1.16E-02 | 202.1 | LYM79 | 13131.6 G | 1.11 | 8.39E-03 | 139.7 |
| LYM1 | 11602.6 | A | 0.011 | 1.60E-02 | 197.2 | LYM180 | 13441.7 G | 1.224 | 1.13E-02 | 164.3 |
| LYM1 | 11602.1 | A | 0.005 | 1.79E-02 | 46.2 | LYM157 | 13341.1 G | 0.527 | 1.68E-02 | 13.9 |
| LYM268 | 12482.1 | A | 0.007 | 2.35E-02 | 97.9 | LYM227 | 14542.5 G | 0.569 | 1.84E-02 | 22.7 |
| LYM132 | 12276.1 | A | 0.009 | 2.60E-02 | 146.9 | LYM52 | 12894.6 G | 0.525 | 1.93E-02 | 13.4 |
| LYM129 | 12572.2 | A | 0.005 | 2.65E-02 | 46.2 | LYM52 | 12891.5 G | 0.671 | 2.02E-02 | 44.8 |
| LYM5 | 12432.1 | A | 0.006 | 4.79E-02 | 70.6 | LYM117 | 13621.8 G | 0.57 | 2.22E-02 | 23 |
| LYM6 | 11735.1 | A | 0.006 | 5.37E-02 | 58 | LYM213 | 12841.6 G | 0.782 | 2.30E-02 | 68.9 |
| LYM132 | 12273.2 | A | 0.005 | 5.62E-02 | 44.1 | LYM107 | 12632.1 G | 0.648 | 2.97E-02 | 39.9 |
| LYM268 | 12483.4 | A | 0.006 | 6.34E-02 | 65 | LYM117 | 13623.9 G | 0.677 | 4.19E-02 | 46 |
| LYM6 | 11736.1 | A | 0.006 | 6.64E-02 | 71.3 | LYM117 | 13624.7 G | 0.695 | 5.21E-02 | 49.9 |
| LYM6 | 11733.2 | A | 0.004 | 6.75E-02 | 13.3 | LYM117 | 13622.5 G | 0.634 | 5.88E-02 | 36.9 |
| LYM6 | 11735.2 | A | 0.005 | 6.93E-02 | 49 | LYM52 | 12894.8 G | 0.73 | 6.31E-02 | 57.5 |
| LYM134 | 12313.2 | A | 0.011 | 7.63E-02 | 216.1 | LYM79 | 13131.5 G | 0.654 | 7.90E-02 | 41.2 |
| LYM129 | 12573.5 | A | 0.007 | 7.95E-02 | 102.8 | CONTROL | — G | 0.463 | — | 0 |
| CONTROL | — | A | 0.004 | — | 0 | LYM107 | 12631.1 H | 0.107 | 0.00E+00 | 141.1 |
| LYM132 | 12275.3 | B | 0.134 | 1.00E-06 | 86.1 | LYM120 | 13382.3 H | 0.111 | 0.00E+00 | 148.8 |
| LYM1 | 11603.2 | B | 0.124 | 3.20E-05 | 72.1 | LYM120 | 13382.2 H | 0.107 | 0.00E+00 | 139.8 |
| LYM1 | 11601.1 | B | 0.123 | 4.10E-05 | 71.4 | LYM120 | 13382.1 H | 0.102 | 0.00E+00 | 129.7 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM132 | 12271.4 | B | 0.124 | 1.69E-04 | 71.8 | LYM120 | 13382.8 | H | 0.094 | 0.00E+00 | 111.3 |
| LYM268 | 12483.2 | B | 0.142 | 8.85E-04 | 96.8 | LYM157 | 13341.3 | H | 0.146 | 0.00E+00 | 228.5 |
| LYM178 | 12164.2 | B | 0.111 | 2.98E-03 | 54.4 | LYM157 | 13341.1 | H | 0.096 | 0.00E+00 | 117 |
| LYM5 | 12432.2 | B | 0.09 | 6.77E-03 | 25.1 | LYM180 | 13441.7 | H | 0.114 | 0.00E+00 | 157.5 |
| LYM134 | 12314.2 | B | 0.138 | 7.76E-03 | 91.2 | LYM180 | 13441.5 | H | 0.097 | 0.00E+00 | 119.2 |
| LYM129 | 12571.3 | B | 0.11 | 9.48E-03 | 52.8 | LYM213 | 12842.8 | H | 0.114 | 0.00E+00 | 157 |
| LYM1 | 11602.6 | B | 0.214 | 9.84E-03 | 197.7 | LYM213 | 12842.9 | H | 0.107 | 0.00E+00 | 141.1 |
| LYM268 | 12482.3 | B | 0.124 | 1.45E-02 | 71.8 | LYM52 | 12894.7 | H | 0.117 | 0.00E+00 | 162.5 |
| LYM268 | 12482.1 | B | 0.129 | 1.64E-02 | 78.6 | LYM52 | 12895.7 | H | 0.105 | 0.00E+00 | 136 |
| LYM129 | 12572.2 | B | 0.101 | 1.69E-02 | 40.1 | LYM79 | 13131.6 | H | 0.108 | 0.00E+00 | 142.5 |
| LYM129 | 12573.3 | B | 0.087 | 1.94E-02 | 21 | LYM180 | 13442.7 | H | 0.08 | 1.00E-06 | 79.4 |
| LYM6 | 11735.2 | B | 0.13 | 2.15E-02 | 80.5 | LYM157 | 13341.4 | H | 0.077 | 3.00E-06 | 73.4 |
| LYM178 | 12164.3 | B | 0.215 | 2.21E-02 | 199.1 | LYM213 | 12841.6 | H | 0.077 | 1.70E-05 | 74.3 |
| LYM178 | 12163.3 | B | 0.227 | 2.30E-02 | 214.8 | LYM79 | 13134.7 | H | 0.07 | 6.90E-05 | 57.7 |
| LYM5 | 12432.1 | B | 0.116 | 2.54E-02 | 60.7 | LYM52 | 12894.8 | H | 0.075 | 1.89E-04 | 67.6 |
| LYM6 | 11735.1 | B | 0.107 | 2.65E-02 | 48.9 | LYM227 | 14544.2 | H | 0.067 | 4.24E-04 | 49.8 |
| LYM132 | 12276.1 | B | 0.18 | 2.72E-02 | 150.1 | LYM107 | 12633.4 | H | 0.066 | 5.81E-04 | 48.6 |
| LYM134 | 12313.2 | B | 0.229 | 3.20E-02 | 217.6 | LYM117 | 13622.6 | H | 0.066 | 5.92E-04 | 49 |
| LYM268 | 12483.4 | B | 0.128 | 4.11E-02 | 77.8 | LYM248 | 13503.5 | H | 0.067 | 7.50E-04 | 50.7 |
| LYM134 | 12312.4 | B | 0.096 | 6.12E-02 | 33.5 | LYM213 | 12841.8 | H | 0.067 | 7.87E-04 | 50.6 |
| LYM129 | 12573.5 | B | 0.144 | 6.28E-02 | 99.7 | LYM52 | 12891.8 | H | 0.067 | 9.77E-04 | 49.6 |
| LYM6 | 11736.1 | B | 0.13 | 7.91E-02 | 80.6 | LYM117 | 13622.5 | H | 0.067 | 9.85E-04 | 51.7 |
| LYM1 | 11604.4 | B | 0.083 | 9.90E-02 | 16 | LYM180 | 13442.6 | H | 0.065 | 1.09E-03 | 45.8 |
| CONTROL | — | B | 0.072 | — | 0 | LYM117 | 13623.9 | H | 0.064 | 3.89E-03 | 44.7 |
| LYM1 | 11602.6 | C | 0.965 | 0.00E+00 | 91.4 | LYM79 | 13132.6 | H | 0.062 | 5.30E-03 | 38.5 |
| LYM1 | 11601.1 | C | 0.83 | 8.30E-05 | 64.7 | LYM107 | 12632.1 | H | 0.063 | 5.57E-03 | 41.7 |
| LYM268 | 12483.2 | C | 0.803 | 1.01E-04 | 59.3 | LYM120 | 13382.4 | H | 0.061 | 5.57E-03 | 38.2 |
| LYM132 | 12276.1 | C | 0.936 | 1.06E-04 | 85.8 | LYM117 | 13624.7 | H | 0.064 | 5.91E-03 | 43.9 |
| LYM178 | 12164.3 | C | 0.831 | 1.49E-04 | 64.9 | LYM248 | 13502.6 | H | 0.06 | 9.80E-03 | 35.3 |
| LYM129 | 12571.3 | C | 0.794 | 1.72E-04 | 57.5 | LYM213 | 12841.5 | H | 0.062 | 1.07E-02 | 39 |
| LYM129 | 12573.5 | C | 0.83 | 1.82E-04 | 64.6 | LYM227 | 14542.1 | H | 0.059 | 1.46E-02 | 33.2 |
| LYM268 | 12482.3 | C | 0.752 | 4.97E-04 | 49.2 | LYM157 | 13342.4 | H | 0.06 | 1.46E-02 | 34.4 |
| LYM268 | 12483.4 | C | 0.752 | 8.08E-04 | 49.2 | LYM117 | 13621.8 | H | 0.06 | 1.51E-02 | 34.5 |
| LYM178 | 12163.3 | C | 0.849 | 8.09E-04 | 68.5 | LYM79 | 13131.5 | H | 0.06 | 2.75E-02 | 35.8 |
| LYM5 | 12435.1 | C | 0.771 | 9.77E-04 | 52.9 | LYM227 | 14541.5 | H | 0.057 | 3.75E-02 | 28.4 |
| LYM134 | 12314.2 | C | 0.733 | 1.55E-03 | 45.5 | CONTROL | — | H | 0.044 | — | 0 |
| LYM178 | 12164.2 | C | 0.679 | 7.95E-03 | 34.7 | LYM79 | 13131.6 | A | 0.004 | 9.00E-06 | 63 |
| LYM134 | 12313.3 | C | 0.739 | 8.31E-03 | 46.6 | LYM79 | 13133.6 | A | 0.004 | 1.55E-03 | 61 |
| LYM132 | 12275.3 | C | 0.675 | 1.62E-02 | 34 | LYM79 | 13131.5 | A | 0.004 | 3.66E-02 | 40 |
| LYM1 | 11603.2 | C | 0.683 | 3.61E-02 | 35.6 | LYM79 | 13132.6 | A | 0.004 | 3.91E-02 | 47 |
| CONTROL | — | C | 0.504 | — | 0 | LYM227 | 14544.2 | A | 0.004 | 5.01E-02 | 72 |
| LYM1 | 11602.6 | D | 8.109 | 7.70E-05 | 79.7 | LYM79 | 13134.7 | A | 0.003 | 5.24E-02 | 39 |
| LYM268 | 12483.2 | D | 6.779 | 9.34E-04 | 50.3 | LYM227 | 14542.5 | A | 0.003 | 7.71E-02 | 35 |
| LYM268 | 12482.3 | D | 6.318 | 9.47E-04 | 40 | CONTROL | — | A | 0.003 | — | 0 |
| LYM129 | 12571.3 | D | 6.587 | 1.03E-03 | 46 | LYM79 | 13133.6 | B | 0.089 | 3.95E-03 | 23.5 |
| LYM134 | 12314.2 | D | 6.146 | 2.72E-03 | 36.2 | LYM227 | 14544.2 | B | 0.101 | 1.09E-02 | 40.9 |
| LYM1 | 11601.1 | D | 7.074 | 6.19E-03 | 56.8 | LYM227 | 14542.1 | B | 0.082 | 5.43E-02 | 14.7 |
| LYM268 | 12483.4 | D | 6.375 | 1.10E-02 | 41.3 | LYM79 | 13131.5 | B | 0.093 | 7.88E-02 | 28.9 |
| LYM178 | 12164.2 | D | 5.681 | 1.80E-02 | 25.9 | LYM79 | 13132.6 | B | 0.095 | 8.38E-02 | 32.4 |
| LYM129 | 12573.5 | D | 7.105 | 1.84E-02 | 57.5 | LYM227 | 14542.5 | B | 0.085 | 9.81E-02 | 18.4 |
| LYM178 | 12164.3 | D | 6.941 | 1.87E-02 | 53.8 | CONTROL | — | B | 0.072 | — | 0 |
| LYM132 | 12276.1 | D | 7.985 | 3.78E-02 | 77 | LYM79 | 13134.7 | C | 0.665 | 5.00E-05 | 49.9 |
| LYM5 | 12435.1 | D | 6.433 | 4.32E-02 | 42.6 | LYM79 | 13132.6 | C | 0.683 | 1.75E-04 | 53.9 |
| LYM132 | 12275.3 | D | 5.769 | 5.38E-02 | 27.9 | LYM227 | 14544.2 | C | 0.606 | 2.21E-03 | 36.6 |
| LYM178 | 12163.3 | D | 7.171 | 6.48E-02 | 59 | LYM79 | 13133.6 | C | 0.614 | 5.09E-03 | 38.3 |
| CONTROL | — | D | 4.511 | — | 0 | LYM79 | 13131.5 | C | 0.606 | 6.01E-03 | 36.5 |
| LYM178 | 12164.3 | E | 0.618 | 6.14E-04 | 35.8 | LYM227 | 14542.5 | C | 0.589 | 9.41E-03 | 32.9 |
| LYM5 | 12435.1 | E | 0.6 | 6.85E-04 | 31.8 | LYM79 | 13131.6 | C | 0.559 | 2.18E-02 | 26 |
| LYM134 | 12314.2 | E | 0.598 | 1.04E-03 | 31.5 | LYM227 | 14542.3 | C | 0.576 | 2.31E-02 | 29.9 |
| LYM268 | 12482.3 | E | 0.59 | 1.49E-03 | 29.6 | CONTROL | — | C | 0.444 | — | 0 |
| LYM129 | 12571.3 | E | 0.596 | 1.76E-03 | 31 | LYM79 | 13134.7 | D | 5.698 | 4.00E-06 | 47.8 |
| LYM132 | 12276.1 | E | 0.595 | 2.11E-03 | 30.8 | LYM79 | 13131.6 | D | 5.051 | 2.55E-04 | 31 |
| LYM1 | 11602.6 | E | 0.58 | 4.57E-03 | 27.6 | LYM227 | 14544.2 | D | 5.176 | 7.52E-03 | 34.3 |
| LYM132 | 12275.3 | E | 0.587 | 9.38E-03 | 29 | LYM79 | 13131.5 | D | 5.504 | 5.52E-03 | 42.8 |
| LYM178 | 12164.2 | E | 0.557 | 1.30E-02 | 22.5 | LYM79 | 13132.6 | D | 5.911 | 5.61E-02 | 53.3 |
| LYM268 | 12483.4 | E | 0.539 | 4.86E-02 | 18.5 | LYM227 | 14542.5 | D | 5.159 | 6.06E-02 | 33.8 |
| LYM178 | 12163.3 | E | 0.553 | 5.88E-02 | 21.4 | LYM79 | 13133.6 | D | 5.429 | 8.59E-02 | 40.9 |
| LYM1 | 11601.1 | E | 0.543 | 6.29E-02 | 19.2 | CONTROL | — | D | 3.855 | — | 0 |
| LYM129 | 12573.5 | E | 0.548 | 7.27E-02 | 20.4 | LYM79 | 13134.7 | F | 6.191 | 5.25E-04 | 18 |
| LYM5 | 12432.1 | E | 0.532 | 7.47E-02 | 16.9 | LYM79 | 13132.6 | F | 6.158 | 6.45E-03 | 17.4 |
| LYM129 | 12572.2 | E | 0.52 | 7.70E-02 | 14.4 | LYM79 | 13131.5 | F | 6.286 | 7.80E-03 | 19.8 |
| CONTROL | — | E | 0.455 | — | 0 | LYM227 | 14542.3 | F | 5.863 | 7.80E-02 | 11.7 |
| LYM268 | 12482.3 | F | 6.797 | 1.32E-04 | 22.4 | CONTROL | — | F | 5.247 | — | 0 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM5 | 12435.1 | F | 6.566 | 5.75E−04 | 18.2 | LYM79 | 13131.6 | G | 0.756 | 8.17E−03 | 48 |
| LYM134 | 12314.2 | F | 6.858 | 2.92E−03 | 23.5 | LYM227 | 14544.2 | G | 0.575 | 3.56E−02 | 12.6 |
| LYM132 | 12276.1 | F | 6.968 | 4.43E−03 | 25.4 | CONTROL | — | G | 0.511 | — | 0 |
| LYM129 | 12571.3 | F | 6.614 | 1.13E−02 | 19.1 | LYM79 | 13131.6 | H | 0.075 | 1.40E−05 | 50.2 |
| LYM178 | 12164.3 | F | 6.685 | 1.23E−02 | 20.3 | LYM227 | 14544.2 | H | 0.062 | 1.36E−02 | 24.5 |
| LYM268 | 12483.2 | F | 6.477 | 1.34E−02 | 16.6 | LYM79 | 13133.6 | H | 0.062 | 1.76E−02 | 25.2 |
| LYM268 | 12483.4 | F | 6.494 | 1.43E−02 | 16.9 | LYM79 | 13131.5 | H | 0.064 | 2.54E−02 | 28.1 |
| LYM1 | 11602.6 | F | 6.607 | 1.52E−02 | 18.9 | LYM227 | 14542.5 | H | 0.061 | 3.57E−02 | 22.1 |
| LYM1 | 11601.1 | F | 6.595 | 2.97E−02 | 18.7 | LYM79 | 13134.7 | H | 0.059 | 6.68E−02 | 19.2 |
| LYM178 | 12164.2 | F | 6.106 | 4.81E−02 | 9.9 | LYM79 | 13132.6 | H | 0.059 | 8.94E−02 | 18.9 |
| LYM132 | 12275.3 | F | 6.546 | 7.02E−02 | 17.8 | CONTROL | — | H | 0.05 | — | 0 |
| LYM129 | 12573.5 | F | 6.544 | 9.24E−02 | 17.8 | | | | | | |
| CONTROL | — | F | 5.555 | — | 0 | | | | | | |
| LYM1 | 11601.1 | G | 0.75 | 8.00E−06 | 56.3 | | | | | | |
| LYM132 | 12271.4 | G | 0.76 | 1.00E−05 | 58.3 | | | | | | |
| LYM132 | 12275.3 | G | 0.841 | 4.10E−05 | 75.2 | | | | | | |
| LYM268 | 12482.1 | G | 0.738 | 2.75E−04 | 53.6 | | | | | | |
| LYM178 | 12164.3 | G | 1.031 | 1.85E−03 | 114.7 | | | | | | |
| LYM1 | 11603.2 | G | 0.665 | 1.89E−03 | 38.5 | | | | | | |
| LYM134 | 12314.2 | G | 0.759 | 2.43E−03 | 58.1 | | | | | | |
| LYM1 | 11602.6 | G | 1.002 | 3.24E−03 | 108.6 | | | | | | |
| LYM178 | 12164.2 | G | 0.615 | 7.36E−03 | 28 | | | | | | |
| LYM178 | 12163.3 | G | 0.929 | 1.03E−02 | 93.6 | | | | | | |
| LYM132 | 12276.1 | G | 0.833 | 1.10E−02 | 73.5 | | | | | | |
| LYM6 | 11736.1 | G | 0.75 | 1.25E−02 | 56.2 | | | | | | |
| LYM129 | 12573.5 | G | 0.786 | 2.28E−02 | 63.6 | | | | | | |
| LYM268 | 12483.2 | G | 0.728 | 2.44E−02 | 51.6 | | | | | | |
| LYM6 | 11735.2 | G | 0.594 | 2.79E−02 | 23.7 | | | | | | |
| LYM268 | 12482.3 | G | 0.63 | 3.55E−02 | 31.3 | | | | | | |
| LYM5 | 12432.1 | G | 0.741 | 3.96E−02 | 54.3 | | | | | | |
| LYM129 | 12572.2 | G | 0.598 | 4.01E−02 | 24.5 | | | | | | |
| LYM1 | 11602.1 | G | 0.588 | 5.84E−02 | 22.4 | | | | | | |
| LYM268 | 12483.4 | G | 0.708 | 6.03E−02 | 47.5 | | | | | | |
| LYM134 | 12313.2 | G | 0.968 | 6.92E−02 | 101.5 | | | | | | |
| CONTROL | — | G | 0.48 | — | 0 | | | | | | |
| LYM136 | 13423.1 | A | 0.006 | 4.00E−06 | 156.7 | LYM160 | 13472.1 | A | 0.01 | 0.00E+00 | 138.8 |
| LYM1 | 11601.1 | A | 0.004 | 2.49E−04 | 69.1 | LYM136 | 13423.4 | A | 0.009 | 1.48E−04 | 118.5 |
| LYM136 | 13421.5 | A | 0.006 | 1.77E−03 | 129.9 | LYM293 | 13391.2 | A | 0.007 | 5.51E−03 | 57.6 |
| LYM84 | 13404.4 | A | 0.004 | 3.79E−03 | 81.4 | LYM293 | 13391.4 | A | 0.009 | 8.63E−03 | 106 |
| LYM1 | 11602.6 | A | 0.007 | 5.63E−03 | 182.5 | LYM136 | 13421.7 | A | 0.008 | 1.58E−02 | 94 |
| LYM1 | 11603.2 | A | 0.005 | 7.42E−03 | 125.8 | LYM136 | 13421.8 | A | 0.008 | 2.02E−02 | 92.2 |
| LYM84 | 13401.2 | A | 0.005 | 1.15E−02 | 91.8 | LYM160 | 13471.1 | A | 0.008 | 3.06E−02 | 95.2 |
| LYM84 | 13403.1 | A | 0.007 | 1.33E−02 | 170.1 | LYM84 | 13403.1 | A | 0.008 | 3.34E−02 | 90.4 |
| LYM84 | 13403.3 | A | 0.005 | 1.48E−02 | 99 | LYM160 | 13472.2 | A | 0.007 | 3.80E−02 | 78.5 |
| LYM136 | 13421.6 | A | 0.005 | 2.79E−02 | 116.5 | LYM84 | 13403.3 | A | 0.012 | 6.33E−02 | 186 |
| LYM136 | 13421.8 | A | 0.007 | 2.82E−02 | 189.7 | LYM293 | 13392.2 | A | 0.007 | 6.99E−02 | 70.1 |
| LYM84 | 13403.2 | A | 0.006 | 2.92E−02 | 156.7 | LYM84 | 13401.2 | A | 0.007 | 7.32E−02 | 66.6 |
| LYM1 | 11602.1 | A | 0.004 | 3.31E−02 | 70.1 | LYM293 | 13391.9 | A | 0.007 | 7.86E−02 | 67.8 |
| LYM136 | 13423.2 | A | 0.004 | 3.85E−02 | 79.4 | LYM136 | 13421.5 | A | 0.008 | 8.34E−02 | 99.4 |
| LYM1 | 11604.4 | A | 0.003 | 5.00E−02 | 39.2 | LYM160 | 13471.4 | A | 0.006 | 9.24E−02 | 31.3 |
| CONTROL | — | A | 0.002 | — | 0 | CONTROL | — | A | 0.004 | — | 0 |
| LYM84 | 13401.2 | B | 0.093 | 1.52E−03 | 80.5 | LYM160 | 13472.1 | B | 0.218 | 5.01E−03 | 128.9 |
| LYM1 | 11601.1 | B | 0.09 | 4.19E−03 | 75.6 | LYM136 | 13423.4 | B | 0.19 | 7.33E−03 | 100 |
| LYM136 | 13423.1 | B | 0.125 | 5.82E−03 | 143.9 | LYM136 | 13421.8 | B | 0.173 | 1.03E−02 | 81.6 |
| LYM84 | 13403.3 | B | 0.1 | 6.00E−03 | 95.1 | LYM293 | 13391.2 | B | 0.138 | 1.09E−02 | 44.7 |
| LYM136 | 13421.5 | B | 0.103 | 8.84E−03 | 100 | LYM84 | 13401.2 | B | 0.138 | 1.59E−02 | 44.7 |
| LYM136 | 13421.6 | B | 0.123 | 9.57E−03 | 139 | LYM136 | 13421.7 | B | 0.153 | 2.38E−02 | 60.5 |
| LYM1 | 11602.6 | B | 0.13 | 1.32E−02 | 153.7 | LYM84 | 13403.3 | B | 0.275 | 3.54E−02 | 189.5 |
| LYM136 | 13423.2 | B | 0.088 | 1.41E−02 | 70.7 | LYM160 | 13472.2 | B | 0.155 | 6.63E−02 | 63.2 |
| LYM136 | 13421.8 | B | 0.155 | 2.23E−02 | 202.4 | LYM293 | 13391.4 | B | 0.193 | 7.66E−02 | 102.6 |
| LYM84 | 13403.2 | B | 0.155 | 2.32E−02 | 202.4 | LYM136 | 13421.5 | B | 0.18 | 8.25E−02 | 89.5 |
| LYM84 | 13404.4 | B | 0.095 | 2.70E−02 | 85.4 | LYM160 | 13471.1 | B | 0.18 | 8.25E−02 | 89.5 |
| LYM1 | 11603.2 | B | 0.10 | 2.70E−02 | 109.8 | LYM84 | 13403.1 | B | 0.195 | 8.89E−02 | 105.3 |
| LYM1 | 11604.4 | B | 0.073 | 3.33E−02 | 41.5 | CONTROL | — | B | 0.095 | — | 0 |
| LYM1 | 11602.1 | B | 0.088 | 3.79E−02 | 70.7 | LYM136 | 13421.5 | G | 1.16 | 1.40E−05 | 113.3 |
| LYM84 | 13403.1 | B | 0.15 | 5.94E−02 | 192.7 | LYM160 | 13472.1 | G | 1.073 | 1.70E−05 | 97.2 |
| CONTROL | — | B | 0.051 | — | 0 | LYM160 | 13471.1 | G | 0.973 | 1.00E−04 | 78.9 |
| LYM1 | 11601.1 | G | 0.75 | 7.00E−06 | 88.7 | LYM84 | 13403.1 | G | 0.915 | 1.04E−04 | 68.3 |
| LYM84 | 13403.1 | G | 0.75 | 8.00E−06 | 88.7 | LYM136 | 13423.4 | G | 1.08 | 1.69E−03 | 98.6 |
| LYM84 | 13404.4 | G | 0.64 | 9.30E−05 | 61 | LYM136 | 13421.8 | G | 1.035 | 3.80E−03 | 90.3 |
| LYM1 | 11603.2 | G | 0.635 | 7.21E−04 | 59.7 | LYM293 | 13391.4 | G | 1.193 | 5.56E−03 | 119.3 |
| LYM136 | 13421.6 | G | 0.688 | 1.51E−03 | 73 | LYM84 | 13401.2 | G | 0.83 | 7.52E−03 | 52.6 |
| LYM84 | 13401.2 | G | 0.688 | 2.17E−03 | 73 | LYM84 | 13403.3 | G | 1.418 | 7.77E−03 | 160.7 |

TABLE 34-continued

Results obtained in a T2 experiment at the tissue culture assay

| Gene name | Event | ID | Mean | P value | % incr. vs. cont. | Gene name | Event | ID | Mean | P value | % incr. vs. cont. |
|---|---|---|---|---|---|---|---|---|---|---|---|
| LYM1 | 11602.6 | G | 0.783 | 3.89E−03 | 96.9 | LYM160 | 13472.2 | G | 0.76 | 1.94E−02 | 39.8 |
| LYM136 | 13423.1 | G | 0.83 | 4.81E−03 | 108.8 | LYM136 | 13421.7 | G | 0.88 | 2.80E−02 | 61.8 |
| LYM84 | 13403.3 | G | 0.72 | 4.83E−03 | 81.1 | LYM293 | 13391.2 | G | 0.74 | 4.83E−02 | 36.1 |
| LYM136 | 13421.5 | G | 0.62 | 6.93E−03 | 56 | LYM293 | 13392.2 | G | 0.885 | 4.98E−02 | 62.8 |
| LYM84 | 13403.2 | G | 0.785 | 1.19E−02 | 97.5 | LYM136 | 13423.2 | G | 0.795 | 8.04E−02 | 46.2 |
| LYM136 | 13421.8 | G | 0.878 | 1.65E−02 | 120.8 | LYM293 | 13391.9 | G | 0.813 | 8.66E−02 | 49.4 |
| LYM136 | 13423.2 | G | 0.61 | 2.94E−02 | 53.5 | LYM160 | 13471.4 | G | 0.725 | 9.93E−02 | 33.3 |
| LYM1 | 11604.4 | G | 0.515 | 2.96E−02 | 29.6 | CONTROL | — | G | 0.544 | — | 0 |
| CONTROL | — | G | 0.398 | — | 0 | LYM136 | 13421.5 | H | 0.122 | 0.00E+00 | 119 |
| LYM136 | 13423.1 | H | 0.081 | 0.00E+00 | 101.6 | LYM160 | 13472.1 | H | 0.118 | 0.00E+00 | 110.6 |
| LYM84 | 13403.1 | H | 0.076 | 0.00E+00 | 88.3 | LYM84 | 13403.3 | H | 0.15 | 1.00E−06 | 168.9 |
| LYM1 | 11602.6 | H | 0.077 | 1.00E−06 | 91.4 | LYM136 | 13423.4 | H | 0.116 | 3.00E−06 | 108.4 |
| LYM1 | 11601.1 | H | 0.068 | 2.00E−06 | 70.4 | LYM293 | 13391.4 | H | 0.121 | 6.00E−06 | 116.8 |
| LYM84 | 13403.2 | H | 0.083 | 2.00E−06 | 107 | LYM136 | 13421.8 | H | 0.106 | 7.20E−05 | 90.5 |
| LYM136 | 13421.8 | H | 0.087 | 4.00E−06 | 116.3 | LYM160 | 13471.1 | H | 0.097 | 1.50E−04 | 74.2 |
| LYM136 | 13421.6 | H | 0.068 | 7.00E−06 | 68.1 | LYM84 | 13403.1 | H | 0.089 | 8.80E−04 | 59.1 |
| LYM84 | 13403.3 | H | 0.07 | 9.00E−06 | 74.3 | LYM136 | 13421.7 | H | 0.094 | 1.79E−03 | 68.6 |
| LYM84 | 13401.2 | H | 0.065 | 2.60E−05 | 62.6 | LYM84 | 13401.2 | H | 0.086 | 3.12E−03 | 54.6 |
| LYM136 | 13421.5 | H | 0.066 | 2.80E−05 | 65 | LYM293 | 13392.2 | H | 0.093 | 3.73E−03 | 66.4 |
| LYM1 | 11603.2 | H | 0.062 | 3.00E−05 | 54.9 | LYM160 | 13472.2 | H | 0.085 | 5.45E−03 | 51.8 |
| LYM84 | 13404.4 | H | 0.06 | 7.80E−05 | 48.6 | LYM293 | 13391.9 | H | 0.084 | 2.09E−02 | 50.7 |
| LYM136 | 13423.2 | H | 0.061 | 1.90E−03 | 51.8 | LYM293 | 13391.2 | H | 0.078 | 2.83E−02 | 40.1 |
| LYM1 | 11604.4 | H | 0.054 | 4.45E−03 | 35.4 | LYM136 | 13423.2 | H | 0.081 | 3.88E−02 | 44.5 |
| LYM1 | 11602.1 | H | 0.053 | 1.86E−02 | 31.5 | LYM160 | 13471.4 | H | 0.075 | 6.82E−02 | 34.5 |
| CONTROL | — | H | 0.04 | — | 0 | CONTROL | — | H | 0.056 | — | 0 |
| LYM84 | 13403.2 | C | 1.027 | 1.40E−05 | 80.2 | LYM136 | 13421.5 | C | 0.908 | 0.00E+00 | 100.7 |
| LYM136 | 13423.1 | C | 1.023 | 1.50E−05 | 79.7 | LYM136 | 13421.8 | C | 0.873 | 0.00E+00 | 93.1 |
| LYM136 | 13421.8 | C | 1.028 | 7.30E−05 | 80.6 | LYM293 | 13391.2 | C | 0.792 | 0.00E+00 | 75.2 |
| LYM84 | 13403.1 | C | 0.893 | 1.60E−04 | 56.8 | LYM160 | 13472.1 | C | 0.721 | 1.00E−06 | 59.5 |
| LYM84 | 13403.3 | C | 0.867 | 6.59E−04 | 52.3 | LYM84 | 13403.2 | C | 1.089 | 1.00E−06 | 140.8 |
| LYM136 | 13421.6 | C | 0.853 | 2.33E−03 | 49.8 | LYM136 | 13423.2 | C | 0.831 | 3.00E−06 | 83.8 |
| LYM136 | 13423.2 | C | 0.864 | 3.27E−03 | 51.7 | LYM293 | 13391.4 | C | 1.071 | 3.00E−06 | 136.8 |
| LYM1 | 11603.2 | C | 0.817 | 3.91E−03 | 43.4 | LYM160 | 13471.1 | C | 0.772 | 3.10E−05 | 70.6 |
| LYM84 | 13401.2 | C | 0.804 | 4.08E−03 | 41.2 | LYM84 | 13401.2 | C | 0.692 | 3.40E−05 | 52.9 |
| LYM1 | 11602.6 | C | 0.862 | 5.42E−03 | 51.3 | LYM136 | 13423.4 | C | 0.777 | 4.90E−05 | 71.7 |
| LYM1 | 11601.1 | C | 0.789 | 1.01E−02 | 38.6 | LYM160 | 13472.2 | C | 0.672 | 1.41E−04 | 48.7 |
| LYM1 | 11604.4 | C | 0.823 | 1.54E−02 | 44.5 | LYM84 | 13403.1 | C | 0.646 | 2.21E−04 | 42.9 |
| LYM84 | 13404.4 | C | 0.734 | 2.94E−02 | 28.8 | LYM293 | 13391.9 | C | 0.763 | 2.73E−04 | 68.7 |
| LYM1 | 11602.1 | C | 0.727 | 4.75E−02 | 27.6 | LYM136 | 13421.7 | C | 0.727 | 8.57E−04 | 60.7 |
| LYM136 | 13421.5 | C | 0.715 | 7.12E−02 | 25.5 | LYM293 | 13392.2 | C | 0.668 | 1.97E−02 | 47.8 |
| CONTROL | — | C | 0.57 | — | 0 | CONTROL | — | C | 0.452 | — | 0 |
| LYM1 | 11604.4 | E | 0.583 | 3.46E−03 | 26.5 | LYM84 | 13403.3 | E | 0.559 | 5.55E−02 | 23 |
| LYM84 | 13403.2 | E | 0.574 | 1.03E−02 | 24.6 | CONTROL | — | E | 0.454 | — | 0 |
| LYM136 | 13421.8 | E | 0.551 | 1.41E−02 | 19.7 | LYM136 | 13421.8 | D | 7.685 | 9.00E−05 | 87.2 |
| LYM84 | 13403.3 | E | 0.562 | 1.74E−02 | 21.9 | LYM136 | 13421.5 | D | 8.418 | 1.06E−04 | 105 |
| LYM1 | 11601.1 | E | 0.549 | 2.97E−02 | 19.1 | LYM160 | 13472.1 | D | 6.28 | 5.37E−04 | 52.9 |
| LYM84 | 13401.2 | E | 0.543 | 4.13E−02 | 17.9 | LYM293 | 13391.2 | D | 6.823 | 2.80E−03 | 66.1 |
| LYM84 | 13403.1 | E | 0.535 | 4.77E−02 | 16.1 | LYM84 | 13403.1 | D | 5.88 | 8.55E−03 | 43.2 |
| LYM84 | 13404.4 | E | 0.528 | 5.27E−02 | 14.6 | LYM84 | 13401.2 | D | 6.165 | 9.88E−03 | 50.1 |
| LYM136 | 13423.2 | E | 0.543 | 5.95E−02 | 18 | LYM136 | 13423.2 | D | 7.685 | 1.61E−02 | 87.2 |
| LYM1 | 11602.1 | E | 0.525 | 6.56E−02 | 13.9 | LYM160 | 13471.1 | D | 6.818 | 1.69E−02 | 66 |
| CONTROL | — | E | 0.461 | — | 0 | LYM84 | 13403.3 | D | 9.518 | 2.04E−02 | 131.8 |
| LYM136 | 13423.1 | D | 8.863 | 8.70E−05 | 75.8 | LYM136 | 13423.4 | D | 7.015 | 2.44E−02 | 70.8 |
| LYM84 | 13403.1 | D | 7.748 | 3.02E−03 | 53.7 | LYM160 | 13472.2 | D | 5.758 | 2.55E−02 | 40.2 |
| LYM84 | 13403.2 | D | 8.738 | 5.76E−03 | 73.4 | LYM293 | 13391.9 | D | 9.49 | 2.56E−02 | 131.1 |
| LYM84 | 13403.3 | D | 7.598 | 8.31E−03 | 50.7 | LYM293 | 13391.9 | D | 6.7 | 4.90E−02 | 63.2 |
| LYM84 | 13401.2 | D | 7.038 | 9.19E−03 | 39.6 | LYM136 | 13421.7 | D | 6.533 | 5.11E−02 | 59.1 |
| LYM84 | 13404.4 | D | 6.515 | 1.63E−02 | 29.3 | CONTROL | — | D | 4.106 | — | 0 |
| LYM1 | 11603.2 | D | 7.223 | 2.00E−02 | 43.3 | LYM136 | 13421.5 | F | 6.765 | 1.52E−03 | 21.7 |
| LYM136 | 13421.8 | D | 8.993 | 2.33E−02 | 78.4 | LYM136 | 13423.2 | F | 6.73 | 2.68E−03 | 21.1 |
| LYM1 | 11601.1 | D | 6.888 | 2.44E−02 | 36.7 | LYM136 | 13421.8 | F | 6.943 | 3.01E−03 | 24.9 |
| LYM136 | 13421.6 | D | 7.335 | 3.72E−02 | 45.5 | LYM84 | 13401.2 | F | 6.2 | 9.41E−03 | 11.5 |
| LYM136 | 13423.2 | D | 7.405 | 4.76E−02 | 46.9 | LYM136 | 13421.7 | F | 6.38 | 3.57E−02 | 14.8 |
| LYM1 | 11602.6 | D | 7.605 | 4.83E−02 | 50.9 | LYM293 | 13391.9 | F | 6.223 | 4.78E−02 | 11.9 |
| LYM1 | 11602.1 | D | 6.278 | 4.96E−02 | 24.6 | LYM84 | 13403.3 | F | 6.783 | 5.99E−02 | 22 |
| CONTROL | — | D | 5.04 | — | 0 | LYM293 | 13391.2 | F | 6.208 | 7.14E−02 | 11.7 |
| LYM136 | 13421.8 | F | 7.018 | 1.11E−04 | 27.1 | LYM160 | 13471.1 | F | 6.125 | 9.99E−02 | 10.2 |
| LYM84 | 13404.4 | F | 6.478 | 3.96E−04 | 17.3 | CONTROL | — | F | 5.559 | — | 0 |
| LYM136 | 13423.1 | F | 6.81 | 7.54E−04 | 23.3 | | | | | | |
| LYM1 | 11601.1 | F | 6.775 | 2.36E−03 | 22.7 | | | | | | |
| LYM84 | 13403.3 | F | 6.765 | 3.61E−03 | 22.5 | | | | | | |
| LYM84 | 13403.1 | F | 6.53 | 4.49E−03 | 18.3 | | | | | | |
| LYM84 | 13403.2 | F | 6.903 | 5.58E−03 | 25 | | | | | | |

TABLE 34-continued

Results obtained in a T2 experiment at the tissue culture assay

| Gene name | Event ID | | Mean | P value | % incr. vs. cont. | Gene name | Event | ID | Mean | P value | % incr. vs. cont. |
|---|---|---|---|---|---|---|---|---|---|---|---|
| LYM1 | 11603.2 | F | 6.813 | 6.13E-03 | 23.4 | | | | | | |
| LYM136 | 13423.2 | F | 6.79 | 7.54E-03 | 23 | | | | | | |
| LYM84 | 13401.2 | F | 6.633 | 1.04E-02 | 20.1 | | | | | | |
| LYM1 | 11602.1 | F | 6.275 | 1.24E-02 | 13.7 | | | | | | |
| LYM136 | 13421.6 | F | 6.113 | 1.93E-02 | 10.7 | | | | | | |
| LYM1 | 11604.4 | F | 6.708 | 2.78E-02 | 21.5 | | | | | | |
| CONTROL | — | F | 5.521 | — | 0 | | | | | | |

Table 34. Results of the tissue culture experiments. Provided are the measured values of each tested parameter [parameters (ID.) A-F according to the parameters described in Table 33 above] in plants expressing the indicated polynucleotides.
"Ev" = event;
"P" = P-value;
"Mean" = the average of measured parameter across replicates.
% incr. vs. cont. = percentage of increase versus control (as compared to control).

TABLE 35

Measured parameters at the tissue culture assay (T1 experiment) for transformed agriculture improving trait genes

| Tested Parameters | ID |
|---|---|
| Dry Weight (gr) | A |
| Fresh Weight (gr) | B |
| RGR Of Root Coverage | C |
| Roots Coverage TP3 (cm$^2$) | D |
| RGR Of Roots Length | E |
| Roots Length TP3 (cm) | F |
| Leaf Area TP3 (cm) | G |
| RGR Of Leaf Area | H |
| Leaf Area TP1 (cm) | I |
| Roots Length TP1 (cm) | J |

Table 35: Provided are the identification (ID) letters of each of the Tested Parameters. TP3 = Time point 3; RGR—relative growth rate. TP1 = Time point 1.

TABLE 36

Results obtained in a T1 experiment at the tissue culture assay

| Gene name | ID | Mean | P value | % incr. vs. cont | Gene name | ID | Mean | P value | % incr. vs. cont |
|---|---|---|---|---|---|---|---|---|---|
| LYM161 | A | 0.014 | 1.24E-03 | 90.4 | LYM240 | H | 0.078 | 2.23E-02 | 31.2 |
| LYM219 | A | 0.01 | 2.07E-03 | 28.3 | LYM228 | H | 0.077 | 2.59E-02 | 29.8 |
| LYM83 | A | 0.01 | 1.93E-02 | 30.6 | LYM189 | H | 0.076 | 3.81E-02 | 28 |
| LYM278 | A | 0.009 | 3.67E-02 | 25.9 | LYM184 | H | 0.082 | 4.23E-02 | 37.8 |
| LYM204 | A | 0.01 | 5.84E-02 | 36.3 | LYM248 | H | 0.076 | 6.24E-02 | 27.1 |
| LYM155 | A | 0.013 | 6.05E-02 | 70.7 | CONTROL | H | 0.06 | — | 0 |
| LYM221 | A | 0.009 | 9.70E-02 | 22.9 | LYM117 | A | 0.009 | 5.26E-04 | 65.7 |
| CONTROL | — | 0.007 | — | 0 | LYM146 | A | 0.01 | 1.17E-02 | 81.5 |
| LYM161 | B | 0.282 | 9.40E-05 | 75.5 | LYM144 | A | 0.007 | 1.61E-02 | 34.3 |
| LYM83 | B | 0.213 | 3.45E-03 | 32.5 | LYM93 | A | 0.008 | 7.31E-02 | 43.5 |
| LYM219 | B | 0.207 | 2.66E-02 | 28.8 | LYM123 | A | 0.006 | 7.96E-02 | 19 |
| LYM204 | B | 0.207 | 6.73E-02 | 28.8 | LYM127 | A | 0.007 | 9.16E-02 | 32.1 |
| LYM155 | B | 0.267 | 9.60E-02 | 66.3 | CONTROL | A | 0.005 | — | 0 |
| LYM278 | B | 0.191 | 9.94E-02 | 18.9 | LYM117 | B | 0.198 | 7.40E-05 | 75.7 |
| CONTROL | — | 0.161 | — | 0 | LYM127 | B | 0.159 | 8.58E-04 | 41.3 |
| LYM221 | C | 0.468 | 1.90E-03 | 94.9 | LYM146 | B | 0.186 | 8.64E-03 | 65.3 |
| LYM155 | C | 0.468 | 2.86E-03 | 95.2 | LYM192 | B | 0.148 | 1.44E-02 | 31.7 |
| LYM161 | C | 0.484 | 3.41E-03 | 101.5 | LYM144 | B | 0.153 | 4.48E-02 | 35.5 |
| LYM188 | C | 0.4 | 2.12E-02 | 66.5 | LYM93 | B | 0.172 | 5.30E-02 | 52.3 |
| LYM144 | C | 0.355 | 9.94E-02 | 48.1 | LYM135 | B | 0.178 | 5.72E-02 | 58 |
| CONTROL | — | 0.24 | — | 0 | LYM123 | B | 0.156 | 5.80E-02 | 38.4 |
| LYM188 | D | 3.425 | 1.59E-03 | 67.6 | LYM200 | B | 0.153 | 6.00E-02 | 35.5 |
| LYM221 | D | 3.964 | 1.79E-03 | 94 | CONTROL | B | 0.113 | — | 0 |
| LYM155 | D | 3.85 | 1.26E-02 | 88.4 | LYM135 | C | 0.625 | 1.90E-05 | 79.8 |
| LYM144 | D | 3.038 | 4.84E-02 | 48.6 | LYM127 | C | 0.614 | 5.30E-05 | 76.4 |
| LYM161 | D | 4.023 | 7.69E-02 | 96.8 | LYM146 | C | 0.553 | 1.54E-04 | 58.8 |
| CONTROL | — | 2.044 | — | 0 | LYM117 | C | 0.537 | 5.03E-04 | 54.2 |
| LYM155 | E | 0.444 | 9.80E-03 | 58.2 | LYM154 | C | 0.56 | 1.78E-03 | 60.9 |
| LYM221 | E | 0.413 | 2.08E-02 | 47 | LYM192 | C | 0.492 | 3.37E-03 | 41.5 |
| LYM188 | E | 0.41 | 2.14E-02 | 46.1 | LYM93 | C | 0.477 | 8.26E-03 | 37 |
| LYM161 | E | 0.412 | 2.44E-02 | 46.6 | LYM200 | C | 0.483 | 9.48E-03 | 38.9 |
| LYM144 | E | 0.405 | 2.83E-02 | 44.2 | LYM144 | C | 0.473 | 1.14E-02 | 35.8 |
| CONTROL | — | 0.281 | — | 0 | LYM123 | C | 0.473 | 1.75E-02 | 35.8 |
| LYM188 | F | 4.053 | 6.86E-04 | 41.3 | LYM273 | C | 0.473 | 1.83E-02 | 35.8 |

TABLE 36-continued

Results obtained in a T1 experiment at the tissue culture assay

| Gene name | ID | Mean | P value | % incr. vs. cont | Gene name | ID | Mean | P value | % incr. vs. cont |
|---|---|---|---|---|---|---|---|---|---|
| LYM144 | F | 3.97 | 2.09E−03 | 38.4 | CONTROL | C | 0.348 | — | 0 |
| LYM221 | F | 4.058 | 3.24E−03 | 41.5 | LYM192 | D | 4.217 | 1.10E−03 | 42.2 |
| LYM161 | F | 3.914 | 2.30E−02 | 36.5 | LYM93 | D | 4.075 | 1.12E−03 | 37.4 |
| LYM278 | F | 3.493 | 5.26E−02 | 21.8 | LYM144 | D | 4.057 | 4.97E−03 | 36.8 |
| LYM155 | F | 4.084 | 5.40E−02 | 42.4 | LYM117 | D | 4.4 | 7.86E−03 | 48.4 |
| LYM204 | F | 3.68 | 6.02E−02 | 28.3 | LYM146 | D | 4.555 | 9.70E−03 | 53.6 |
| CONTROL | — | 2.868 | — | 0 | LYM200 | D | 4.151 | 3.73E−02 | 40 |
| LYM83 | G | 0.883 | 2.63E−04 | 31.7 | LYM135 | D | 5.162 | 4.62E−02 | 74 |
| LYM161 | G | 1.129 | 1.06E−03 | 68.3 | LYM127 | D | 5.078 | 5.37E−02 | 71.2 |
| LYM221 | G | 0.856 | 4.40E−03 | 27.7 | LYM123 | D | 4.062 | 7.29E−02 | 37 |
| LYM278 | G | 0.834 | 9.29E−03 | 24.3 | CONTROL | D | 2.966 | — | 0 |
| LYM155 | G | 1.024 | 2.05E−02 | 52.8 | LYM127 | E | 0.535 | 9.11E−04 | 48.7 |
| LYM144 | G | 0.823 | 3.31E−02 | 22.7 | LYM135 | E | 0.508 | 2.21E−03 | 41 |
| LYM204 | G | 0.789 | 4.70E−02 | 17.6 | LYM117 | E | 0.463 | 1.53E−02 | 28.7 |
| CONTROL | — | 0.671 | — | 0 | LYM93 | E | 0.448 | 2.20E−02 | 24.5 |
| LYM161 | H | 0.122 | 4.00E−06 | 71.4 | LYM192 | E | 0.444 | 3.60E−02 | 23.2 |
| LYM155 | H | 0.112 | 2.07E−03 | 56.9 | LYM154 | E | 0.456 | 4.57E−02 | 26.7 |
| LYM83 | H | 0.096 | 7.84E−03 | 35.1 | CONTROL | E | 0.36 | — | 0 |
| LYM278 | H | 0.09 | 3.91E−02 | 26.5 | LYM93 | F | 4.431 | 8.92E−04 | 21.7 |
| LYM221 | H | 0.089 | 4.80E−02 | 25.3 | LYM192 | F | 4.435 | 9.73E−03 | 21.8 |
| LYM144 | H | 0.088 | 6.23E−02 | 23.8 | LYM144 | F | 4.132 | 6.49E−02 | 13.5 |
| CONTROL | — | 0.071 | — | 0 | LYM123 | F | 4.108 | 7.42E−02 | 12.8 |
| LYM227 | A | 0.01 | 8.00E−05 | 53.1 | LYM135 | F | 4.683 | 9.16E−02 | 28.6 |
| LYM32 | A | 0.007 | 1.81E−03 | 19.8 | CONTROL | F | 3.641 | — | 0 |
| LYM40 | A | 0.009 | 1.92E−03 | 49.9 | LYM127 | G | 0.72 | 6.12E−04 | 22.6 |
| LYM273 | A | 0.009 | 2.65E−03 | 44.7 | LYM117 | G | 0.904 | 2.69E−03 | 53.9 |
| LYM273 | A | 0.01 | 3.12E−03 | 63.1 | LYM192 | G | 0.701 | 3.05E−03 | 19.3 |
| LYM200 | A | 0.01 | 8.53E−03 | 57.9 | LYM135 | G | 0.885 | 1.05E−02 | 50.7 |
| LYM118 | A | 0.008 | 2.84E−02 | 24.2 | LYM146 | G | 0.854 | 1.87E−02 | 45.4 |
| LYM164 | A | 0.009 | 3.85E−02 | 39.1 | LYM144 | G | 0.693 | 2.45E−02 | 18 |
| LYM23 | A | 0.008 | 6.86E−02 | 32.3 | LYM93 | G | 0.737 | 9.00E−02 | 25.4 |
| LYM93 | A | 0.01 | 8.67E−02 | 61.9 | CONTROL | G | 0.588 | — | 0 |
| LYM122 | A | 0.008 | 9.35E−02 | 28.3 | LYM117 | H | 0.095 | 1.50E−05 | 62.9 |
| CONTROL | — | 0.006 | — | 0 | LYM135 | H | 0.09 | 4.07E−04 | 55.5 |
| LYM227 | B | 0.248 | 4.10E−05 | 47.9 | LYM146 | H | 0.085 | 9.67E−04 | 46.9 |
| LYM40 | B | 0.216 | 2.49E−04 | 28.6 | LYM93 | H | 0.075 | 2.94E−02 | 29.7 |
| LYM273 | B | 0.231 | 7.82E−03 | 37.8 | LYM127 | H | 0.073 | 7.67E−02 | 25.7 |
| LYM200 | B | 0.251 | 1.45E−02 | 49.8 | CONTROL | H | 0.058 | — | 0 |
| LYM146 | B | 0.229 | 1.83E−02 | 36.6 | LYM180 | A | 0.006 | 1.39E−04 | 44.3 |
| LYM273 | B | 0.249 | 1.90E−02 | 48.6 | LYM243 | A | 0.006 | 3.56E−03 | 64.4 |
| LYM164 | B | 0.222 | 2.09E−02 | 32.2 | LYM194 | A | 0.006 | 9.85E−03 | 62.5 |
| LYM154 | B | 0.216 | 3.87E−02 | 28.8 | LYM221 | A | 0.005 | 4.06E−02 | 34.6 |
| LYM122 | B | 0.189 | 6.35E−02 | 12.9 | LYM204 | A | 0.006 | 4.55E−02 | 60.5 |
| LYM135 | B | 0.197 | 7.69E−02 | 17.4 | LYM109 | A | 0.005 | 6.49E−02 | 29.4 |
| CONTROL | — | 0.168 | — | 0 | LYM233 | A | 0.007 | 7.12E−02 | 70.9 |
| LYM234 | C | 0.482 | 5.87E−02 | 32.1 | CONTROL | A | 0.004 | — | 0 |
| LYM200 | C | 0.469 | 6.18E−02 | 28.7 | LYM243 | B | 0.148 | 1.67E−02 | 28.8 |
| LYM227 | C | 0.47 | 6.80E−02 | 28.9 | CONTROL | B | 0.115 | — | 0 |
| LYM154 | C | 0.481 | 7.23E−02 | 31.9 | LYM233 | C | 0.383 | 4.28E−04 | 55.4 |
| CONTROL | — | 0.364 | — | 0 | LYM204 | C | 0.377 | 6.67E−04 | 52.8 |
| LYM200 | D | 3.874 | 5.17E−02 | 27.9 | LYM248 | C | 0.377 | 1.32E−03 | 53.1 |
| CONTROL | — | 3.029 | — | 0 | LYM194 | C | 0.366 | 1.66E−03 | 48.4 |
| LYM273 | G | 1.057 | 1.01E−04 | 23 | LYM186 | C | 0.387 | 1.93E−03 | 57.1 |
| LYM227 | G | 1.033 | 1.50E−04 | 20.2 | LYM243 | C | 0.347 | 4.89E−03 | 40.9 |
| LYM200 | G | 1.012 | 2.71E−04 | 17.8 | LYM83 | C | 0.349 | 5.96E−03 | 41.5 |
| LYM273 | G | 1.027 | 2.79E−04 | 19.6 | LYM109 | C | 0.34 | 1.16E−02 | 38 |
| LYM154 | G | 1.022 | 1.12E−02 | 18.9 | LYM228 | C | 0.336 | 1.95E−02 | 36.4 |
| LYM164 | G | 1.027 | 8.89E−02 | 19.5 | LYM115 | C | 0.339 | 1.96E−02 | 37.7 |
| LYM146 | G | 1.063 | 8.89E−02 | 23.7 | LYM252 | C | 0.34 | 2.33E−02 | 38 |
| LYM40 | G | 0.97 | 9.15E−02 | 12.9 | CONTROL | C | 0.246 | — | 0 |
| LYM135 | G | 1.045 | 9.75E−02 | 21.6 | LYM243 | D | 2.941 | 4.12E−03 | 38.7 |
| CONTROL | — | 0.859 | — | 0 | LYM115 | D | 2.938 | 6.77E−03 | 38.6 |
| LYM93 | H | 0.117 | 2.44E−02 | 29.7 | LYM194 | D | 3.087 | 8.47E−03 | 45.6 |
| LYM146 | H | 0.112 | 3.08E−02 | 24.4 | LYM233 | D | 3.284 | 1.36E−02 | 54.9 |
| LYM273 | H | 0.108 | 4.22E−02 | 20.3 | LYM204 | D | 3.176 | 2.25E−02 | 49.8 |
| LYM273 | H | 0.107 | 5.78E−02 | 19 | LYM83 | D | 2.959 | 3.59E−02 | 39.6 |
| LYM154 | H | 0.108 | 6.06E−02 | 19.8 | LYM109 | D | 2.886 | 4.28E−02 | 36.1 |
| LYM164 | H | 0.108 | 6.30E−02 | 20 | LYM248 | D | 3.188 | 5.13E−02 | 50.4 |
| LYM135 | H | 0.108 | 7.21E−02 | 19.8 | CONTROL | D | 2.12 | — | 0 |
| LYM227 | H | 0.106 | 7.58E−02 | 17.7 | LYM248 | E | 0.416 | 9.58E−03 | 27.1 |
| LYM200 | H | 0.106 | 7.94E−02 | 17.6 | LYM204 | E | 0.389 | 6.24E−02 | 19.1 |
| LYM234 | H | 0.107 | 8.46E−02 | 18.6 | LYM233 | E | 0.39 | 7.40E−02 | 19.4 |
| CONTROL | — | 0.09 | — | 0 | LYM83 | E | 0.385 | 8.68E−02 | 17.7 |
| LYM131 | A | 0.008 | 2.70E−02 | 60.5 | CONTROL | E | 0.327 | — | 0 |
| LYM194 | A | 0.007 | 5.17E−02 | 36.9 | LYM115 | F | 3.729 | 2.49E−03 | 13.6 |

TABLE 36-continued

Results obtained in a T1 experiment at the tissue culture assay

| Gene name | ID | Mean | P value | % incr. vs. cont | Gene name | ID | Mean | P value | % incr. vs. cont |
|---|---|---|---|---|---|---|---|---|---|
| LYM261 | A | 0.006 | 5.62E−02 | 29.7 | LYM248 | F | 4.115 | 5.82E−03 | 25.3 |
| LYM185 | A | 0.01 | 5.77E−02 | 99.7 | LYM228 | F | 3.665 | 2.44E−02 | 11.6 |
| LYM123 | A | 0.007 | 7.73E−02 | 39 | LYM204 | F | 3.852 | 4.19E−02 | 17.3 |
| LYM192 | A | 0.006 | 7.80E−02 | 14.4 | LYM83 | F | 3.788 | 6.51E−02 | 15.4 |
| CONTROL | — | 0.005 | — | 0 | LYM233 | F | 3.97 | 8.99E−02 | 20.9 |
| LYM252 | B | 0.165 | 5.43E−03 | 38.4 | CONTROL | F | 3.284 | — | 0 |
| LYM131 | B | 0.181 | 2.17E−02 | 51.5 | LYM233 | G | 0.768 | 5.26E−03 | 41.5 |
| LYM194 | B | 0.164 | 3.02E−02 | 37.5 | LYM194 | G | 0.73 | 1.12E−02 | 34.5 |
| LYM185 | B | 0.225 | 3.55E−02 | 87.9 | LYM228 | G | 0.597 | 4.27E−02 | 9.8 |
| LYM123 | B | 0.154 | 4.39E−02 | 28.9 | LYM243 | G | 0.676 | 4.45E−02 | 24.5 |
| CONTROL | — | 0.12 | — | 0 | LYM215 | G | 0.626 | 6.82E−02 | 15.4 |
| LYM185 | C | 0.527 | 6.00E−06 | 97.4 | LYM204 | G | 0.697 | 8.47E−02 | 28.3 |
| LYM123 | C | 0.495 | 1.50E−05 | 85.7 | CONTROL | G | 0.543 | — | 0 |
| LYM131 | C | 0.454 | 2.90E−05 | 70.4 | LYM233 | H | 0.078 | 1.07E−04 | 38.3 |
| LYM194 | C | 0.413 | 1.09E−03 | 54.7 | LYM194 | H | 0.077 | 4.96E−04 | 36.3 |
| LYM243 | C | 0.406 | 3.94E−03 | 52.1 | LYM204 | H | 0.069 | 2.23E−02 | 23.5 |
| LYM252 | C | 0.375 | 1.15E−02 | 40.5 | LYM243 | H | 0.068 | 2.43E−02 | 20.9 |
| LYM233 | C | 0.366 | 1.81E−02 | 37.2 | LYM252 | H | 0.071 | 2.64E−02 | 26.5 |
| LYM215 | C | 0.338 | 7.24E−02 | 26.7 | CONTROL | H | 0.056 | — | 0 |
| CONTROL | — | 0.267 | — | 0 | LYM189 | A | 0.009 | 3.27E−04 | 32.5 |
| LYM131 | D | 3.668 | 3.37E−04 | 67.4 | LYM32 | A | 0.01 | 8.84E−03 | 51.3 |
| LYM215 | D | 2.788 | 1.33E−02 | 27.2 | LYM219 | A | 0.01 | 4.76E−02 | 49.4 |
| LYM194 | D | 3.34 | 2.15E−02 | 52.4 | LYM240 | A | 0.009 | 5.15E−02 | 33.2 |
| LYM123 | D | 4.004 | 3.68E−02 | 82.7 | LYM161 | A | 0.01 | 7.76E−02 | 52 |
| LYM185 | D | 4.257 | 5.21E−02 | 94.2 | CONTROL | A | 0.007 | — | 0 |
| LYM233 | D | 3.014 | 6.12E−02 | 37.5 | LYM32 | B | 0.19 | 9.39E−04 | 27.5 |
| LYM252 | D | 3.036 | 7.43E−02 | 38.5 | LYM249 | B | 0.225 | 2.56E−03 | 51 |
| CONTROL | — | 2.192 | — | 0 | LYM189 | B | 0.21 | 3.29E−02 | 40.5 |
| LYM131 | E | 0.469 | 8.00E−06 | 42.8 | LYM193 | B | 0.193 | 6.69E−02 | 29.1 |
| LYM185 | E | 0.47 | 2.28E−04 | 43.1 | LYM261 | B | 0.177 | 7.40E−02 | 18.5 |
| LYM123 | E | 0.448 | 3.49E−04 | 36.4 | CONTROL | B | 0.149 | — | 0 |
| LYM194 | E | 0.411 | 6.53E−03 | 25.3 | LYM234 | C | 0.531 | 0.00E+00 | 123.9 |
| LYM243 | E | 0.407 | 8.35E−03 | 24 | LYM249 | C | 0.539 | 0.00E+00 | 127.6 |
| LYM252 | E | 0.383 | 7.84E−02 | 16.6 | LYM219 | C | 0.517 | 7.00E−06 | 118.2 |
| CONTROL | — | 0.328 | — | 0 | LYM240 | C | 0.415 | 2.30E−05 | 75.1 |
| LYM131 | F | 4.042 | 7.90E−05 | 32 | LYM74 | C | 0.443 | 6.30E−05 | 86.9 |
| LYM243 | F | 3.668 | 1.22E−02 | 19.8 | LYM179 | C | 0.406 | 1.06E−04 | 71.1 |
| LYM215 | F | 3.383 | 3.49E−02 | 10.5 | LYM161 | C | 0.409 | 1.34E−04 | 72.4 |
| LYM194 | F | 3.635 | 4.63E−02 | 18.8 | LYM79 | C | 0.412 | 1.71E−04 | 73.6 |
| LYM123 | F | 3.912 | 5.09E−02 | 27.8 | LYM188 | C | 0.38 | 5.35E−04 | 60.3 |
| LYM185 | F | 4.091 | 7.35E−02 | 33.7 | LYM278 | C | 0.376 | 1.23E−03 | 58.5 |
| CONTROL | — | 3.061 | — | 0 | LYM261 | C | 0.369 | 1.75E−03 | 55.6 |
| LYM131 | G | 0.834 | 1.00E−06 | 54 | LYM224 | C | 0.382 | 3.15E−03 | 61.3 |
| LYM123 | G | 0.78 | 2.30E−05 | 44.1 | LYM189 | C | 0.349 | 5.89E−03 | 47.3 |
| LYM233 | G | 0.643 | 8.49E−03 | 18.8 | LYM32 | C | 0.341 | 2.37E−02 | 44 |
| LYM252 | G | 0.713 | 2.16E−02 | 31.8 | LYM193 | C | 0.322 | 4.86E−02 | 35.6 |
| LYM243 | G | 0.656 | 2.67E−02 | 21.2 | LYM155 | C | 0.302 | 9.72E−02 | 27.2 |
| LYM192 | G | 0.669 | 2.77E−02 | 23.5 | CONTROL | C | 0.237 | — | 0 |
| LYM261 | G | 0.637 | 3.41E−02 | 17.7 | LYM240 | D | 3.448 | 1.00E−06 | 67.3 |
| LYM194 | G | 0.715 | 5.43E−02 | 32 | LYM188 | D | 3.137 | 6.00E−06 | 52.2 |
| LYM185 | G | 0.825 | 5.58E−02 | 52.4 | LYM179 | D | 3.35 | 9.72E−04 | 62.6 |
| CONTROL | — | 0.541 | — | 0 | LYM189 | D | 2.884 | 1.31E−03 | 39.9 |
| LYM131 | H | 0.087 | 3.00E−06 | 53.4 | LYM234 | D | 4.399 | 4.93E−03 | 113.5 |
| LYM185 | H | 0.092 | 1.70E−05 | 62.1 | LYM249 | D | 4.486 | 8.04E−03 | 117.7 |
| LYM123 | H | 0.083 | 3.10E−05 | 46.2 | LYM74 | D | 3.651 | 9.49E−03 | 77.2 |
| LYM252 | H | 0.077 | 2.13E−03 | 34.4 | LYM261 | D | 3.07 | 2.24E−02 | 49 |
| LYM194 | H | 0.077 | 3.63E−03 | 34.1 | LYM161 | D | 3.381 | 2.29E−02 | 64.1 |
| LYM192 | H | 0.073 | 1.17E−02 | 27.3 | LYM278 | D | 3.171 | 2.40E−02 | 53.9 |
| LYM261 | H | 0.069 | 4.77E−02 | 20.8 | LYM79 | D | 3.427 | 3.04E−02 | 66.3 |
| LYM243 | H | 0.068 | 7.19E−02 | 18.9 | LYM219 | D | 4.274 | 7.53E−02 | 107.4 |
| CONTROL | — | 0.057 | — | 0 | LYM155 | D | 2.558 | 8.03E−02 | 24.1 |
| LYM245 | A | 0.008 | 1.20E−02 | 38.7 | CONTROL | D | 2.061 | — | 0 |
| LYM228 | A | 0.008 | 1.47E−02 | 44.3 | LYM249 | E | 0.438 | 5.00E−06 | 53.9 |
| LYM240 | A | 0.008 | 2.80E−02 | 45.2 | LYM234 | E | 0.431 | 3.10E−05 | 51.7 |
| LYM260 | A | 0.007 | 3.74E−02 | 27.4 | LYM219 | E | 0.401 | 1.65E−03 | 41.2 |
| LYM189 | A | 0.007 | 3.75E−02 | 27 | LYM224 | E | 0.397 | 2.21E−03 | 39.7 |
| LYM184 | A | 0.009 | 5.19E−02 | 49.1 | LYM179 | E | 0.378 | 3.93E−03 | 33 |

TABLE 36-continued

Results obtained in a T1 experiment at the tissue culture assay

| Gene name | ID | Mean | P value | % incr. vs. cont | Gene name | ID | Mean | P value | % incr. vs. cont |
|---|---|---|---|---|---|---|---|---|---|
| CONTROL | — | 0.006 | — | 0 | LYM79 | E | 0.383 | 5.24E−03 | 34.7 |
| LYM245 | B | 0.16 | 1.51E−02 | 41.9 | LYM240 | E | 0.362 | 8.54E−03 | 27.4 |
| LYM260 | B | 0.15 | 2.23E−02 | 33 | LYM74 | E | 0.373 | 9.36E−03 | 31.3 |
| LYM189 | B | 0.136 | 4.67E−02 | 20.6 | LYM189 | E | 0.352 | 2.77E−02 | 23.9 |
| LYM240 | B | 0.144 | 5.98E−02 | 27.5 | LYM261 | E | 0.35 | 3.22E−02 | 23 |
| LYM228 | B | 0.148 | 7.33E−02 | 31.1 | LYM188 | E | 0.352 | 3.95E−02 | 23.9 |
| LYM184 | B | 0.159 | 8.46E−02 | 41.5 | LYM193 | E | 0.351 | 5.12E−02 | 23.4 |
| CONTROL | — | 0.113 | — | 0 | LYM161 | E | 0.348 | 5.53E−02 | 22.4 |
| LYM184 | C | 0.46 | 1.23E−03 | 98.6 | LYM32 | E | 0.344 | 8.20E−02 | 21 |
| LYM240 | C | 0.363 | 6.06E−03 | 56.9 | LYM251 | E | 0.338 | 9.37E−02 | 18.9 |
| LYM109 | C | 0.33 | 2.96E−02 | 42.4 | CONTROL | E | 0.284 | — | 0 |
| LYM245 | C | 0.322 | 5.20E−02 | 39.3 | LYM74 | F | 3.635 | 3.70E−05 | 18.8 |
| LYM248 | C | 0.323 | 5.28E−02 | 39.7 | LYM249 | F | 4.232 | 3.54E−05 | 38.3 |
| LYM189 | C | 0.318 | 6.19E−02 | 37.2 | LYM240 | F | 3.548 | 3.55E−03 | 16 |
| LYM186 | C | 0.315 | 6.33E−02 | 36 | LYM234 | F | 4.189 | 3.00E−02 | 36.9 |
| CONTROL | — | 0.232 | — | 0 | LYM261 | F | 3.464 | 4.23E−02 | 13.2 |
| LYM109 | D | 2.67 | 9.12E−04 | 41.4 | LYM179 | F | 3.591 | 9.25E−02 | 17.4 |
| LYM186 | D | 2.588 | 1.06E−02 | 37 | CONTROL | F | 3.06 | — | 0 |
| LYM240 | D | 2.99 | 1.63E−02 | 58.4 | LYM240 | G | 0.919 | 5.00E−06 | 57.4 |
| LYM189 | D | 2.592 | 1.94E−02 | 37.3 | LYM249 | G | 0.849 | 1.20E−05 | 45.4 |
| LYM245 | D | 2.594 | 4.12E−02 | 37.4 | LYM278 | G | 0.879 | 9.10E−05 | 50.5 |
| LYM115 | D | 2.352 | 4.59E−02 | 24.6 | LYM261 | G | 0.799 | 1.65E−04 | 36.8 |
| LYM248 | D | 2.622 | 7.42E−02 | 38.8 | LYM224 | G | 0.739 | 2.43E−04 | 26.5 |
| LYM180 | D | 2.304 | 7.43E−02 | 22 | LYM189 | G | 0.853 | 1.11E−03 | 46 |
| CONTROL | — | 1.888 | — | 0 | LYM161 | G | 0.913 | 1.62E−03 | 56.3 |
| LYM240 | E | 0.391 | 1.32E−02 | 29.6 | LYM79 | G | 0.915 | 2.06E−03 | 56.7 |
| LYM248 | E | 0.386 | 2.03E−02 | 28.1 | LYM188 | G | 0.747 | 1.25E−02 | 27.9 |
| LYM186 | E | 0.384 | 2.65E−02 | 27.4 | LYM219 | G | 0.841 | 1.69E−02 | 44.1 |
| LYM184 | E | 0.417 | 5.28E−02 | 38.2 | LYM74 | G | 0.762 | 1.99E−02 | 30.4 |
| LYM180 | E | 0.366 | 6.72E−02 | 21.5 | LYM179 | G | 0.795 | 4.21E−02 | 36.2 |
| LYM109 | E | 0.364 | 7.31E−02 | 20.8 | LYM234 | G | 0.815 | 4.73E−02 | 39.5 |
| CONTROL | — | 0.301 | — | 0 | CONTROL | G | 0.584 | — | 0 |
| LYM240 | F | 3.576 | 2.32E−03 | 26.9 | LYM161 | H | 0.097 | 2.10E−05 | 62.6 |
| LYM109 | F | 3.246 | 1.05E−02 | 15.2 | LYM240 | H | 0.094 | 4.70E−05 | 57.3 |
| LYM248 | F | 3.449 | 1.22E−02 | 22.4 | LYM79 | H | 0.095 | 7.60E−05 | 59.9 |
| LYM180 | F | 3.271 | 3.14E−02 | 16 | LYM189 | H | 0.091 | 1.67E−04 | 53.1 |
| LYM186 | F | 3.533 | 4.22E−02 | 25.3 | LYM278 | H | 0.088 | 4.71E−04 | 47.7 |
| LYM189 | F | 3.237 | 6.97E−02 | 14.8 | LYM249 | H | 0.086 | 7.09E−04 | 45.4 |
| LYM115 | F | 3.16 | 7.89E−02 | 12.1 | LYM219 | H | 0.087 | 1.31E−03 | 46 |
| CONTROL | — | 2.819 | — | 0 | LYM234 | H | 0.086 | 2.25E−03 | 44.5 |
| LYM184 | G | 0.774 | 3.40E−05 | 36 | LYM261 | H | 0.082 | 3.68E−03 | 38.3 |
| LYM228 | G | 0.749 | 1.29E−03 | 31.6 | LYM32 | H | 0.086 | 4.72E−03 | 44.3 |
| LYM189 | G | 0.726 | 6.50E−03 | 27.5 | LYM179 | H | 0.081 | 1.11E−02 | 35.5 |
| LYM240 | G | 0.735 | 2.55E−02 | 29.1 | LYM74 | H | 0.081 | 1.50E−02 | 36.7 |
| LYM186 | G | 0.653 | 4.33E−02 | 14.7 | LYM188 | H | 0.077 | 2.66E−02 | 29.3 |
| CONTROL | — | 0.569 | — | 0 | LYM224 | H | 0.077 | 4.09E−02 | 30.1 |
|  |  |  |  |  | CONTROL | H | 0.059 | — | 0 |
|  |  |  |  |  | LYM38 | B | 0.115 | — | 13.8 |
|  |  |  |  |  | LYM126 | B | 0.136 | — | 34.3 |
|  |  |  |  |  | CONTROL | B | 0.101 | — | 0 |
| LYM36 | A | 0.004 | E−4.7501 | 6.7 | LYM36 | I | 0.138 | E−014.84 | 7.8 |
| CONTROL | A | 0.004 | — | 0 | CONTROL | I | 0.128 | — | 0 |
| LYM36 | I | 0.09 | E−4.3401 | 7 | LYM36 | J | 0.693 | E−017.20 | 3.3 |
| CONTROL | I | 0.084 | — | 0 | CONTROL | J | 0.671 | — | 0 |

Table 36. Results of the tissue culture experiments. Provided are the measured values of each tested parameter [parameters (ID.) A-F according to the parameters described in Table 35 above] in plants expressing the indicated polynucleotides. "Ev" = event; "P" = P-value; "Mean" = the average of measured parameter across events. % incr. vs. cont. = percentage of increase versus control (as compared to control).

TABLE 37

Measured parameters at the tissue culture assay low nitrogen (T2 experiment) for transformed agriculture improving trait genes

| Tested Parameters | ID |
|---|---|
| Dry Weight (gr) | G |
| Fresh Weight (gr) | H |
| RGR Of Root Coverage | I |
| Roots Coverage TP3 (cm$^2$) | J |
| RGR Of Roots Length | K |
| Roots Length TP3 (cm) | L |
| Leaf Area TP3 (cm) | M |
| RGR Of Leaf Area | N |

Table 37: Provided are the identification (ID) letters of each of the Tested Parameters. TP3—Time Point 3; RGR—Relative Growth Rate plants were grown on low nitrogen as described above.

TABLE 38

Results obtained in a T2 experiment at the tissue culture assay low nitrogen

| Gene name | Event | ID | Mean | P value | % incr. vs. cont | Gene name | Event | ID | Mean | P value | % incr. vs. cont |
|---|---|---|---|---|---|---|---|---|---|---|---|
| LYM178 | 12161.1 | G | 0.006 | 2.07E-03 | 39.1 | LYM5 | 12432.1 | G | 0.007 | 1.40E-05 | 69.3 |
| LYM37 | 11801.2 | G | 0.007 | 3.50E-03 | 60 | LYM268 | 12483.2 | G | 0.007 | 1.56E-04 | 56.6 |
| LYM34 | 11901.1 | G | 0.006 | 3.63E-03 | 31.9 | LYM1 | 11602.6 | G | 0.009 | 2.16E-04 | 107.8 |
| CONTROL | — | G | 0.004 | — | 0 | LYM178 | 12164.3 | G | 0.009 | 3.01E-03 | 110.2 |
| LYM37 | 11801.2 | I | 1.024 | 1.65E-04 | 56.9 | LYM132 | 12275.3 | G | 0.006 | 3.52E-03 | 50.6 |
| LYM178 | 12161.1 | I | 1.023 | 5.17E-04 | 56.8 | LYM129 | 12572.2 | G | 0.006 | 5.24E-03 | 41.6 |
| CONTROL | — | I | 0.652 | — | 0 | LYM1 | 11604.4 | G | 0.006 | 5.89E-03 | 39.2 |
| LYM12 | 11873.4 | L | 6.672 | 5.23E-03 | 23 | LYM129 | 12571.3 | G | 0.006 | 7.22E-03 | 45.2 |
| LYM37 | 11801.2 | L | 6.593 | 5.54E-03 | 21.5 | LYM268 | 12483.4 | G | 0.008 | 7.89E-03 | 95.8 |
| CONTROL | — | L | 5.425 | — | 0 | LYM178 | 12164.2 | G | 0.006 | 8.14E-03 | 50.6 |
| LYM5 | 12436.1 | G | 0.008 | 3.89E-04 | 83.5 | LYM132 | 12273.2 | G | 0.005 | 8.21E-03 | 30.7 |
| LYM86 | 12183.3 | G | 0.007 | 5.67E-04 | 63 | CONTROL | — | G | 0.004 | — | 0 |
| LYM82 | 12203.5 | G | 0.011 | 2.31E-03 | 153 | LYM1 | 11602.6 | H | 0.177 | 1.00E-06 | 103.6 |
| LYM82 | 12201.2 | G | 0.008 | 2.64E-03 | 77.8 | LYM5 | 12432.1 | H | 0.142 | 1.94E-04 | 64 |
| LYM86 | 12182.3 | G | 0.007 | 2.83E-03 | 49.9 | LYM268 | 12483.2 | H | 0.154 | 9.59E-04 | 76.8 |
| CONTROL | — | G | 0.004 | — | 0 | LYM129 | 12572.2 | H | 0.123 | 1.86E-03 | 41.4 |
| LYM268 | 12482.1 | H | 0.115 | 8.00E-06 | 61.6 | LYM132 | 12275.3 | H | 0.144 | 2.77E-03 | 66.3 |
| LYM82 | 12203.5 | H | 0.189 | 2.40E-04 | 166 | LYM129 | 12573.5 | H | 0.13 | 3.59E-03 | 50.2 |
| LYM44 | 11884.1 | H | 0.12 | 6.61E-04 | 67.8 | LYM6 | 11735.1 | H | 0.118 | 8.04E-03 | 36 |
| LYM6 | 11735.2 | H | 0.102 | 6.94E-04 | 43.6 | LYM178 | 12164.2 | H | 0.133 | 9.56E-03 | 53.6 |
| LYM82 | 12201.2 | H | 0.144 | 1.47E-03 | 101.5 | CONTROL | — | H | 0.087 | — | 0 |
| LYM129 | 12573.1 | H | 0.122 | 1.54E-03 | 71.9 | LYM268 | 12483.4 | I | 1.459 | 0.00E+00 | 94.9 |
| LYM86 | 12183.3 | H | 0.132 | 1.66E-03 | 85.3 | LYM5 | 12435.1 | I | 1.327 | 5.00E-06 | 77.2 |
| LYM86 | 12182.3 | H | 0.124 | 2.94E-03 | 73.7 | LYM178 | 12164.2 | I | 1.39 | 2.60E-05 | 85.7 |
| LYM5 | 12436.1 | H | 0.155 | 6.44E-03 | 118.2 | LYM129 | 12571.3 | I | 1.264 | 3.90E-05 | 68.7 |
| LYM129 | 12572.2 | H | 0.121 | 7.61E-03 | 69.9 | LYM129 | 12573.5 | I | 1.215 | 4.60E-05 | 62.3 |
| LYM82 | 12204.6 | H | 0.091 | 9.35E-03 | 27.4 | LYM268 | 12483.2 | I | 1.195 | 7.50E-05 | 59.5 |
| LYM5 | 12435.1 | H | 0.104 | 9.36E-03 | 45.6 | LYM268 | 12482.3 | I | 1.16 | 3.42E-04 | 54.9 |
| LYM8 | 11984.1 | H | 0.15 | 9.54E-03 | 110.2 | LYM134 | 12314.2 | I | 1.199 | 4.26E-04 | 60.1 |
| CONTROL | — | H | 0.071 | — | 0 | LYM1 | 11603.2 | I | 1.094 | 1.02E-03 | 46.1 |
| LYM268 | 12483.4 | I | 1.515 | 0.00E+00 | 124.3 | LYM5 | 12432.2 | I | 1.082 | 2.26E-03 | 44.5 |
| LYM82 | 12203.2 | I | 1.459 | 0.00E+00 | 116 | LYM268 | 12482.1 | I | 1.23 | 4.74E-03 | 64.3 |
| LYM82 | 12203.5 | I | 1.419 | 8.00E-06 | 110.1 | LYM1 | 11602.6 | I | 1.073 | 6.12E-03 | 43.2 |
| LYM8 | 11984.1 | I | 1.336 | 1.10E-05 | 97.9 | LYM132 | 12276.1 | I | 1.134 | 7.20E-03 | 51.5 |
| LYM44 | 11882.1 | I | 1.135 | 2.40E-05 | 68.1 | CONTROL | — | I | 0.749 | — | 0 |
| LYM5 | 12436.1 | I | 1.264 | 3.40E-05 | 87.2 | LYM268 | 12483.4 | J | 12.19 | 3.00E-05 | 90.2 |
| LYM86 | 12183.3 | I | 1.056 | 1.39E-04 | 56.3 | LYM5 | 12435.1 | J | 10.945 | 1.14E-03 | 70.8 |
| LYM86 | 12182.3 | I | 1.219 | 1.86E-04 | 80.5 | LYM129 | 12571.3 | J | 10.375 | 1.25E-03 | 61.9 |
| LYM5 | 12436.2 | I | 1.072 | 2.95E-04 | 58.7 | LYM129 | 12573.5 | J | 10.093 | 2.32E-03 | 57.5 |
| LYM82 | 12201.2 | I | 0.986 | 3.76E-04 | 46 | LYM268 | 12483.2 | J | 9.908 | 2.57E-03 | 54.6 |
| LYM44 | 11884.3 | I | 1.094 | 5.32E-04 | 62 | LYM268 | 12482.3 | J | 9.59 | 4.95E-03 | 49.6 |
| LYM44 | 11885.4 | I | 1.249 | 1.21E-03 | 85 | CONTROL | — | J | 6.409 | — | 0 |
| LYM268 | 12484.2 | I | 1.147 | 1.40E-03 | 69.9 | LYM129 | 12571.3 | K | 0.76 | 6.00E-05 | 41.4 |
| LYM8 | 11982.7 | I | 0.958 | 1.62E-03 | 41.9 | LYM5 | 12435.1 | K | 0.754 | 6.90E-05 | 40.3 |
| LYM8 | 11983.1 | I | 1.007 | 1.85E-03 | 49.1 | CONTROL | — | K | 0.538 | — | 0 |
| LYM129 | 12573.1 | I | 0.935 | 2.77E-03 | 38.4 | LYM129 | 12571.3 | L | 7.821 | 3.52E-04 | 23.6 |
| LYM129 | 12573.3 | I | 0.901 | 2.85E-03 | 33.4 | LYM5 | 12435.1 | L | 7.76 | 5.05E-04 | 22.6 |
| LYM268 | 12482.1 | I | 0.992 | 3.37E-03 | 46.9 | LYM268 | 12483.4 | L | 7.69 | 6.12E-04 | 21.5 |
| LYM6 | 11734.3 | I | 1.105 | 5.28E-03 | 63.6 | CONTROL | — | L | 6.328 | — | 0 |
| LYM5 | 12435.1 | I | 1.047 | 6.27E-03 | 55.1 | LYM5 | 12432.1 | M | 0.837 | 3.00E-06 | 67.1 |
| LYM129 | 12572.2 | I | 0.97 | 7.93E-03 | 43.6 | LYM129 | 12571.3 | M | 0.732 | 2.50E-05 | 46.1 |
| CONTROL | — | I | 0.675 | — | 0 | LYM132 | 12273.2 | M | 0.685 | 8.40E-05 | 36.7 |
| LYM82 | 12203.2 | J | 12.328 | 1.84E-03 | 118.3 | LYM1 | 11604.4 | M | 0.692 | 1.78E-04 | 38.1 |
| LYM129 | 12573.3 | J | 7.459 | 3.21E-03 | 32.1 | LYM129 | 12573.5 | M | 0.797 | 3.26E-04 | 59.1 |
| LYM268 | 12483.4 | J | 12.726 | 6.83E-03 | 125.4 | LYM178 | 12163.3 | M | 0.668 | 6.70E-04 | 33.4 |
| LYM82 | 12201.2 | J | 8.641 | 8.55E-03 | 53 | LYM1 | 11602.6 | M | 0.95 | 7.84E-04 | 89.7 |
| CONTROL | — | J | 5.647 | — | 0 | LYM5 | 12435.1 | M | 0.756 | 8.12E-04 | 51.1 |
| LYM82 | 12203.2 | K | 0.636 | 1.22E-03 | 30 | LYM132 | 12275.3 | M | 0.727 | 1.36E-03 | 45.3 |
| LYM5 | 12435.1 | K | 0.624 | 1.73E-03 | 27.8 | LYM1 | 11602.1 | M | 0.676 | 1.74E-03 | 35.1 |
| LYM86 | 12182.3 | K | 0.622 | 2.13E-03 | 27.3 | LYM268 | 12483.4 | M | 0.889 | 2.41E-03 | 77.5 |
| LYM268 | 12483.4 | K | 0.628 | 3.66E-03 | 28.5 | LYM178 | 12164.3 | M | 0.93 | 2.60E-03 | 85.7 |
| LYM44 | 11884.3 | K | 0.614 | 5.55E-03 | 25.7 | LYM178 | 12164.2 | M | 0.732 | 4.37E-03 | 46.3 |
| CONTROL | — | K | 0.489 | — | 0 | LYM129 | 12572.2 | M | 0.7 | 5.37E-03 | 39.9 |
| LYM82 | 12203.2 | L | 7.098 | 1.50E-05 | 35.2 | LYM134 | 12314.2 | M | 0.746 | 5.84E-03 | 48.9 |
| LYM86 | 12182.3 | L | 6.996 | 2.30E-05 | 33.3 | LYM1 | 11603.2 | M | 0.78 | 9.55E-03 | 55.8 |
| LYM268 | 12483.4 | L | 7.232 | 2.69E-04 | 37.8 | CONTROL | — | M | 0.501 | — | 0 |
| LYM5 | 12435.1 | L | 6.758 | 3.03E-04 | 28.7 | LYM1 | 11602.6 | N | 0.098 | 0.00E+00 | 96 |
| LYM82 | 12203.5 | L | 7.346 | 4.61E-04 | 39.9 | LYM178 | 12164.3 | N | 0.094 | 0.00E+00 | 87 |
| LYM86 | 12183.3 | L | 6.532 | 8.44E-04 | 24.4 | LYM268 | 12483.4 | N | 0.092 | 0.00E+00 | 83.5 |
| LYM5 | 12432.1 | L | 6.265 | 1.21E-03 | 19.3 | LYM5 | 12432.1 | N | 0.083 | 1.00E-06 | 65.1 |
| LYM5 | 12436.1 | L | 6.713 | 1.40E-03 | 27.9 | LYM5 | 12435.1 | N | 0.083 | 6.00E-06 | 65.5 |
| LYM44 | 11884.3 | L | 6.768 | 1.41E-03 | 28.9 | LYM129 | 12573.5 | N | 0.08 | 7.00E-06 | 60.5 |
| LYM268 | 12484.2 | L | 6.748 | 3.26E-03 | 28.5 | LYM1 | 11603.2 | N | 0.082 | 1.10E-05 | 64.2 |
| LYM44 | 11885.4 | L | 6.724 | 3.68E-03 | 28.1 | LYM129 | 12571.3 | N | 0.076 | 2.30E-05 | 52.5 |
| LYM8 | 11983.1 | L | 6.614 | 5.58E-03 | 26 | LYM178 | 12164.2 | N | 0.078 | 3.10E-05 | 55.3 |

TABLE 38-continued

Results obtained in a T2 experiment at the tissue culture assay low nitrogen

| Gene name | Event | ID | Mean | P value | % incr. vs. cont | Gene name | Event | ID | Mean | P value | % incr. vs. cont |
|---|---|---|---|---|---|---|---|---|---|---|---|
| LYM5 | 12436.2 | L | 6.52 | 6.08E−03 | 24.2 | LYM132 | 12275.3 | N | 0.073 | 7.30E−05 | 45.8 |
| LYM86 | 12181.3 | L | 6.239 | 6.93E−03 | 18.8 | LYM132 | 12273.2 | N | 0.071 | 8.20E−05 | 41.5 |
| LYM8 | 11984.1 | L | 6.951 | 8.05E−03 | 32.4 | LYM132 | 12276.1 | N | 0.076 | 1.27E−04 | 52.1 |
| CONTROL | — | L | 5.25 | — | 0 | LYM1 | 11604.4 | N | 0.071 | 1.52E−04 | 41 |
| LYM82 | 12203.2 | M | 0.836 | 8.30E−05 | 110.7 | LYM5 | 12432.2 | N | 0.077 | 1.63E−04 | 53.8 |
| LYM129 | 12572.2 | M | 0.675 | 4.28E−04 | 69.9 | LYM268 | 12482.1 | N | 0.082 | 1.98E−04 | 63 |
| LYM268 | 12482.1 | M | 0.63 | 6.12E−04 | 58.6 | LYM129 | 12572.2 | N | 0.072 | 2.38E−04 | 44.1 |
| LYM82 | 12203.5 | M | 0.836 | 9.33E−04 | 110.6 | LYM134 | 12313.2 | N | 0.084 | 2.41E−04 | 67.5 |
| LYM86 | 12183.3 | M | 0.684 | 1.14E−03 | 72.2 | LYM134 | 12314.2 | N | 0.073 | 6.27E−04 | 45.5 |
| LYM82 | 12204.6 | M | 0.491 | 1.31E−03 | 23.6 | LYM268 | 12483.2 | N | 0.077 | 1.02E−03 | 52.9 |
| LYM82 | 12201.2 | M | 0.787 | 1.98E−03 | 98.1 | LYM1 | 11602.1 | N | 0.068 | 1.34E−03 | 36.8 |
| LYM268 | 12483.4 | M | 0.825 | 2.72E−03 | 107.9 | LYM132 | 12271.4 | N | 0.075 | 2.22E−03 | 49.5 |
| LYM5 | 12436.1 | M | 0.776 | 3.22E−03 | 95.3 | LYM178 | 12163.3 | N | 0.064 | 7.09E−03 | 26.9 |
| LYM268 | 12484.2 | M | 0.743 | 4.16E−03 | 87.2 | LYM1 | 11601.1 | N | 0.067 | 8.58E−03 | 34.4 |
| LYM8 | 11984.1 | M | 0.716 | 4.66E−03 | 80.3 | CONTROL | — | N | 0.05 | — | 0 |
| LYM8 | 11982.7 | M | 0.565 | 8.97E−03 | 42.3 | | | | | | |
| LYM5 | 12435.1 | M | 0.674 | 9.05E−03 | 69.7 | | | | | | |
| LYM86 | 12182.3 | M | 0.719 | 9.47E−03 | 81.2 | | | | | | |
| LYM268 | 12481.1 | M | 0.627 | 9.53E−03 | 58 | | | | | | |
| CONTROL | — | M | 0.397 | — | 0 | | | | | | |
| LYM268 | 12483.4 | N | 0.085 | 0.00E+00 | 112.8 | | | | | | |
| LYM82 | 12203.2 | N | 0.088 | 0.00E+00 | 119.9 | | | | | | |
| LYM82 | 12203.5 | N | 0.087 | 0.00E+00 | 116.8 | | | | | | |
| LYM5 | 12436.1 | N | 0.078 | 1.00E−06 | 95.5 | | | | | | |
| LYM82 | 12201.2 | N | 0.074 | 2.00E−06 | 85 | | | | | | |
| LYM8 | 11984.1 | N | 0.075 | 3.00E−06 | 87 | | | | | | |
| LYM86 | 12183.3 | N | 0.072 | 3.00E−06 | 80.7 | | | | | | |
| LYM129 | 12573.1 | N | 0.073 | 1.00E−05 | 82.5 | | | | | | |
| LYM268 | 12484.2 | N | 0.073 | 1.20E−05 | 82.9 | | | | | | |
| LYM86 | 12182.3 | N | 0.074 | 2.00E−05 | 85.7 | | | | | | |
| LYM5 | 12435.1 | N | 0.072 | 2.60E−05 | 80.5 | | | | | | |
| LYM268 | 12482.1 | N | 0.066 | 6.90E−05 | 63.7 | | | | | | |
| LYM129 | 12572.2 | N | 0.068 | 8.00E−05 | 71.2 | | | | | | |
| LYM268 | 12481.3 | N | 0.066 | 8.40E−05 | 64 | | | | | | |
| LYM44 | 11884.3 | N | 0.067 | 9.10E−05 | 68 | | | | | | |
| LYM268 | 12481.1 | N | 0.062 | 4.98E−04 | 54.5 | | | | | | |
| LYM44 | 11885.4 | N | 0.068 | 5.74E−04 | 70.9 | | | | | | |
| LYM5 | 12436.2 | N | 0.062 | 9.56E−04 | 55.4 | | | | | | |
| LYM8 | 11982.7 | N | 0.059 | 1.14E−03 | 47 | | | | | | |
| LYM44 | 11884.1 | N | 0.057 | 2.22E−03 | 42 | | | | | | |
| LYM8 | 11982.4 | N | 0.057 | 2.75E−03 | 42.3 | | | | | | |
| LYM82 | 12201.1 | N | 0.056 | 5.28E−03 | 39 | | | | | | |
| LYM86 | 12183.1 | N | 0.056 | 7.02E−03 | 40.5 | | | | | | |
| LYM44 | 11885.3 | N | 0.059 | 7.80E−03 | 46.7 | | | | | | |
| LYM44 | 11882.1 | N | 0.056 | 8.64E−03 | 40.3 | | | | | | |
| CONTROL | — | N | 0.04 | — | 0 | | | | | | |
| LYM136 | 13423.2 | H | 0.006 | 2.00E−06 | 107.3 | LYM136 | 13423.2 | N | 0.085 | 0.00E+00 | 82.6 |
| LYM136 | 13421.8 | G | 0.005 | 8.66E−04 | 75.6 | LYM136 | 13421.8 | N | 0.082 | 0.00E+00 | 75.9 |
| LYM84 | 13404.4 | G | 0.007 | 2.84E−03 | 113.8 | LYM84 | 13404.4 | N | 0.092 | 0.00E+00 | 96.7 |
| LYM136 | 13421.6 | G | 0.006 | 2.89E−03 | 94.3 | LYM84 | 13401.2 | N | 0.088 | 0.00E+00 | 88 |
| LYM1 | 11601.1 | G | 0.005 | 5.24E−03 | 61 | LYM1 | 11601.1 | N | 0.081 | 1.00E−06 | 73.2 |
| LYM84 | 13403.3 | G | 0.006 | 5.30E−03 | 87.8 | LYM84 | 13403.3 | N | 0.08 | 2.00E−06 | 70.6 |
| LYM84 | 13401.2 | G | 0.007 | 5.52E−03 | 130.9 | LYM84 | 13403.2 | N | 0.073 | 2.00E−06 | 55.9 |
| LYM1 | 11603.2 | G | 0.004 | 9.31E−03 | 42.3 | LYM136 | 13423.1 | N | 0.085 | 3.00E−06 | 81.3 |
| LYM84 | 13403.2 | G | 0.005 | 1.53E−02 | 58.5 | LYM1 | 11602.6 | N | 0.07 | 1.40E−05 | 49.8 |
| LYM1 | 11602.6 | G | 0.005 | 2.06E−02 | 50.4 | LYM136 | 13421.6 | N | 0.075 | 2.50E−05 | 60.5 |
| LYM136 | 13423.1 | G | 0.007 | 3.33E−02 | 123.6 | LYM84 | 13403.1 | N | 0.07 | 7.20E−05 | 50.5 |
| LYM136 | 13421.5 | G | 0.005 | 5.81E−02 | 72.4 | LYM136 | 13421.5 | N | 0.074 | 1.10E−04 | 57.9 |
| CONTROL | — | G | 0.003 | — | 0 | LYM1 | 11603.2 | N | 0.071 | 1.87E−04 | 51.2 |
| LYM1 | 11601.1 | H | 0.103 | 1.93E−04 | 78.3 | LYM1 | 11604.4 | N | 0.058 | 2.56E−02 | 23.7 |
| LYM84 | 13403.3 | H | 0.11 | 1.55E−03 | 91.3 | LYM1 | 11602.1 | N | 0.056 | 7.26E−02 | 19.1 |
| LYM84 | 13403.2 | H | 0.113 | 1.81E−03 | 95.7 | CONTROL | — | N | 0.047 | — | 0 |
| LYM136 | 13423.2 | H | 0.13 | 4.05E−03 | 126.1 | LYM136 | 13421.8 | I | 1.163 | 9.90E−05 | 51.6 |
| LYM1 | 11603.2 | H | 0.093 | 4.55E−03 | 60.9 | LYM136 | 13423.1 | I | 1.209 | 8.12E−04 | 57.6 |
| LYM84 | 13404.4 | H | 0.13 | 6.79E−03 | 126.1 | LYM1 | 11603.2 | I | 0.993 | 1.65E−03 | 29.4 |
| LYM1 | 11602.6 | H | 0.103 | 7.66E−03 | 78.3 | LYM84 | 13404.4 | I | 1.095 | 2.56E−03 | 42.7 |
| LYM136 | 13423.1 | H | 0.148 | 9.13E−03 | 156.5 | LYM84 | 13403.2 | I | 1.009 | 3.97E−03 | 31.5 |
| LYM136 | 13421.8 | H | 0.128 | 1.35E−02 | 121.7 | LYM84 | 13403.1 | I | 0.997 | 4.57E−03 | 30 |
| LYM84 | 13401.2 | H | 0.133 | 1.58E−02 | 130.4 | LYM136 | 13423.2 | I | 1.104 | 4.86E−03 | 43.9 |
| LYM136 | 13421.5 | H | 0.105 | 2.31E−02 | 82.6 | LYM84 | 13403.3 | I | 1.035 | 8.51E−03 | 34.9 |
| LYM136 | 13421.6 | H | 0.11 | 2.99E−02 | 91.3 | LYM84 | 13401.2 | I | 1.049 | 2.01E−02 | 36.8 |
| LYM84 | 13403.1 | H | 0.095 | 9.17E−02 | 65.2 | LYM136 | 13421.6 | I | 0.996 | 2.96E−02 | 29.8 |
| CONTROL | — | H | 0.058 | — | 0 | LYM1 | 11601.1 | I | 0.899 | 6.99E−02 | 17.1 |
| LYM136 | 13421.8 | M | 0.805 | 0.00E+00 | 84 | LYM1 | 11604.4 | I | 0.884 | 9.29E−02 | 15.3 |
| LYM84 | 13403.2 | M | 0.683 | 0.00E+00 | 56 | CONTROL | — | I | 0.767 | — | 0 |

TABLE 38-continued

Results obtained in a T2 experiment at the tissue culture assay low nitrogen

| Gene name | Event | ID | Mean | P value | % incr. vs. cont | Gene name | Event | ID | Mean | P value | % incr. vs. cont |
|---|---|---|---|---|---|---|---|---|---|---|---|
| LYM1 | 11602.6 | M | 0.713 | 1.50E−04 | 62.9 | LYM1 | 11603.2 | J | 8.538 | 1.59E−03 | 30 |
| LYM84 | 13404.4 | M | 0.893 | 6.76E−04 | 104 | LYM84 | 13403.1 | J | 8.743 | 1.76E−02 | 33.1 |
| LYM1 | 11601.1 | M | 0.84 | 7.01E−04 | 92 | LYM136 | 13421.8 | J | 10.115 | 2.04E−02 | 54 |
| LYM136 | 13423.2 | M | 0.835 | 7.48E−04 | 90.9 | LYM84 | 13403.2 | J | 8.468 | 3.82E−02 | 28.9 |
| LYM84 | 13403.1 | M | 0.675 | 1.60E−03 | 54.3 | LYM84 | 13404.4 | J | 9.658 | 5.32E−02 | 47 |
| LYM84 | 13403.3 | M | 0.79 | 2.37E−03 | 80.6 | LYM1 | 11604.4 | J | 7.745 | 5.47E−02 | 17.9 |
| LYM84 | 13401.2 | M | 0.86 | 2.92E−03 | 96.6 | LYM136 | 13423.1 | J | 10.398 | 6.40E−02 | 58.3 |
| LYM136 | 13423.1 | M | 0.84 | 4.59E−03 | 92 | LYM1 | 11601.1 | J | 7.858 | 6.86E−02 | 19.6 |
| LYM1 | 11603.2 | M | 0.693 | 8.94E−03 | 58.3 | CONTROL | — | J | 6.568 | — | 0 |
| LYM136 | 13421.6 | M | 0.738 | 9.38E−03 | 68.6 | LYM136 | 13421.8 | L | 7.173 | 1.89E−03 | 21.6 |
| LYM1 | 11604.4 | M | 0.54 | 1.15E−02 | 23.4 | LYM84 | 13404.4 | L | 7.105 | 3.22E−03 | 20.4 |
| LYM136 | 13421.5 | M | 0.685 | 1.62E−02 | 56.6 | LYM84 | 13403.1 | L | 6.823 | 8.12E−03 | 15.7 |
| LYM1 | 11602.1 | M | 0.538 | 5.30E−02 | 22.9 | LYM1 | 11603.2 | L | 6.868 | 9.56E−03 | 16.4 |
| CONTROL | — | M | 0.438 | — | 0 | LYM1 | 11601.1 | L | 6.538 | 2.95E−02 | 10.8 |
|  |  |  |  |  |  | LYM136 | 13423.2 | L | 6.88 | 3.42E−02 | 16.6 |
|  |  |  |  |  |  | LYM84 | 13403.2 | L | 6.445 | 7.62E−02 | 9.3 |
|  |  |  |  |  |  | CONTROL | — | L | 5.899 | — | 0 |

Table 38. Results of the tissue culture T2 experiments. Provided are the measured values of each tested parameter [parameters (ID.) G-L according to the parameters described in Table 37 above] in plants expressing the indicated polynucleotides. "Ev" = event; "P" = P-value; "Mean" = the average of measured parameter across events. % incr. vs. cont. = percentage of increase versus control (as compared to control).

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (4204 sequences)

SEQ ID NO: 1 - DNA, 1003 bp, Oryza sativa
atcaaactcatcaagtcaacaacaactttttgcaaccctagctagcttgcatacttagttagctatactatactactcttcttcttcttcttctcttcttcttcattggatcaagcaaggagagagtaattaattaagtaggcaatcatgtgtgagggcgagaagaagaaggactcgtcaagcggcgcgctctactgcgtcaacctcgccctccgcatcgtcgtcctcgggctcgccgtcgccgcggcggcgctcatggcgacggcgagccagtgcaccatcttcctctactacggcggccctctccacaccatcacctacaaggactttggccccttcgtgtatttggtggtggcgagctcgatcggggcgttcatggaggcgatcgccatcttcctgaccatctgcaagaagaaggacggcacgccggcgaaggtgctcctgccgctgctggacgccgccgtgccggtgctgctctactcggcgacggccgccgcgttcgccgccggcgacatgtcgtactgcgccgtggggaagcgcgtcggcgtctgcaccaccgccgccgccggcaacttctgcaaccaggtgcacattgccatgtacgtctccctcgccgccggcgtcgccctgctcgtcgccgagatcgtcaagcactggccggactccgggaagaagaaggaaggcggcggcggcggatgcgggtcggactccgactccgacaagtcaaccccttgccaccatggctgccatagcaagcattagtcgagctctctagctagggtacatttaattctataatcgagaaatttatacgagatttttagataaattaatcgtcgcttgattaattttccatatattctcaaacaaaagaaaaccaaaaaaaaaaaaacaagccatgcatgcatgcatttctcatgagaggccagtaatataatcaagtggcctagctatatttgtatcatggaaaacttgttgtaattaattaatgtttgtgtgtgtc

SEQ ID NO: 2 - DNA, 2200 bp, Oryza sativa
accccccgcgcgcgagtatatctcaaagtcctcaacccgtcccttctctctctctcgtcttcacatcgctcatctccgcctcctccgagctcactgacaggtgggccccctccctcctccgagtcctcgccgtcgccgccgttgcctgctccgacctgacggacggagaggcggctggggctcgatcggacgccgccgccacgggaggccggaggaggggaggcacggcgaccggcgaccggccacgggtgggtgggtgcatgtcgacggccgccgcgtcagccgcgcgcggtaggtagatgaaattaaggaacacagcaataacacgagctaactcagcctgtcttccaatggaggattgtgttggtatcaagtacagcagtgtcaatgagggcgaagagcgtaagggaggccatggcgtcccaaaggtttccatcatcccactcattttcctcatattctatgaagtttctgggggtccgtttgggattgaggatagtgtcaaggctgctggcccactcctagcaattgctggatttctgctgtttgcactcatatggagtgtcccggaagccctgattactgcagagatgggcactatgtttcctgagaatggtggttacgtcgtctgggtctcttcagcccttgggccattctggggttttcagcaaggctgggcaaagtggctgagtggtgtcatagataatgctctctatccagtcctcttcctcgactatgttaagtccagcattccagctcttggaggtggtctcccaaggaccttggcggtgcttatcctcacagttgcacttacttacatgaactacagagggttgacaatagttggctgggtggcagtctttcttggcgtgttctctctactcccgttttttgttatgggattaatagctattccccgaatcgaaccctcaagatggcttgaaatggacttggggaatgtgaattggggtttatatctaaacacactgttttggaacctcaattattgggactcaatcagtacccttgctggagaggttgagaatccaaagagaacactcccaagggcactttcttatgctctagttttagtggtggggggatacctctaccctctgatcacctgtacagcagcagttccagttgttcgggagttctggacggatggatatttctcagacgttgcgagaattcttggtggtttctggttgcactcgtggcttcaagcagctgctgcactgtccaacatgggcaatttcgtaactgaaatgagcagtgattcttaccagcttctcgggatggctgagcgtggaatgcttccagagtttttcgccaagagatctcgctatggaaccccacttattggcatcatgttctccgcgtttggtgtggtcctgctgtcctggatgagcttccaggagatcatcgctgcggagaactacctgtactgcttcggtatgatcctggaattcatcgccttcatcaagctgagggtggtccacccaaacgcctcccgaccttacaagatcccactgggcaccatcggcgctgtcctgatgatcatcccacctaccattctgatcgtcgtggtgatgatgctcgcgtccttcaaggtgatggtggtcagcatcatggcaatgctggttgggttcgtgctgcagccggctctggtgtacgtggagaagagacggtggctgaagttctccataagcgcagaactgccagatttgccgtactcgaacgttgaggaagacagcacaatcccacttgtgtgctgacctgcatatgcatgccatgaaagtagaatccccaaccatagccatgctagacggaaggaacactgcgatttgcgacttgtttcgtctcacggcttttcaaagcctcttcatctgccatgtataattagaagagaagcaagttcaaaattgtgatcatgctatttgtataccatgttggcgtcagggaggattgtaaatcccagggccagtttgaggaaaatacttcacttggctattgccaatagcacctggttattcgttcattatatatgtgctgctgctcttgttagagagattctgaggacaagcacctggttttatgttttgctatcgatatatgcaggttctagaaaataacattgtacaataagatatgtcatcgctatcgaggttcagtcaattccattccgctatcccaacca

SEQ ID NO: 3 - DNA, 2133 bp, Oryza sativa
ttccttccacactgcccaatttccatctccatttccttcatcagaggttgttctgctcagtcagaggcatcctttgccaaaaacatttatctgcttcaatggcaacttcttggtctgttgctttcactatcttcttctcctgtattctcctgcttgaaaccatctcttcttcagcatctcttgattgctcatatggttcagctcaagtgaagatactgtccagctcggtggtcagtgagcagcaaaatgtgtacctcttcttgaagccgtttcagagcacgagatcatgcagcgcgaggcggctcgccggcgaattcgtcaatggcgtcgtcgtgcccaacctgcggctcaacgtcaccggcgtcgtggtcacggccaacgagcggcagctcggcgcgctgcgctgcacgctggagtcggttcaggcggagctcgccgtcgccggattgggtcggagcgtcaaggtctcgccggagctctcgctgccttctctgcgagccatggcgaagtgccgccgccgcggcgagaagcattggcgcagagtcatggagttcgtgaggaggtcaggctcgtttgtcgtggtggagatgggtgcagaagagaaggcagacctcgccgtcgccgatgtcgccgccgcgttcgaggagggcgtcggcgtggcgttccgtatcagcggccgcgcggctcggagcgcggcggaaatggcgaggctgatcggcgatgcggataaggggaggaggtggacgggtgttcttgcggaggttgcgtctccctctccccggcgggagctcgccgcggcggcaaggacgacggcgcgcgacgtgttcgcgccggtgactaacccgacgacgacgccggcgacgaacccggtgacggtgcccgcgacgaacccggcgatgaacccggtgacgccgggcatcgtcaccgtgccgtcgaccaacccggccacgggatactccaacaaccccaacctcccgccgctgtacccggagccgacgccggtgacgatgcccgacccgacgacgacgacgacgccgacgccattcatgaacccggtcaccgcgccgaccatgccatccccggtgaccaaccccgccacgacgccggccgtcacaaacccaacgacgatgccttacccgtacccgccgcagcaaggcggcgtcatgccgacgactccgacttaccagccgccggcgacgatgccggcggcgggcgggcagacgtggtgcgtggcgaaggcggggctgatggacgcggcgctgcagagcgggctggactacgcgtgcggcatgggcggggccgactgcacggcgatccagcccatgggggcctgctacaacccaaacaccctgcaggcccacgcctcctacgccttcaactcctacttccagaggaacccctcgccggcgagctgcgacttcggcggcgccggcatgctcgtcaacatcaacccaagttcaggaacttgcttgtttcaggcatcatcagcaggctacggcgcgggatacagcccgggggtgacggggacagtgccggtgggcggcggcgcgggcgccggcgccggggtcggcgtcggcgtgacgccgatgggaccggcggtgggcggcaccggaggcgccggagtgacgccgatgggaccggcggtgggcggcggatcggggtcgacggtgctcaacgccaacagccccggcgggaactcgatgtacggctccgacagtaacccgacgagcctcaccggcgccgccgccgccgcgctgtcatccggctgggtcctgtgccttgtctggatattcacctttgcatatgtcaaggagaaagtgtaggccttcttcttgctgctgctgctgctactgatgatgaacaacttgttctacttgattcagctgtgtacagatgcatactagatgatttgagtgaattttcataggggagaagaaggatagatgttttgtgagtctgtctgtaatctgtatatgactgtttatgagctgggtaggcagaatgatgcttaggcatcttagccatcatatatgttgtaggtgagcatagagatccttctctatggagacatgcttcttgttgtagtgcttgatatgatatcagttgatactattcttgttcttgggcagcttt

SEQ ID NO: 4 - DNA, 1870 bp, Oryza sativa
attcctcgaccagctcacgcaaaaaccccccgaaacctcgaaaccctagatcgccatatggcctcctccgccgccgccgccttctaccgcgacagggaggacgcggcgccgccgtcgtccggccccgggggaggcggcgccatggcggcgtacgacccgagctacgtgccggactcggtgaagacgttcgtgtcgcacctctaccgccacatccgcgaccgcaacgtgtacgagacgcaccagatgtacgagggcgggttcacccgcctctccgaccgccacttccgcgacacgccgtggccgccggcggaggccgtggcggcgcactgcgacggcgaccacgtcttcctcctcctctaccgggagctctggttccgccacgcccacgcccgcgtccagggcctcaccccggcgcagcgcgccgagtcgtgggacaactactgctccctcttcagcgtcgtcctccagggcgtcgtcaacatgcagctccccaaccagtggctctgggacatggtcgacgagttcgtctaccagttccagagcttctgccagtaccgcgccaagctcaagaacaagacccacgaggagatcgccctcctcaagcagtacgaccaggcatggagtgtttatggggttcttaattacttgaaagcactggtggagaagtcaatgattggagagatcctggagagggagaaggtagggcttgaacagttcacggcaactgatgggtatgactatgagggcgggagcaatgtgttgaagatgctggggtactacagcatgattgggctgctcagggtgcattgccttcttggggattaccatactgggctcaagtgcttggctccaatagatataagccagcagggtgtctacaccactgtgattggaagccacatttccactatttatcactatgggtttgccagcctcatgatgcgcaggtatattgatggtatacgtgaattcaacaaaattctgttgtatatcctgaagtgtaagcaataccaccagaattccccccagtatgaccagctacttaagaagaatgagcagatgtatgcactattggcgatctgcctctcattgtgtccacaggacaagctcatagatgaaaacgttggcactcagctgaaggaaaagtatggggacaaaatgacaaagatgcataggtatgatgatgaggcatatgctatttatgatgaactcttttcctatgcctgccccaagttcattactgcgtcgcctccagttctacgagagccatacacaaactacaaccaggatgcttatcgtcttcagttgaaactatttctttatgaagtgaaacaacaacagttgctctctggtattcgaagctatctcaagttgtattcaacgataacaattggtaaacttgccaaatacatggatgtggatgaggttacactaaggacaattcttatgacatacaagcacaaaatgcattcaatcgacagtgacggaaaggtcatatccagtgcagactttgacttctatattgatgaggacattattcatgttgttgaatccaagttaaccaagaaccatggtgattactttttgagacagattttgaagtttgaggagatgattacgcagctggataaagtacaatttgactgaacctgctatcatcagggctgaagctctcctttgagttacagtgggacgcgctgttggtgatggatagtaatgataaatttttgtgccatccttttttgatacattgttgacatgagttaaatcctcgctaaaaagtactctaggtgctaactatcgcatccacttgtcatggcatgttctggtttgaagaatgccaactttaaattgttcttgtcttatcgtc

SEQ ID NO: 5 - DNA, 1329 bp, Oryza sativa
cgaggaagaaagggaaagagggaagagaagagaagagagggagccaaagaaagctctcatcttcctcttctcaaactccatctctctctcttcttcttcttcctctcctcctcctcctcgcttggaccccggattttttgcaagggggtaaggaggcgggaggagatggggagggaggagaggttcccggtgtgggaggcggcgctcggcgccggggtcgccgccgccttcgccaccgggctcgtcggagtctacctctccatgccggactccgactacagcttcctcaagttgccgcgcaacctcgaggagctccaaatcctcactggacatcttgagaactataccagtgattacaccatacaagtgttggtgggttactgttctgtgtacatcttcatgcagaccttcatgatcccaggaacaatattcatgtcattgcttgccggttctctgtttgggcaactccggggtgtggccctcgtggtatttgcagcctctgctggtgcttcttcgtgctttttcctgtcgaagctgattggaaagccattggtgttctcactgtggccagataagctcatgttcttccagaagcaggttgccaaaagaagagaaaagctgttgaattacatgctttttctcagggtcaccccaacattgccaaacaccttcattaacttagcttcacccatagtagatgtgccctaccatatattcttactggcaactctcatcggtctcatcccagcttcctatgttactgtcagggctgggattgctctaggagagttaacatcattgagtgacctgtatgatacccaatcgatagcgctgctgttcttgatcgggattgtttcggtcacaccaacattgttgggcaaggacgaagcgcaagaaaaaacaacggaaattgcagttaccgcgtcatgatcaccgaagcgccgatccgcatgccctcacctgtacatatgaagctccagcatgcagggttgcttcagaagtagtaggagcatcaaaggcctgacaacaccatggtttgcaaagactacacagcatgacaggacctccaaccccaagtgcttccctgacccctctccattactggaagcctgcttgggttgccatcgaaacatttacgaagtgaagtgtttagccacccaaattatggagtctggggaggcacaatgcccatcaggcaaagctgctttgatgtgtaagcattaagccaagtagtgttgtttagatgggacaagcaaactgatctgatccctgtatatattgatcagattcattcaatccatattcagtggttcaatcacaacctgtctc

SEQ ID NO: 6 - DNA, 3313 bp, Oryza sativa
ggagtccgcgatggctgcttgcctcaccgagtgaacgcacgcgctcgccggcggcgaccaagaaaccacgcgaagacatggcattcccgagcggcaaagcctactacctccacctcctcctgctcgcgatcctgccaagcctcgtcgcgcggcgcggcgcggcgcagcagggcggcgtcgacgagaagcagctcctgctccaggtcaagcgcgcgtggggggaccccgcggcgctcgcgtcgtggacggacgcggcgccgcactgccgctgggtgtacgtgtcctgcgacggcggcggcaccggccgcgtcacgtcgctgtccctccccaacgtcgcggtcgccggcgccgtccccgacgccatcggcgggctgacggcgctcacggtgctcaacctccagaacaccagcgtcggcggcgtgttcccggcgttcctctacaacctcaccgcgatcacctccatcgacctctcgatgaacagtatcggcggcgagctccccgccgacattgaccggctcggcaagaacctgacctacctcgccttgaacaacaacaacttcaccggcgtgataccggcggcggtgtcgaagctcaagaacctgaaggtgtttaccctcaactgcaaccagctcaccggcacgatcccggcggcgctcggcgagctcactagcctcgagacgctcaagctcgaggtgaatcagttcacccccggcgagctgccgggatcgttcaagaacttgacgagcctgaagacggtctggctggcgcagtgcaacctcaccggcgatttccccagctacgtcacagagatgatggagatggagtatctcgacctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctcctcgccgccggcgcggccctcgtcgtcttgatcggggcgctcgccttcttcgtcgtccgcgacatcaagaggcggaagcggctcgcgcggacagagccggcatggaagatgaccccattccagcccctcgacttcagcgaggcctcccttgtgcgcgggctcgccgacgagaacctcatcggcaagggcggcgcggggcgcgtgtaccgcgtcgcgtacgccagccggagcagcggcggcgccggcggcaccgtcgccgtgaagcgcatatggaccggcggcaagctggacaagaacctggagcgcgagttcgattcggaggtggacatcctcggccatgtccgccacaccaacatcgtgaagctcctctgctgcctctcccgcgcggagacgaagctcctcgtgtacgagtacatggagaacggcagcctcgacaagtggctccacgggaacaaattgctggccggtggcgcgacggcgagggcgccgtcggtccggcgagcgccgctggactggctggcgagggtcagggtggccgtcggcgcggcgaggggcctctgctacatgcaccacgagtgctcgccgccgatcgtgcaccgggacatcaagtccagcaacatcctgctcgacgctgagctcatggccaaggtcgccgacttcgggctcgcccggatgctggtccaggccgggacgccggacaccatgaccgccgtcgccggatcgttcggctacatggctcccgagtgcgcgtacacgaggaaggtgaacgagaaggtcgacgtgtacagcttcggggtggtgctcctcgagctgatcaccggcagggaagcccacgacggcggcgagcacggctcgctggcggagtgggcgtggcggcacctgcaatcgggcaggagcatcgccgacgcggtggacaggtgcatcaccgactccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatccaatggttaccatctaggagagatggcacgctagttaggagagcaggtagataccagacaaatacattcgccatccttcagttatttgcatgtaatgagtattgtaactttgtaaatgcatctataaaattttgggacagtgagagtgcagtcacatac

SEQ ID NO: 7 - DNA, 502 bp, Oryza sativa
aaatttccactcgcaaaagtcgcaactcgcaaccctaatcatccaattcccacacggactctgctaccatcggagtcagatccattcctcctcccattctcgatcgcgaggaggaggagaccccgcccgccagccaccccggatccgtcgatcgccatggcggatgaagaacctgttgatccaaagaagtaccttgaggagcgctgcaagccccagtgcgtaaagccactctatgagtatgagaagtgcgtcaagagagtggagaaggatgatactgggcataaacactgcactgggcaatatttcgactattggtcatgcattgacaaatgtgtagcaccgaaactccttgagaagctcaaatgatgaccggctgctacttttggatcagtgacttgttctatttgcgtaaccttgttcgcacttgaaactgaatgagttaattgtgtctattgtgactgtttgggtttcatgacttgtaataaaagccaccatttcccat

SEQ ID NO: 8 - DNA, 4067 bp, Oryza sativa
gtactttccccgcaaccccaaacaacaaggaaggaagacgctcctcccctcccatctcttaaaccccaaaaaaaccaaaataaaaatcctcctcctcctccgcctccgcttcccttcccttccccgatagaaatccatccctcccgccgccgccgccgccgccgctcctagggttccggcacctccccgaatccccccctcacttcgacccctgttcgcttcacccgccgccgccatggcggagaagctgagggatctgagccagcccatagacgtcccgctgctggacgccactgtcgccgccttctacggcaccggatctaaggaagagaggaatgccgctgatcagatactacgggatctacagaataatccagatatgtggctgcaggtggtccacattctgcagaattctcacaacttgaacaccaagttctttgccctccaagtacttgaaagtgttataaagtataggtggaatgcattgccaactgaacaacgtgatggcatcaagaattacatatctgatgttattgtccagctctccagtaatgaggcttcttttcggcaagagagactttatgttaataaactcaacattatactggtgcaggttctgaagcatgagtggccagctaggtggtcatctttcgttcctgaccttgttgctgctgcaaagagtagtgaaaccatatgcgaaaattgcatggctatattgaagcttttaagcgaagaaatttttgatttttcaagaggtgaaatgacacaacagaagattaaagaactgaagtcatcacttaacagtgaatttcgtcttattcatgagctatgtttatatgtcctatctgcaacacaaagacctgagctcatccgtgctacactggctacacttcatgctttcttatcatggataccagtgggcttcatatttgagtcacctttgctggagacattactgaagttctttcctatggctgcttatcggaaccttacactccagtgccttacagaggtcgctgctcttcagtttggtgatttttataatgtgcagtatgtgaagatgtatacgattttcatgatgcagttgcaggctattcttcctcctggaacaattcctgatgcttatgctaatggctccagtgaagaacaggcattcatacaaaatctagctctttttttcacttctttcttcaagaatcacatgcgcatattggaggcatctccagaaaatagagctgcattacttctgggccttgagtacctcattggaatttcatatgttgatgacacagaggtttttaaggtgtgtttggattactggaatgtgtttgttttagagctatttgaagcacacaatcaaatggagcctgcagcatctgtaaacatgatgggacttcaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataagattatgagggaaacactgatctacttgtctcatcttgatcatgaggatacagagcagcaaatgctgaagaaattgagtaagcaattaaatggagaagactggagttggaataacctcaatactctctgctgggcaatcggatcaatatctggttctatggtggaggaacaggaaaataggttcttggtaatggttattcgcgatttattaaatctctgtgaaatcacaaaggggaaggataataaagctgtgattgccagtaacatcatgtatgttgttggtcagtacccaagatttctcagggctcattggaagttcttgaaaacggtggttaacaaactatttgagttcatgcatgagatgcatcctggagttcaggatatggcgtgtgatacttttctgaaaattgttcagaaatgcaagcgcaaatttgtcacacaacaggtgggcgagaacgaaccatttgtttctgaactgttgtccagccttgccacgacaattggtgatcttgagccgcaccagattcatacgttttatgaatcggttggccacatgattcaagctgaatctgataacactaagagagatgaatacctcaaaagactgatgagcctccctaatcagaaatgggccgagataattggacaggcaagccaaagcattgatatcctgaagaaccaggatgttattagatctgttcttaacatcctgcagacaaacacaagtgttgctagctcacttggaccacactttttcccgcaaatttccctaatctttcttgacatgttgacagtttacagaatgtacagtgagcttgtatcaagcaccattgctgaagggggaccttttgcctcaaggacctcctttgtaaaactccttagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaaatacaaaggtgaaatgcttgaagacgtgcctcgcatatttgaggctgttttccagtgcactcttgagatgatcactaaaaactttgaagattacccggagcatcgcctcaaatttttctctttgcttcgtgcgattggcacccattgcttccaagcattaattcagctttcaagtcagcaattgaaacttgtgattgactctatcaactgggcatttagacatacagagagaaacatcgcagagactggtctcagtctattgctggaaattttaaagaactttcaggcctcaggattccaaaatcaattctacaaaacttattttttgaatattgaacaagagatctttgcagttctgacagacacattccacaagcctggtttcaagcttcatgttttggtgctgcagcacttattttgtgtggttgatggtctgacggagcctctctgggatgcatcctcagtaccataccaatatactgacaacgctatgtttgtccgagattacacaataaaacttttaggttcatcatttcccaacatgacacctactgaggttacaaaatttgttgatgggcttcttagttcaaaacatgaccttccaagcttcaaaaaccatattagggatttcctggtgcaatcaaaggagttctcggctcaggataataaggatttgtatgctgaagaggctgctgcacaaagagagagggagcgtcaacgaatgcttgccattccagggcttattgccccaagcgaattacaagatgagatggttgattcataattctgtgattcagccttgctaatccagttccatttcttgctttggcctccaaacctctggagccctcaacaccccattgcccaagttctcttccagggtggtgaaagaaggtgcctgctgtaattttattttcggttacctccacttggtgctgattgcgagatttctgctagtcaataggaaaggccaactcaattttgtcgcaagagctgttttggactgccattggtttgcagtatgagctgtcaggttaatgtgatgacagcagctcttgtgctcctgtattttgctaacattgctgcgtgtgcggggccatcatatagtatgatcacggtacaacattgtatcatgatttttagtttagtttatagatcggccgcattctgtattgtggacaagattcaggatagaaacttatattcgtagtgtactattttgtgaaatatgttctttttacattgcccgcatatgtgctgtttggtttctttttgacgctcgtgatttgtcgagtctgtatcaaagtcggatcgcccgcgtgtattacccacatgcatggagcgaatctttggcgtcactttttttttctatattaacgcaagttctgaacgaattacgattt

SEQ ID NO: 9 - DNA, 916 bp, Oryza sativa
acactcttccacctctccacgtcaccccctccttctccgcgtgcgcccatccatcccaactccccaaccaagcagcggcgagccagcgatggcgacacccactgcccaaaccgcggcgctcctcgccgccgccgccgcgctcttcctcctcgcgtcggcggccctcccggtcgtccgctccgacgccggcggcgacggcgacgtcaccgcgtacgacgagctccggcaccgcgggttcccgctgggcttgctgccggcgaacgtgcgcgggtacacgctggactccgggtcgggggacttcgccgtggacctcgcctccagctgccggatcgtgctccccgcggggagctacctcgcctccttcagcgaccgcctcacgggccggctcgacgaccgccgcatctccggcctcagcggcatccgcgtcagggccttcttccggtggtggtccatcaccgggatccgcgccgacggcgacgagctcgtcttcgaggtcggctccgtctccgccaagttccccgcccgccacttcaacgccagcctcgagtgccccgccaaagccgactcttagtacaaaggtcctggtgtctattccttgatatggcatcatgaagcggcttaggcttcaggctttcagtgttctctgtttcttcgcacctgtctgtaattattcgtgtataaggctgaaatgctgaattgttcagccagtcgccccacgcaaacaaagtggaacagaacaatgcgtactgtagctcttgtatctataccttctatatagttggtataattggtacccactagttgtgttggtagttgttacccatgtccatgtatcgtcgtttcagtccgaaagactcggggcgccgaatatatatgttgcctcagacacgaccaggtacagatcaaaaccgttttt

SEQ ID NO: 10 - DNA, 534 bp, Oryza sativa
atacgcacgccacgcgcaaacccgatctctccaaccttgcgaaggcgaagcccccgtgagatctccggccgccgccgccgccgccatggacgccgtcgactcggtggtcgacccgctgcgcgagttcgccaaggacagcgtccgcctcgtcaagcgctgccacaagcccgaccgcaaggagttcaccaaggtggcggcgaggacggcgatcgggttcgtcgtcatgggcttcgtcggcttcttcgtcaagctcatcttcatccccatcaacaacatcatcgtcggatccggctgatttgagcactaaggcaagaattcgcaggagttgagggtggcgtcaaacatcgcagagacggctccacttctccgttcctgatgatttcgtaaagcaatctctgtaggaccttgttgttgagtacaattccccatttctttcatttgaaagaaacaaaatacattttgctgcctggaacgttttgtacctgataccgagtaaactttatgaagtagtagagagtaacaaagtttacaaat

SEQ ID NO: 11 - DNA, 1359 bp, Oryza sativa
gctgtcgttgctcttatcctatcctacgtttgttgctcggttgcttctcttctttcctctctgtcttctgtcttctcttcttcttcctcaccaaagttgttgagttggtgtcctgttcttggacggacaagggtgtttatccaaaagaaatccatcccgagatttgcttctcttgcgcgcacactggcaccgtccggatcgctgaatcttgctggtggtggtggtggtggtggtggtggtggtgcacggccatgtcgacggcggtggcggacgtgccaccggcggcggcctacgggttccccggatcggccaagagagggaagcctgaggaggtggtggtgctgatggggaagaggaggaacgaagggttcttcatcgaggaggaggaggaggaggaggaggtgctgacggagagctcgtcgatcggcgcgccgtcgccggcgagctcgtcgatcggggagaactccggcgaggaggagggaggggacgacgaggaggaggtggagagcaagctcaaggcggaggatgagcaggtcggcctcggctgcttggacgccttggaggaatccttacccatcaagagggggctctccaacttctacgccggcaagtccaagtcgttcaccagcctcgccgaggcgacggcgtcgccggcggcggcggccaacgagctggccaagccggagaaccccttcaacaagcgccgccgcatcctcgccacctggtcgcggcgagcctcctgcagctccctcgccaccgccacctacctcccacctctcctcgcgcccgaccacgccgtcgccgagggcgacgagggtgaggaggaagacgacgattcagacgacgatgagcggcagcaccgtggcaagaacggcggccggcgagagtcggcggcgccgccattgccattgccgccgccgaggctcaccttgcacacccagatgggaggaatggtgaggaggaatggaacattcaggtcgccgaggtcgctctcactgtctgatcttcagaacagtggcggttcatgttagtttgctgctattagtacaaaaaaaataataatttttacagttagagcaaaaagccattgatctccttttggctggtagagttgttactgctacaactgcttactattagtaactatataattataattataattgcaatgcataaggtccaagtttgttgtgatctactatgattctagtaactctctggtttttctgagtcctgacctgattaagaagacatgtatcaactatgtatatctatgaactgacctaacttgaggctatcattaactaatgatggtttatgattagtcaattgctttgcttttgatgatctctctttcta

SEQ ID NO: 12 - DNA, 1282 bp, Oryza sativa
catccacaacacctgagctgaggccgccgccgcgtcgtcgtcgtcgtccgtacatcgccgccggatcgagccgcgccgcaagcggtaggagatgaggcccgcggtgagcagggccgccttcgcgtccgtgcttctggcgccgcgcgcggtcggggtcgccgcccgctgcgcctcctcctcctcttcggccgcctccccgtcggtcgccgccgccacttacgatcacgcgtcgtttattaaggaggtcgccgcaaccgatccaccggagcatcttagctcgttgctgaatgtgctccaggcacgaggtgaaaagctagtttctccaggggcgaaaagaggcctgattccacttgttgttcccttagcagaaagtccagcaggtaatttaacatcactactgagatggccaactgctcctagcgggatggaaatgcctgtggtggaagttcgtaatcacggcctatggcttttggctaagaatgtgaaccaatatattcacagagtgctcgttgaggctgatatcaatggttacgctgatgatttatggtctgctgtgggggacactggtaaaaaactttacacaaaaggtgatttcaaagagtcacagatggcagatcttgatgcctatttgttgaagaaggttggcctctttccagatgttatagagagaaaaacatcacgccatttcgaaaaaggagattatgtgtcagctctaattactggagaattctacactagagatcaatttcctggatttggaaggccctttgtgttcaacgcagagatattaaaaagagttgggcgtacaaccgaagccaaagattcagctcgagtggctctgaagtcaccatggtggacactgggctgcagttatgaagaggctgctgaattagctgggtgggaggatgagcagattgagtttatacgagagaaggttagtgaggagggcaagcgtgaggatctgaagaaaggaaaagctccagaacaggtggttcttgacgaggcagcatttctaatggatttggcatcggtggatggtaattgggacgatgttgttgatcgaattgctggatgttacagagaagctggacttgatgatattgcgaagttcattgcttaccgggaatagttgttatatgcatgtattcctactgaaatcgatagtcatttttgactcgcatgtactagggtttgactcgcgtgtactggtcctgaaacaaacaaatttggttgtttaactaaaaagaggaaacagtcgagtccgtttgattttgatcttacc

SEQ ID NO: 13 - DNA, 1639 bp, Oryza sativa
gagaaagaaatctcgctctcgcctcctcgccaccgttctccgtccatccaccgagtcaccgacaggaggcgcgtctcctccctcctcacctccatctccataaacacagcaggctcacgcacacgcctccgccccggaggaaggaaggaaggaaggcaaggaagccaagcccgcgaccccgacctacccccaccaattcaaccctccctcctcagatccaccaccaccgagcgcccgcgatgacggccaagggcggcgccgcgccgtcgccgggcggcgcgggcggcctcccgaacggccgcttcttcaccgtggggctcgtcaccgcctggtactcctccaacatcggcgtcctcctcctcaacaagtacctcctcagcaactacggcttcaagtacccaatcttcctcaccatgtgccacatgtccgcctgcgccctcctctcctacgccgccatcgcctggctccgcgtcgtccccatgcagctcgtccgctcccgcgtccagctcgccaagatcgccgccctcagcctcgtcttctgcggctccgtcgtctccggcaacgtctcgctccgctacctccccgtctccttcaaccaggccgtcggcgccaccacccccttcttcaccgccgtcttcgcctacatcatgaccgtcaagagggagtcctgggtcacctacctcaccctcgtccccgtcgtcaccggcgtcatgatcgccagcggaggagagcctagctttcatctgtttggattcatcatgtgcattggggccactgctgcaagggcattgaagacggtgttgcaaggaatcctcctttcatccgagggggagaagcttaattctatgaatttgcttttatacatggctccaattgctgttattctcttgctccctgctaccatcttcatggaggacaacgttgttggcattacaatagaactggccaaaaaggacaccacgattgtttggttgctgctgttcaattcctgtttggcatattttgtcaatttgaccaatttcttggtgactaagcatactagtgcattgactctacaggtcctaggtaacgcgaaaggtgctgtggcagttgttgtctcaattctaatattcaggaatcccgtatctgtaaccggaatgctcggttacactcttacagttataggcgtaattctttacagtgaatccaaaaaacgcaacaagccctgaatattttagaatgccgtaaatatggctgtcctttctcattccggtggatgcccagggctaatatatgacggggaactacatcggggacaattgcaacaaatcctgcactgtatggagcctgattggatagcaaggatagaagtccaataatacatgtagtttgcccatgggatctgggaggcattttgttttgctaatggaaatgatcaatagaatattttttttttgtgtttagagaactgtggctcacgttgccaacattggttaatacggttagttcgtggaaattgtttgagtcattcatcggttattgtaagttcatgttcccccattttgttttttctctgaagattgcctgtaccaaactttgctccaggaccccctaatatattatgacagtgaatttaatcccacagtgagctgttgttaca

SEQ ID NO: 14 - DNA, 963 bp, Oryza sativa
acaaatgcccaaacctcatcttatcagtttcccgcccgcaacgtgtggtacccatcccacccatccccacttttatccaagccgccggcctccgatccctccacccccatcgtccgcccgtacgccgtccgtcccactcccatctcgcggccgctattactaccagcagattgacgacaccgatcgaccgatcgatcgtactacgtgcagagagcttagctagctgcgacgcacgcacggtttgtacaaggtacagtatagtatgacaccgaccgtcgcgaccaccaccccggccgccgcggcggcgacgacggcggcggcggccgaggtgaagccggcgaagcgctccgtcggcctcggcctccccgcgcttccgccattattgcccggcctcgcctcccacggccagccccgtgtcgcgtccttctgcaagaggctggcgaggaacgtggtggccatggcggcgggggaggcgccggcggcgccgctcgccgccaacgcggagatcaccgagttcatcaacgccctcaaacaagagtgggacaggattgaggacaagtacgcggtgacgacgctggcggtcgctgcgtcgctcgggatgtggagcgccggcggagttgtatcggcaattgacaggcttcctatcgttcctggtctcatggaagctgttggcattggctacagcgggtggtttgcataccggaacctgctgttcaagcctgacagggaagctttctttgcaaaggttagggaggtctacgaggatataatcagcggttaacagagatactacttatatacaacttcagttcaagggaggctgctactggattaattatctgtactgtatcacagcatagcatctaatttaattgctcttactcaatgtatgtctatataagttggacattactgctaaataacatttttcagaatgtttactcagagttgaaattctttgtc

SEQ ID NO: 15 - DNA, 820 bp, Oryza sativa
atacaaatcctatccctgcacaaccccctctcattttccccctctcctcctgagccaaacaattccctatcccctcatctcactgcagctttccactatactaccaccaccactgagctgccactactcatccagctaactaggagaaggaaaaaagaagaacacagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgttttttttcttcccattttgtcactccgacctaatttctccctgttgcaacaactgctctgtatccgtatacgattaataactgaatcttcaggctttgccatgtgttca

SEQ ID NO: 16 - DNA, 925 bp, Oryza sativa
cgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtggtgctgcaaccagatccgtttctgagcgagttgacgagcatgtacgagcggagcacggagaagggatctgtctgggtcaccatgaagcgatcatcgatgaagtgccaggcaaggttgaagaagatggcggcgaagggagaggcagtggagtaccggtgcctcgtccgtgccaccgatggcaagaagaacatctgcaccgcgctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctgga

SEQ ID NO: 17 - DNA, 1339 bp, Oryza sativa
accgttgataacttgatactctcccgatttgacgaacgcaaagcacgcacacgatgaggctcacgacgaaatcgaaaagccgctgcttagactgaacacaccacacacgagcacgagcacggagaagtcgagagagagagaagagagatggtcctccccgtcctcgcgcccctcgccggcgccaccgccgtcgccttcctcctcttcaagttcgccaccgtcgatggggatttcacgctggtctcgcgcggggcgccgcggcgggagaaggtggacgggaaggttgtgtggatcactggagccagccgcgggataggggaagttcttgcaatgcaatttgctagtttaggagcaaagctgatactatctgctcggaacaaggaggagcttgagagagtgaaacataacatcatcaacaagcatccaaatagcagagttgaagtattacccatggatttatcatcgggtgaagagtctctgaaagagcatgtacatgaagcagagtcactcttctccaatgcaggcgttgactatatgatccataatgcagcatttgagcgtccaaaaaggagggctctggaagaaactgaacaaggtcttaaggctacttttgatgtcaatgtctttggtactattactctaactcgccttcttgcaccctcaatgatggatagagggatgggccattttgttgtgatgagtagtgcagctggaaaggttccatcacctggccaggctctttattcagcctccaaacatgccctcaatggctatttttcttctctgcgctctgagttatgtacaaaaggcattaaggttactgttgtctgtcctgggccgatcgaagcaccccaatcttctggtgcaacctcttcatcacaaaaaccatcttctgagaaacgtgttccagttgaaagatgcgctgaactgacaattgttgcagcaactcacggactaaaagaagcatggatatcatatcagcctgtgctaggggttatgtacttggtgcaatacatgccgacggttggtctctggcttatggacaaggttggtgcaaagcggctggatgtagcagcaaagaaaggcaatgcgtacggttggaatctccttttcggtggcaagaagtcagcatgatgaagttgtccaataataggggagtcaaaatggctgtataaatttgtggattctgaacatacggattttggtatttacttttactactgttacagtagcaccttacctaaacaagttctcgaattctaaaggagcccttgatgaacgtctgttaattttacgatattgagggtgtcatgctaactcacctctcttatttttgtgc

SEQ ID NO: 18 - DNA, 1916 bp, Oryza sativa
gtggggagatcccaactccgaatccgacgcacccacacccatccactccagagctccccgcggcacttggcaccaccaccaccaccaccggcatccggcggcgcgggcggtgatggcgaccatcaccacgcagctccggtcggccctcctctcgccggcggcctcgccgagccgccgtgccaggcgcgccccgtcgtccgtgcggtgcgactcctcggcagcgtcgtccctgtccgcctccgcgtcgctcgacgccgacttcgacaagaagcagttccgccacaacctcacccgcagcgacaactacaaccgcaagggcttcggccacaagaaggagacgctcgagctcatgagccaggagtacaccagcgacgtgatcaagacgctcaaggagaacgggaaccagcacacgtggggccccgtgacggtgaagctggcggaggcgtacggcttctgctggggcgtcgagcgcgccgtgcagatcgcctacgaggcgcgcaagcagttccccgacgatcgcatctggctcaccaacgagatcatccacaaccccaccgtcaacaagcgattggaggacatgggcgtccaaaacattcctgttgatgcaggtattaaggatttcgatgttgtcgagcaaggggatgttgtcgtattgcctgcatttggagcggccgtggaggagatgtacacgctgaatgagaagaaggtgcagatagtcgatacaacgtgcccttgggtttcaaaggtgtggaacatggttgaaaagcacaagaagggtgactacacttctattattcatggaaaatactcccatgaagaaactgttgccactgcttcctttgcagggacatacatcattgttaagaacatagcagaggctagctatgtatgtgattatatacttggtggccaacttgatggttctagctccacaaaagaggagttccttgagaaattcaaaaatgctgtttctccaggatttgatcctgatgttgacttagtgaaagttggcattgccaatcaaacaacaatgcttaaaggagaaactgaagaaattgggaagcttgttgagaagacaatgatgcgtaggtttggagttgagaatgtcaatgaccacttcattgccttcaacactatctgtgatgccacacaggaaagacaagatgcaatgtaccagctagtgaaggagaaagttgatcttattctggttgttggaggatggaactccagtaacacctctcatttgcaagaaattggagaactcagtggaattccgtcttactggattgacagtgaacaaaggattggacctggaaacaagatcagctacaagttaaatcatggcgagcttgtcgagaaagagaactggttaccagaaggccctatcacaatcggagttacttctggcgcctcaactccggacaaggttgttgaggatgcgttacagaaggtgtttgagatcaagcgccaggaagttttgcaggccgcgtaaattttcatcaggtttggtcacggtagctgatggcttggtgaaggttaatagaaccagtgcacaagcgatgtctgtacagtagtgaagaatgctacgcttttaggagcgcatactacggcatgtgctgagatttacgtagtatgttgggggcaaatgttgtaatcaattatcacacgaagaacagttgctgtatcggctgtcataactttctgaccccctcaaataacgttgcagaagtatctttcttcggtataaatatcacccaatttgttagctagtactatttgatagagctcaaatgcaggactccctgtatatatatggcaagtacaagaaatgcagggttccctatgtataacattaagttcagaaccaatcttgatatgccacatatgttgttataaaattccatttctctctgcaa

SEQ ID NO: 19 - DNA, 695 bp, Oryza sativa
gcagcacgaaggaagatagattttccccatcgaaatctcgtcgcttcccccgggttcgattcgagtcttctctctcgcagcacaaagatggacgcaaacagacgccaaagtggaatccagcaattgttggctgcagagcaagaggctcagcaaatagtaaatgctgctagggctgcaaaatcggcaaggcttaggcaagcaaaagaggaggctgagagggaaatagctgaataccgtgcccagatggaggctgaatttcagaggaaggttgcagagagtagcggtgactctggtgcaaatgtcaagcgtcttgagcaggagacagcggaaaaaatcgcacaactcaagcagcaggctgcaagtatctcccctgaagtgattcagatgcttctgaggcatgtcaccactgtgaagaactaagggttgatggcttgctgctaggcgatttgccatacatctgatggcaaacttgtactgtttattttttgagagggtggtaagaataacttcgtctcttctagctgtaattccgtgttccgaataacggaataaactgcttctgttcatcagcagccatgtttcgtactttgaaaacctcggttcctgtctggtaaatattatcctttcatgtatcatttgaataaaataatgggagattctttttgtttattctcaaaatctcccttgtctttaaa

SEQ ID NO: 20 - DNA, 1391 bp, Oryza sativa
aacaatgtgcgtataaatgcatcggcatcttcctaactgcttatatataggcatagccctccacagtgcacacagagtatagcagtaaccaattaatcaacctagcttaattacatagacgagctagcttagcacacatggcgtcttcaacctcgagctcgctcgccgtggcaacaatggtggccgtcgtcctcctcctgggtgccaccacccaggcggcgcgcctcctcgacgaactcgtccccggcattccgatgccgacgatccccggtgtaccggcggtcggccccaccatcccggccatcccgacgatccccggcgttccggcggtcggccccaccatcccgaccatccccaccgttccgacgatccccggagttccggcggtcggtcccaccatcccggccatcccgacgatccccggcgtgccggcggtcggccccaccatcccgaccatcccgaccatcccgacgatccccggcgtgccggcggtcggttccaccattccgaccatcccgacgatccccggcgtgccggcggtcggcccgactatcccgaccatccccggcgtgccgacgatcccgacggtgccgggagtgccggagctgccggtaaatcccggaggcgtggtgccgacgatcccgaaggtgccattgccgccggtgaatcccggagccgtcgtgcccgccgtgccagctctgccggtgccgccgatccccggagccgcggggggtgtcgtgccgaccctgccggtgccgccgttgcccgccgtgccgggagtcccgctgccggaggtgcccggcgtccctctgccgccggtgccgtccgtcgtcccgcccgtgccttaggtcaactccggcgagccccgtgccgtcgttaattaattactccggccagctgacgtgtacgtggcattgaccgtgtgcgccatgcattggccgccggcgccggcagccatctacagattaattacgtacgtgtgttaagtagtaagtacttcctccgtttcacaatataaatcattctagcatttttcatattcatattgatgttaaagaatctagataaatatatatgtgggaaatgctaaaatgacttacattgtaaaacagagagagtacaaattaagatgacttgcatgtacgttgttacgtcaagttggtatagtatttgtgtaatgaacgtgtgtgtgtgcagaccaggtgcagtatgtgtttgtggcgagtggcgacaaatgcgtcacgctctgtatacgtacgtgtgcaaaagcttaacgtgttgcttaaattatacgtgtcatgttaacaaatatatatttctatcaccgttttaattgtgtatatctttgttggcaaattaccacgcatgcaatcttagtaaaagtgcccctt

SEQ ID NO: 21 - DNA, 2864 bp, Oryza sativa
accctgcaagttgaattaaaccactcttcatctcatctctctccctctcatcgccatggccgcctcctcctccatttccatttgcatcaccacctcctcctcctcttctccgaaccctaattccgacgagcggtggtggtgctagcgagcgagcttgatctccatgcgtcggcgctagctccaccggcggccatgcctcaccgacgacgcctgcttaacccggcgccgtcactgccgccgccgccggctgctgctccggccggcttccaccaccacctcctcgccgtcgacgacacgcggctgccgctgctcgccgactacgcgctgctgcagggcgacgccgcggcggcgccggcgtccgcggagtggagcgccgggagcgggttcaccggcatctccaccgacccggccaccgccaccaccgccacgacggcgtccaccgccacggcgccgggatcggcgtcgaacctgacggcggcgaccgccggaggaggagggagggagacgtgggtccgccgcgccagggagggctactacctccagctctccctcgccatccgcctaacctccgaggccttcctcgccggcgtcccgcccgagctcctcatcggctgcggcggcggcggcgaagccgagaaccacgccgacgtcgcggccgatgccgccgctgtctcctaccggctctgggtgaacgggtgcttgtcgtggggggacaagatcgcgcacgggttctacaacatcctgggggtggacccgcacgtgtgggcgatgtgcaacgctgcggcggaggacggccggcggctgccgacgctggtggcgctccgggcggtggacagcggcgagtcgtcggtgctggaggtggtgctcgtcgacaagtgcggcgacccagcgctcgccgacctcgagcgccgggccctcgacctctaccgcgccgccggcgtctccctcgacctcgtccgccacctcgccgtcctcgtctccgaccacatggggggcgcgttgcggtcggaggacggggacctgttcatgcggtggaaggcggtgagcaagcagctgaggaagcggcacaggtgcgtcgtcgtccccatcggcagcctctccatcggcttctgccgccaccgcgccatcctcttcaagagcctcgccgacttcatcggccttccctgccggatcgcgcagggctgcaagtactgctccgcgccgcaccgctcgtcctgcctcgtcaagatcgacaacgagagaaggtttgtaagggagtacgtcgtcgacctcgtcgttgagccgggaagactcagcagtccagactcgtctatcaatggccagttgctctcctccgtgccttcacctttcaagacctcatgtacaatgagttctgcaaactatgcaacaccggctgcttcgtggaatcgcgcgatatctggagatcgtcgcaactcgatactgtcaaatcctcagtattcagttgctaagtactgtgttgccgaggagaagagctctgttcaggtagccaccaaagaagccatgctgccaaaatgcggtcagatcacgcagaacggcaactgcaacaagaacagtatggcagtgttcgaagtgtcgaagcagatgaaggcgatggagatcagttctgagagtggcgataaggacaacatctccagtgctacgcctctgaaacggctgagcatcgagccgtctttctgcgccgattggctcgagatttcatgggacgagatcgagctaaaggaacgcgtaggcgccggttcgtttggaactgtgtatcgtgctgactggcacggctctgatgttgcagtgaaggtgcttactgaccaggatgtcggcgaagctcaactgaaagaattccttagagagattgcaatcatgaagcgtgttcgccatccgaatgtggtgttattcatgggtgcagtgacaaaatgcccacatttgtcgatagtaacagagtatctgcccagagggagcctcttccgtctcatcaacaaggcatctgctggagaaatgctcgatttaaggcgtcgtttgcgcatggcgttagatgttgcgaaaggcatcaactatctccattgcctgaatcctccaattgtacattgggatttgaaaacgccaaacatgctggtggacaagaactggtccgtgaaggtaggtgactttggcttgtccagatttaaggcgaataccttcatatcctccaaatcagttgctggaacaccagaatggatggcaccagaatttcttcgtggcgagccatcaaacgaaaagtgcgacgtgtacagctttggagtgatcttatgggagctcatgacaatgcagcaaccatggaatggcctaagccctgcacaagtagtaggagcagttgcattccagaacagaaggctcccaattccacaagagacagtccctgagctagctgctcttgttgaatcctgctgggatgatgatccaaggcagcgaccgtcgttttcgagcatcgtggacacgctgaagaagttgctcaaatcgatgcttggtggctcatgacgaatactgaagactgttggtcgccttcttatttttgttctccctgttaatgttaatctacagcaaacaataagttggtaagtcagttgccttaaaggcatctgagttctctacagaaaggagaggatagttgaagcagcacaagtccaatgctgcatcgagttcgttaggtcaccttttttttttcctccgttttccgcatgagaaactaatatctaaaaaatattgttttttgctcctctttttctctggattgaattttgtacagtgcatacaaatttgaaattaatgtgcagaattcagatggtcatgattcgctcggtttactacaaaac

SEQ ID NO: 22 - DNA, 778 bp, Oryza sativa
acgttatcacctcgccgctgtgctcccacactctatcttctctttctcttctcctcgcgactccgccgctgctcgagagcgcaatggcgtccatggcgttcacactggtgggagcattcaaggggatgtccctctcctccccgtgccattcctcctcctccgcctccttcctccgcgctgaccgtgtctcgctctccgtcggcggcggggtcgggatgggggtgccgatgacgatgccggtgcggcggctgacgatccagatggcgcacaagaagggggccgggagcaccaagaacgggagggactcccccgggcagcgcctcggtgtcaagatttacggcgaccaggtcgccaagcccggcgccatcatcatccgccagcgcggcaccagggtctatcctggaaataatgttggaatgggcaaggatcacaccctcttttctttgatcgatggcctcgtaaagttcgagaaatatggaccagacaagaaaaaggtaagtgtttacccatacgagaaacaacctgagaacccaaacagttacagagcaagaaagagagagtacttccgcatgcagcgtgaacgcaaaaaggcaagagcagagggaattgttgaggtgcaattggtgttggcagctgcagatgaaagtcctgaggtcaatgcagactgctgataagttctctgccccgtttttctccattttcgcaatccatgtttgataacaatgtttggaatgtaaatcatcaactatgagatgaatacaaggcccatcttcaactc

SEQ ID NO: 23 - DNA, 1364 bp, Hordeum vulgare
atccacatccccaccggcttgctccctctctctctcttggccgatcaagcgcgtttctttgctgctgcttcttcggcggtcttgttggcgatgggggccgggatggtggaggtggagctggggccagggatgggggcggcggagtccgtgccgccggccaagaggaggcgggtggtggccctaaagaccgcggcttcggcggcgggaaggaggccgcggcgcgccaggaggccgtccgccatccagcggctcttccaggcctgccgcgccgtcttccgtggccccggcaccgtgcccgcccccgccgaggtcgccctgctccgcgccatgctcgacagaatgagaccggaggacgtcggcctaagctcggaaatggccttcttcaggaacagggacgccgcagccgaagggaccccgacgatcacgcacaccaccatatacaagtctgagaaattctccatggttctcttcttcttgccgacgaatgcggtcatccccctgcacaaccaccccggtatgacggtgttcaacaagctgctcatcgggtcgatgcatgcaacgtcatacgactgggctgatcccgacgatgatccggctaatgagagcggcgcctcgtcggctgacgctcaattgaggctggcacaactggtcgtggacgatgttttcacggcgccgtgcgacacgtcggtcctgttcccgacggcgggaggcaacatgcaccggttcagggccgtcgcgccatccgcgttcctcgacatcctcggccccccttactccatcgaagaggaccgagactgcacgtactacacggacattccatactcccagcatcgcatgaccggcggtgagctcggcggggacgagcaagaaggccggcgtctcgcgtggctgaaagaggtggagatgccgagggatctgaagatgtgcagcgtccggtacggcggcccaccgatctccggcaggtgatcgatgatcctttccttccagcccttttgcgaccgatgatgagctgtcaagcgtcaacccaactcaaaccagatggtttcagaatcgttgtttacctcgtgaatacagcagcaagctagttagttgagccataagaataggtctcagtttgtgcatgatgtcttaatcagttatggcagtttaccatgtaagagtgcttgcttgcttgcttttgcagcagctgtgtacgtggaccttgaccaggagatccctttgttgatcttttttctcaatacatagaagatcatccatagatttcacttgctgagcctctgcattctccacctttttttggttaaaaatgtttcatgctctgtccaattgtttatcaggtttgagattcttgaattccttcccat

SEQ ID NO: 24 - DNA, 960 bp, Oryza sativa
ggtttggcatttggaattgacagcgcaaatgcagttgtcctggaggatatcaaccaaataattcccctccatccttcagtaattggcctccaaacacagagcccgaatgagcatggcaagggagcactttgtgcttattcatggagaagggcatggatcctggtgttggttcaagcttcgttggctccttgagagctctggctaccaagtaacatgcatagaccttgctggagctggtgttgaccctaccgaccccaacacagttcaatcgtttgagcagtatgacaagccgctcctggacctcatctcagctataccagaggatgagaaggtgattttggttggacatggttcaggagggttgagtcttattcatgcaatgcaccaatttgttgacaggattagacaagcaatttttgtggcagctacgatgctaccatttggacttcaaactgacgaagataagaaagatggtttaccaacattgcctgagaatgagatcaatttgatattcggcacaggagcagatgatcctccaacaactgctgccctgagaccagaattccagagagagagattatcccaacagagtcctgaagaggaatcagtactcgcttcaatgctgatgcgtccatggcctgtgacagctattagcactgcaagctttgaaggagacgatgagagactaaatcgaatcaaacgggttttcataaagacagaacgtgaccacatgctggaccctcagcagcaagattccatgatcaagaagtggccgcccagtgaggttttggaaatagatacggatcatagcccctttttttcagcaccagaacagctctttaatctaatagtcaaatccctatgatgtaaatctgcatacaactcaaacatccaaggagacttctccaaattattgtaccactgcatatacacaacaactttaaactgatttagagccac

SEQ ID NO: 25 - DNA, 2552 bp, Oryza sativa
aaccgtttcaaatcctcctcctcaccactcccaacgtctactcttcccccaaatccctcctccccatcgcggcgctgccgccgctcctcctccggcagccagccatggccacggtcacgccgggggtgctgctcaagctgctgcaggcgatgcacaccgacgaccgcgtcgccggcgaccaccgctcccccgtcctccaggtcacggccgtagtccccgccctcaccgcctccaccgccgactccctctggccctccaacggcttcctcctccagctctccgacggcctccactccacctacgtccagccatcctccgccgacgccgacgccctcgtctccgcgcgcccgcaactcgtcggccacctcgtccacctcgaccgcctccgcttcgcccgcccggtgccccgcgccgtcgggatccgccccgtcccgtcctcccgcagcgtctccttcgtaggaaacccggagccgctcgtcgcccgccccgccgcgtgctcccgcggctacgtcatccagcccgggtcccactccgactccgcgccgccgctcatgccatccagttccggcaatgcggtgcagtccgatgcaacggatgccgtcaagaggattgttctcgcgcccaagagcgtctccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcttcccgagcgtcctcacctgcggtcaggggcacgcccagggcgacgtcaccagcgccttccaaatgcgtggtgcccagccttgtttcggccaaggaggagaatcgccgcacggcgagggagccagcgattatcgtgccatcgaggtacaggcagccgtcaccggtaggagggaggagaggggcggcgtcgcccgcacccggtgggaggcgcgcgtcactgtctcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggaagccactgaacgaagagacgcagcagcaattgctgcagctgatgctctccaggaggcattaatcactgaatccgtaatcaggaacctaagtaaattttctgaacttacttcagcatcgaagacctccaatccccttccaacagttgatatcttccttgctgtctatgaggatactctcaaatggaagaaaattgctgagtctatatccaccaatagaactgaaactgcatcatgggagaattcagctactcattgggttgaagcagcattggcaactgatcttgaagtcctaaagttgatgaataaggcacctgaatcgctctctcggaaaaggggtgctgataagccaaaggctccctcggtggtagaagctccaagaacaaccatatccaagaggcaatcacatgggacttctgcaaaggtccagtcaaaggtcttaccgacctctacagcgagctgcgcatggaacaaaactcagggcgtgaatgagacggctgagcttgccacgaccttgtgccgtgagatgcatacgtggttcctgaaatttgtggacgaggcaatggatttgggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttacgggttcgtcatcaatcacatgggatctgcatttgatagctcggtctcgatttcatcaaggaattgaggaatgcttaaagtaagcctttaagtttcttctcttttatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttagagctacaagatttcattcttacatccttgcaaatattgtgctaggatttatggtatgttaatttgattggtgccc

SEQ ID NO: 26 - DNA, 1481 bp, Oryza sativa
agccagaccagtacacacaccattttgcttgtcaatggccgccgccgccgccgatcccctcgtcgccggcgccaccgtctcctccgactccgactccgactccgacgatctccacctcctcctcccgaatctcctcccttccgccgccaccgccgcatcagacgcgcagctccaccacttccacctccccgcgctcccgtcccctatcaccgtccgcaccctcccttccctcggcctcaccttccagctctggccatcggcctccaccctcctccgcgtgctccccgcctcgccgctcctcctctcgcgcgcgcccaccccggagagcccgctgggcatcctcgagctcggctccggcaccggcgccgcgggcctcgccctggccgcggcgctgcccgcccacgccgtcctctcggatctccccgcggcgctccccaacctccgccacaacgcgtccctcaacgcgcccctcctcgacgcccgcggcggctccgtctccgtcgtcccgctcccgtggggcgacgccgccgcgatggaggccgtcgctgctccgccgccggcttctcggttcgacctcgtcgtggcgtcggacgtggtgtactacgaggcgttggttgaccccttgattgagacgatgcggttcttcgtcaagggggaggtggtgttcgtgatggcgcacatgagaaggtggaagcgcacggacaagaagttcttcgccaaggcgaggaagctgttcgacgtcgaggtggtacacgaggacccgccgctcgaagggtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacg

SEQ ID NO: 27 - DNA, 793 bp, Oryza sativa
gcacagatcgaggagataattagctcactccatggccgctgctcggtttcctctccttgtcctctgcctcctgccgatcatcgtctgcagcgtcgtggacgcggagctgacccatctccacttctacttccacgaggtcgacgccggcacgcccaacgccaccgtcgtcaacgtcgccagccttcaccggaactcgtcgacgttcggcgacgtgaacgtgttggacaacgcgctgcgggaggggccggacccggcgtcgcggctgatcgggagggcgcacggcctcgcggtgcacgcgtcgctggacgagacgggcggcctcacggccatcaacttcgtcttctccgactacggcgcgtacagcggcagcacgctggccacgcagggccacttcatcacgacgggcccgtcggagcggagcatcgtcggcggcacgggcaagctccggttcgcgcgcgggtacatgaccagcaagcttctcagctccacggacaccgccatcgtcgtcgtcttcgacatgtacttcaccctcgaccattgaatactactccgtggtgtgttatatatcgtgcagtgcttgctttggtgttcggttgaacatatgtatgcacggcgatcgtgacgaatactggggttcggagaattcttttccgacccatcgtctcataggcccaattcaccactcctacgctgtactgacacactcatgtaaaaataaactcggtgttataattgctcagggcaaagcatccttataaataacatttcgcctcaaattctcgaggtaggatca

SEQ ID NO: 28 - DNA, 995 bp, Oryza sativa
cagcccctccatttcaccaactcacaccccctcacacgcttttaactcacccaacagcagctagccgagccgagccaaccaacggacgaacacctctctggctctctcccccaccgcgtcgtcgtcgtcgtcgtcgccgatggccaaatgcagcaagatccgctacatcgtctggctccggcagacgctgcggcggtggcggtcccgggccgcggcgcgcgcggcggcggaggcggtgccggcggggcacgtggcggtgtgcgtgggcggggcgtcgcggcggttcgtggtgcgggcggcgcacctgaaccacccggtgttcagggagctgctccggcaggcggaggaggagtacggcttcccgtcgggcgcctactgtggccccatcgcgctcccctgcgacgagggcctcttcgagcacgtcctccggcacctctcctcgccgtcctccgccgcgcggttcgtcaccctcgaggacatccagagcggcgccctctcctgctgctgcgccgccgccggcgacgccctcccgctcctccgcggcattgccaccgacaaggccgtgtggtgaatgcgatgtgtgatcccacccctagctagccgctccgctcgccattgcgcgtgcgtgcatgcgcgcgaccgttcttgccaccattttttttttctcttctcttcttgtcctcttttttcccctctccctccatggccatttgagaggagctgagactcgccggagcaagagaaagagagagaaatcggcgaccggccggcggtggcggtgaagtgagatggctgagaaagtcttaggattttgagacggccaagtctagtcatccattcccttgtcaaatccgggaaaattatttagcaccggagatttttattctttcttcttcttcttcttattttcacttaataattcgccagtgtaaataactgtactactgcgattattctgccaccatttcaagtgaattgaaacattctttctttac

SEQ ID NO: 29 - DNA, 1839 bp, Oryza sativa
gaactagcaagtaaacctgcggtgtttccaacacaacaaacgctacaacccttgtaggtttcagaggaaaacacacgacacgagccggaggcaacaaggcgctcaggtccatggagcctcacgtcctcctcgtgtccttccctatgcagggccacgtcaacccgctcctccgcctcggccgccgcctcgccgccacgggcctcctcgtcaccttcaccaccgtccgcctcgccgccggcggcggccgcctccgcgacgtgccggaggacggcgcgtgcgccgacgtcgggctcggccgcctgcgcttcgagtacctgcgcgacgacgacgacgacggcgacgagcggtgccagcagctggcgcccaacgacgtgctgtcgcacgtcacggccgtggggccatcggcgctcgccgagttcatcgacggccaggccgacgccggccggccggtgacgttcgtcgtgaacaacatcttcgtgccgtgggcgctcgacgtcgccgccgggatgggcatcccgtgcgccatgctgtggatccagccgtgctccgtgctgtcgatatactaccacttctacgagtcgcccgaggcgttccctaccgccgccgaccccgacgtgccggtcgagctccccggcttgccggtgatggccatggtcgagctgcctttcatggttcgtcccgagtacgcgcagtgcctgtggggcgacacgctccgggcgcaggtcggggcgatcaagaggacggtgtcctgggtgctcgtcaactcgttctacgagctcgagcgctcggccgtcgacgcgctccgcgcgcacacgacggtcaagctcgcgcccatcggccctctcctggagcatggccatgacaacggcggcggcgacgacggcgcgccggcgccggcgctaggggccgaggacaacgaccgctgcgtggcgtggctcgacgcgcagccgccgcgctccgtggtgtacgtggcgttcggcagcctcgtgaacatcggccgcgacgagacggcggcggtggcggaggggctcgtcgccaccggcaggccgttcctgtgggtggtgcgcgacgacagccgcgacctcgtgccggaggccgtcctcgcggcgtgccgcggcgacaaggccggcaagatcacggcgtggtgcccgcaggggcgcgtgctcgcccacggcgccgtcggctgcttcgtgacgcactgcgggtggaactccatcatggaggcgctcgccgcgggcgtgccggtggtcgggtacccgtggtggtccgaccagttcgcgaacgccaagttcttggtggaggactacaaggtcggcgtccggctaccggcgccggtgaccggcggcgagctccgagcgtgcgtcgaccgcgtgatgagcgggccggaggcggcggtgatccggaagagggcgatgcattggaagcgagaagcggcggcggcggttgccgacggcggttcgtcggatcggagcctccaggattttgtcgaccatgtacgacgttccaaaggaccggaggagctagctcgattagctcaagacatccagattatgaatgggccggtcaatccggtcctagtttaataaatctagcacagcccatgtacggtcatgtgggggctatgacgctatgtagtgtgttaatctatctactccattaagttgctgtcgagtctaatccttgttatcataggattccaaggcttacataaaaaaacggtgtaaaaaatgtaagtttgaagtttgaacactccaagtcaaacacgattacatcgtattatacgaattcaatttcgtaaatcacaacagatcatataaaaattgggaggtcgctgtacca

SEQ ID NO: 30 - DNA, 895 bp, Oryza sativa
ctgcacaaacgcaacaaacgaagcccaaaacgccaaagagagaagaaaaaaaacacgaaaaatttccccaaaaaagttagcgaccaagaaaccgcagaaatggaggagcagcagcatctgcatcccggcggcggcggcggcaagaagtcgaacaagatcaccgagatcgtgcggcttcagcagatgctcaagaagtggcgcaagctctccgtcgcgccgaaagacgcggccgccaccgccggcaatggcggcggcggcgagagcaaggcgaagaagttcctgaagaggacgctgtcgttcacggacggcggcgcgtcgccgggggggacgccgccgccgagggggcacctggcggtgtgcgtggggccgacggcgcagcggttcgtgatcccgacggactacctgaagcaccgggcgttcgcggcgctgctccgggaggcggaggaggagttcgggttccagcaggagggcgtgctccgcatcccctgcgaggtgcccgccttcgaggccatcctcaaggccgtcgagaagaacaagaaggacaacgccgccgccttctgctactgcagctacgagtacgccgccgacgaggtcgccctcggcgcccccaacaacccattgtgcagatgaagaggaacgtagtagctgctggtttttagcatggctgttgttcatccatccaaaagaaatggattttttttctttttcttttcttttcttatcgatttgtgtttttaagtgttgtggatggtgagggatgatttgatagtatctcccccctaagcttagaattactgcgtaatattttttttcttattttgttgagttgagctgatgatctgaattgggtaatgcagccctcatggatgaaattaatggaaaatatttatggttg

SEQ ID NO: 31 - DNA, 1977 bp, Hordeum vulgare
ctgcgctgcgccgaccacgcggatatatccagcccgcccctgcccacgggaaactgccgctcgccgtctccagcaatcaaccaccaccaccagcaaaagcccggcgcggcggcgtctcttcctttccttccccgctcgccatccgccgtcgccgtccctcatcgggcgaaatccatgtggttctgcgggtcgtcgccgataatgtggggccaacaagaggaagaggaagaggatcctgacgagcatgacagtacccagtcgccgccgacagtgtgggacgaaaatgaagaggctgatgacgagcatgacgccagatcgccgccgacaatgtgggacgaagaggaaaatgctgatgtggagcatgacacccaaccgccaccacaatgtgggacgaaaatgaagagactgatgacgagcatgggcacgatgacgacgatgttccctccgggagttccgaggaaggggagcccaagttcatagaagacaagtacaggtacagcacggtggatgaggtcattactgtactgagagaagctgggcttggatcatcaaatcttatttttggcattgacttcaccaagagcaacgattggtcaggtaagcattccttcggaggagaatctctgcatgccatcagtcgcaccccaaatccttatgagcaagccatttctattattgggcgaacactatcaccttttgatgatgataacttgataccatgctttggatttggtgatgtttctacatgtgatcattccgtcttcaacttttacgaagaagaccgtccttgtcgtggttttgaggaggttcttgatagatacaaacaaatgattccatatttggacttttcaggaccaacttcttttgcaccccttatctacgcggcgatttcagtcgtcgaaaggagtaacttccaataccatgtcctcgtcatcatagctgatggacaggcggccacctcaaagtcttacagcatcttaagtccacaagaagaggaaactatacaagcacttgttgatgctagcttctatcctctttcaattgtgatggtgggagtgggcgatggaccatgggatgaaatgaagcatgttgatgactgtattcctgacagggcttttcacaatttccagtttgtgaactttactgacatcatgtcaacgagcaaggatatggagaagaaggaggctgcattggcctttgcagctctgatggaaatacccgctcaatacaaagcgacccaatgcctccaacctccagagtggcacgaagaaatggctgacccttggatgatccttccgccaccaattgaagtccttgaacgtgattatgctgttgcagtttcccattttccagccgcacccgccctgtctaccggcattggcaaggacagttcggatgaacaggtatgccccatctgcttaatgaatccaaaggacatggctttccaatgtggtcatctgctaagtctccctagcgcggcattaaccggcgttggcaagggcacttcggatgaacagttatgccccatctgcttaacgaatccaaaggacatggctttccaatgtggtcatctgacatgcaaggagtgtggtccgacgctatcgacctgccacctgtgccgcgcaccgatcaccgtgcgcctgaggctcttctcgtgaagatgacgtggccctctgtagcggagtaccggatcggccgttccatccaactcggtgtcagtagtaatgaaggagcaagaggttggaaagacaatccggtcaaaaaaaaaaggttgaaaagacaaagatacatgaatagaactttactttatatgtccagaaccaactgcatttcagacttccagtgacctgttgtttgcacagtttattactgtcgtcatgcacaaagtagcagtggtaggaaactgtgtttcctttttctggtaaaacctgaatggaatatcagctattgtgttacagtatgatctgcatgactcta

SEQ ID NO: 32 - DNA, 739 bp, Oryza sativa
ccccttccaccccgccattgattcctcctcctcctcgcttcgctgctcgagagctcaatgattcgattcagaggttgaccatggtgtccacgatgtacaaggaggcggccgccacttgcggcgacggggagcactactcgcggctcatccgggagctgtgcgcgctgctcgccgccatcatctccccctcctcctcctcctccaccgcggcggcggcgaggtctccggggatgtcgcccgcggcggcggcgacgatgctgctcggcgcgtcggtggcgctgatgctgtgcgggtcggtgacgttcgcgatcgggctcctcctcatgccgtgggtcgccggcgtcgcgctgctgttcggcctctccgccgccgtctccaccctctcctccggcgtcttcggcaaggccgccgccgccgcctcttctccggtgagccacgcttcttcggataataagcctgtattagtggtagcttaggagattgatcattagcctttaattggttggtgatccctttgtaaaaagaaaaacgcatcctctttttgttgttgttgtcctctgaattattgagatgctctgcttctttgttcgttgcatgatgcgtccaaaaggatgaaaaaaaaagagaattgttctttcatccggatagtttctcacaaacacgttcatgtattaatcacacaacgttttgcttcttgatccgcaaatcgtaaggaaaaaatgttcactttgttaacgtc

SEQ ID NO: 33 - DNA, 1947 bp, Oryza sativa
aaatcgacgcgaagaaataagggcaaagccgccgacgcgagagccagcccatccgcctcaccacctcccgtccctcttccgctccaaatccaaccctcccctcggccgctccgcttgcgccgccgccgccgccaccggagcgacggcgagggagggagtggggagaagcaggaggaaaccccaaaccgtcccgatctcggggtcgggaacccgccgccggcttttccgctcgttcgtccgtccgtcgatcgcccgccccaccctatctagggtttcccgcgctgtagatcggatcggttcggattggttgcttgggtttggagagtaatgatggggtcgaggcgatccaggcgcgtttcatgggcctccggaggcaatctctgcaaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatatagtattggagcaggattggcatattgttgctggagaagaaagtagggagattgaaattcaaaatgagagaataaatggagcgcttgaggcaatttacccacgtccatcgaacattccgccaaacccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaaaagatcatcagaagcaaaagggatcaaaaaggataaaattagacaacacaatgggcggtcgaaattgagctgaagccgccatttaatttttgactgttctttggttcatctatcatggatcagtaaatattactccgttagctcttccattagcctccttttttatgttcgtcgaggagaggagatgttctgaaagaaagcaaaatatttcatgattgattggtgctcaaatttttactgaatcaagttcgagctcgatatcttgttctgaattcact

SEQ ID NO: 34 - DNA, 1986 bp, Oryza sativa
atcaaacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctcccgtcgcctccgccaccgccaccatcgccgccgccgccgtctcctccaccgccgtcaccctctcctccaccaccttcacctcctcctccatctccaccaccaccatctccatcgcctcctccaccttctcccccgccgccgtctcctccaccaccatcgccatcgccgcctccaccatctccaccgcctccatctcctcctccgccatcgccagtgtactacagctcgccgccgccgccgtactacgaggtttcaccggaggacaggtacctctcgccgccgccacctccggcgtaccacgaggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgattttcttttgcttgtactgtatgtatttttcttcttttatttttttctccttctttgaatgaacagcaggaaatctgcttttcctccc

SEQ ID NO: 35 - DNA, 753 bp, Oryza sativa
gtcgagttgccttattgccaaacaatagtactattcattagtagtagtatatctgacccaaaacccaaccgtttccccctttgcattgcatctcagtgttcttccattctttccagagagacaaagtaattgaccatggcaaaagatcctcatgtctccatctctctcaccggcctcgccatggtcgtcttcctcatcttcagctcctccttcctccaggccgcccaaggaccagacaagaagatggtgatgaagtacgacgtgccggtgaagaggttgatgtaccggccggcggcgatcggcacggaggcggcggcgtacgagccgttcgagctgtgcatgggctgccggtgctgcgcgtcgtcgaacgcgagcagctgcgtggacacccggtgctgctacgccatcgactgcaacatccccggcaagcccttcggcgtctgcgccttctccccccacacctgcgactgtggcgccaccaattgcaccagccagcagccatgaccacacacctcttgctgctgctaattcaattcgatctcttccatgatcaatatgcatatgcgcctgaattattcaacggttttctgatgcgattgcaaacgtattaagttttttttttcagagattcttgggactagatatgcttaaggatgtcattgttcctgacacgggcatgttgatatctgaatgtttaactgcatatagaatcttcagaaagggattaattcttgatctaccagttccacaaac

SEQ ID NO: 36 - DNA, 1731 bp, Oryza sativa
gtgtcgcggtcgcggatgccggggtcaaaaccctccccgcctcgttcccgttgagctcgccgccgctaatatcctaacgaactaactaaccatctcatcctcgaggtatccggccaagccgccaccggggtcaccaccatcgagctcgtatggagcggagggcgcagccggtgtcggcggcggtggcgccggtgacggggaggaggaagggtgcggcggcgagccggaagtggatggtggtgccggcggtgggggaggagcggagggtggagtttgggaagcaccagatcatgaagatgacggggctccccgggcgcgacctccgggtgctcgacccggtcctctcctacccgtccaccatcctcggccgcgaccgcgccatcgtcgtcaggctccagggcgtcaaggccatcatcaccgccaccgaggtgctcgtccccgaccacgacgacgtcctcctcgcctccttcctcctcgacctccgctcccgcctctccctcccggatgcggcgcctagcacgaatccggcggcggctgatcgcgggaacgggacggagcagggcgatcaggggagcgtgccaggtctggcgatcagcggtgctggcaacgccaagatcccgccctttgagttcaaggtgctcgaggtctgcctcgagcacgcatgcaaagacttggaatctcagacacgctctctggagaaggaggcgtatccggccttggacaagctgggatcgaaggttagcacgctgaacctggatcacgtcaggaatctgaagagccgcatggttgatctctcagggcgcgtgcagaagattagggatgagctggagcacttgctggatgacgacatggacatgtccgagatgtacctgacgaggaagctgtcgttccaagggctcagcggatcgctgagcagagcggattcacacaagtacgcatctgttgatcatgacgacgatagggaggaggaagaccatgacgatgagacagagagtggccgtgaaagttctgtttatgttaagcctgatatagaagagttggaaatgcttctggaagcttactttgtgcagatcgatggaacgctgaataccctgtaccatatccgtgaatacgcggacgacacggaggattacatcaacataatgctggacgagaagcagaaccagctgctgcagatgggcgtgatgctgacgacggcgacggtggtggtcaccgcgggcatcgtggtggtgagcctgttcggcatgaacatccacatcgacctgatgaaagacccggagacccccgagatggtgaggatgtccaacatgcacttttgggagaccaccttcggcacggtcgccggctgcatcgccatatacctcctggcgatctacgctgggaggaagagcaagatcctgcagtgatgcttcccaacagaggaagctaagcgtcaggttgcgagttctgcagcctggctgcgattttgctgggcagtggcgtagttgataggttgtgtatggatgtgatgcatttttgttgatttcgtatggtgtgggagcaataataatcgaacgatctctctccatttcctgctcttattagaagttagcacttagcactactatgttaaatttcggccaaaggaaccactatgttaaatttcggccaaaggaaccctttcagaaatgctcttgccacatttcgcattcgaagtaaatccaaaaaaggtaccagtaattctcattcaaa

SEQ ID NO: 37 - DNA, 494 bp, Zea mays
gccccgtggacatgggcttttctgtggggccaccgtgaatcaaatgggtgcagcgaaagctgcgaaacgtgaacgggagcatcaccgtcacggcgtcgcctagatccccgtcgtttcccgcaacggacgcacgctccgtgcacggtgatccatcttttggtgccggctggttcgtcgaaaggagataacggtcagttggcagagtccgaaggagttgcaggcgaagaccctgagcagcagctggttggtgaaggttgtccacattgcaaccactgctcaagagaagatgaagtcgtggagaatgacttccaggagttccaagagtacgatgagttctaggcgtgggttagtggcaaacccctagtcggctgtctgtgaaggccgtgtgtttatctacgtttcattttcgcactttgataattgttaatgactatgtgatgtctcggacatcatgatgtaatcaactattaccctcttttatgttattatttgag

SEQ ID NO: 38 - DNA, 1063 bp, Hordeum vulgare
cggcacgagggctcaattcacctcccaagcagagcagcgctatcttctcagaaaaagaagagcagcggcggcggggaggacgcagaaccgggaaggggaaatggcggaatccaactcgtacgaggagcagcgccggaggcagatcgaggagaaccgccggaagctggaggagctgcgggtgcaccacctctccgccgccgtccgcgaggccgccgccaggcccaagcccaagcccaagcccaggccgaagcccaaggccccggaggccggcgagctccggcggtccggccgcgtcgccagcctcccggagcagcccaactacctcaacgacgcagagcagcgcgactaccgtggagtgtacgaggcatacgctgttcggaaagggccgaccgacgagcagagggccggcgccatcgccaaggccgaggaactccggcgccggatccaccgctcccgctgccccgccttcgtcaagcccatgtcccacagcctcgccatcaatgaagtccacatgcgaatcccgagggacttccgcaagtatctcccggcggcgcatggtgaggcggtcgtggtggtggatgaggcggatgatgagttccacatgatgtataatgcctacaaaaagcgctgtcactatctcgaaaaggggtggaaagggttcgccttcgaccatgaccttgtcgatggcgattgcttggtcttccacatgacagagagggcaaaattcaaggtctacatttttagagcaaagccagactataaaagtgaccaaacttctgatgaatctggggatgaagagtaatgaagatgtgtgcttcccatacattgttcggtcaaagctgtttgtaggagaaatacgctcttggctgatgttggagttgcctaccgcgattgcatgctggttgcgtgtagagtcgcattctcagacccagtgtagcaggcctgcattataacataggttagatgggagtagtaggtagtgcaggccttgtattggttgaactactaaacggttgtagtctgactatggtctcaagtgcattttttcatgctgttccttttt

SEQ ID NO: 39 - DNA, 937 bp, Hordeum vulgare
acaaacccgataagaaaatggcggcttgtgctgcgcccccctacgtccgcatctcctgctccacaccttcaccgaccgctctccgccggccacgccgccggcgcgtcccctccgcccgatgctccctcgccgcggcccccggcctccgggcgccgccggagctcgtcgactccatcctctccaaggtgagggggactgaccggggcgtgctgctgccggaggaaggccaccaggaggtcgccgacgtcgcgcagcagctcggcaagtactgcatcgacgagcccgtcaagtccccgcttatattcggagactgggaggtggtgtattgctcggtggcgacgtccccaggaggtatttaccggacccctctcggccggctggtgttcaagaccgacgacatggttcaggtggtggaagcccccgacatcgtcaggaacaaggtctccttctccatctttggccttgatggcgccgtgtctttgaaaggcaagctgaatgtattagacagtaagtggattcaggtcatatttgagcccccggaactgaaggtaggctccttgggtttccgatacgggggcgagagcgaagtcaagctggaaatcacctatgtcgacgagaagatcaggctcgggaaaggatcccgaggctcgcttttcgtcttcctaagacaagattagaaggttaggcacgtatggcaccatgccaccattgcatactttcatgtgctcgacgccacaagggatatcagacatatgggtgtctgcacaactgcttgcacatgtaaattcagagataaagcccacaaagtagttttttatgatattaatttctacctgaagcagactgccttgttgtgagcgaaaatgtttgcggtactcatgctgtttctgaggttgaggagccgttttgagttgagggtgatgtggttcaaatctga

SEQ ID NO: 40 - DNA, 692 bp, Zea mays
aggagacttcacaaagagtatagctgtatctctatagctctatagcgccgatagatccatcctctctttccactcctagctagctaacatatccacacatggcggccagttccaaggtcgtgtgcgcatgcattctcatcgttctcgtcatctcaagccacgccaacgcgaggcggctggtggcggcgacgtgcaacggaacggaaggaggagcatgcaagggtggcatcttcgtccaaggatatgcaggcctcagtgcaaggcagaaaatggcggccactgcaacgagcactgagcaggtcgtcggcgtcggcggcgaaggcatgccggcgaccaccacggactcccggcctacggctcccggcaacagccccggtattggcaacaaagggaagatcaacaactagtttaattgccgtgtgtgttcttgtatgcgttcttatctaataataagcatccaattaagctgagtgctagtagcgcaccgtacgtactcgtttattattgtaatctagtgttgctgccagcgccaccatatttatgtccattttctcttttcatttggcattagtttcgtgctcttatctctgtgtacaatgttcagttcacactgtgcattatgaacttttgtattattatcttgtaaccatgcatatatgttcgcataaattaaataaagttctgcgtctagc

SEQ ID NO: 41 - DNA, 762 bp, Hordeum vulgare
caagcacacgcagccggccgcgcggcacggttttcttcccccgttcgccggccgccccgcccaccccctcgcttgcccactccttccccgaccgacggagccgatggcgacgctgcagctgaaccacatcgcgcgggagaccggcgacgtgcgccgcctcgccgccttctacgaggaggtgctgggcttcgagcgcgtcccgtcccacgcctactccggcttccaggttgcctggctccgcctcccggcctcccccgacgtcgcgctccacatcatcgagcgcgaccccgccgtcgcctccccgggggccgagggcgtcccgccttcgcagctgccccggcggcaccacctggccttctccgtggccgacttcgacgggttcctcaccgggctcaggacccgcggcaccgagctgttcgagaagacccagcccgacggcctcacgcgccaggtcttcttcttcgaccccgacggcaatggcctagaagttacaagctcgagccctggcgataagtaacctgggacagggagcacgaaacagtttctacttctgcgacatccatgtagtgatgcccacctcgaggctgagacgatggaagctgcagaatctgagagtaaacatccaggatcatgctttagtaccttataaataatggacttatgcctatctctgctcctcatgcttgtaatattggatatgtatgtcttgtggctgaagtactgaactgtgctgtgtgttggaacatcaagttatgttacttc

SEQ ID NO: 42 - DNA, 2035 bp, Oryza sativa
ctaaaccccccctctagcctagtcccaccactaggactcaacgagaaggggggcaggtgtccgaagcggatcacggcggcgggagagagatccggtggcccgatccatggctgcggcggcggtggcgcgccgcgtcgtcctggtgctcgtcctcgccgccgcctccctcgccgcggcgccgcgcggggcggccgctcgctcgctcggcggcagggagggccccggggaggtcgacgccgacgccgccgtcgacctcaacgccaccaacttcgacgccttcctcaaggcctcgctggagccctgggccgtcgtcgagttcttcgcccactggtgtccagcttgcagaaactacaagcctcattatgagaaggttgcaaaactattcaatggtcgggacgctgcacatccagggttaatactgatggctagggttgattgtgcatcaaaggtgaacatcgatctttgcaatagattctcagttgaccattaccctttcctactttggggtccaccaacaaaatttgcttctgctaagtgggatcccaagcaagagaataatgaaataaagttaattgatgatggaagaacagcagaacgtttactgaagtggataaataatcagatgaaaagctctttcagtttagaagacaaaaagtacgagaatgaaaatatgcttccaaagaatgcttcggatcctgagcagattgttcaagcaatttacgatgttgaggaagcaacagctcaagcgttacagataattttggagcgcaagacgatcaaaccaaagaatcgtgattcgctcatcagatttttacaaattttggtggctcgtcacccatccaagaggtgccgaaggggatctgctgagctacttattaacttcgatgatcactggtcatcgaatctgtcgttaagttcacaagagggttctaaattgttggaaagtgttgcggaagagaaccactggatctgtggaaaagaggtgccacgtggatattggctgttctgccgcggcagtaaaagtgaaacaagaggatttagctgtggtctatgggttttgatgcattcactaaccgtccgaattggggatggagagagccagtcaacctttacatcaatatgtgattttattcacaacttcttcatctgtgaggaatgccgcaagcacttttatgaaatgtgttcaagcgtgtcagcccccttcagaactgctcgtgagctcagtctctggttatggagcacacataacaaagtcaatatgagattgatgaaagaagaaaaggatatgggaactggtgatcccttgtttccgaaggttacctggcctccaaatcagctctgcccatcttgctaccgctcaagcaaggtcaccgatggagctgtggactggaacgaggatgcagtgtatcaattcttggttaactactatggaaagaagcttgtatcatcctacaaggagacctacatggagtctcttcagcaacaagagaagaagatagtttcagaggattcatcgatttctaatgctgcaagcgtcccaattggagctgccctgggtgttgcgattgccagctgtacatttggggcgctggcttgcttctggagggcccagcagaagaacagaaagcaaagaaagaactggaactgaaaaatagcctaccagttgctcaccctgcacttcatcagaggggctcatcaatgaatgtgtatttttctggacggattaaaatcttggtaagtgctccaaacagtgtgggaaaggaaatggtcgggcagtcagttacagatgaaaaactcacagaagtacgatgattaactcaagtgtattttttgtgcaacgatgtgagctttgttgcatcatgtcatagatcaacgtgtaatagtttgacatatagatttcggatgattggtgtatacgttcggatgttactatccatttaacgagtgaaattttgaattcagttcgtagctttctactaacctttatcgttctcagatatttacctgcaattaaatgctttgtgatcgatttatg

SEQ ID NO: 43 - DNA, 872 bp, Hordeum vulgare
cttggggtgccgagtctcctcctccatctccatgctcttcctgcctcggagtcggagaccctttacaataattacttacttacttggagcatctctagcagaccctttacaaccgggcctggatctggatccggatccatctcttctcccctcccccgcgccggatcgcgcatcggcttggaggcccctcggggctgccgccggcgcgggaggcgtccgcggccgtgcgagctgggaatcgggcggcgggtttcgatcgagggctttctcgggctggcgcgggatctgagccgccgtccatggatttctcgcagcttgggtttggtactatccccacctctctctctctccctccctcggcgttgacgcgcgcgcacctaaaccgaatcaggcgagcgctcgttgccggatcgctcaaccatcgtccctggtcggctggcgccaggtatgagcagctcctgagcctggtcgctcgatgcgtgcacgcacgcatgtatgcatatatataaaatgtgtactccctctgtaaagaaatatcatggtcatgttgcttggtgtggaattgtggctgaaacaatcatgtcttgggcaatcaagacagccgtggtggtgggtactaaataagagcgtctacgaccggacttattgacccatcatttgtaccggcctctcagttccccgtcagctacgggggcggcagccatcgaacattccattgcctgggatccggttgtggggtgggctgggagccctaccgggtttgttgtctgaagggtgctggaggggttggttcggctgaggccagttttaacaccctctggagatgggggaggggagatttagcctgcgataaacttgggcaggcgtggacg

SEQ ID NO: 44 - DNA, 1035 bp, Zea mays
acctgtgaaagcgagcacacgcaacgcagctacgcaagcaagcctgttctctgtcgattgaggccgctacacggcggcaatggagggaagaagggcggccgtgtcgttggtggcagcagtgtcgctgctgctggcgtgctcgcgatccccattcccggtcgtcgccgctgatgagggcgagccggcggtgggggccccggacacgaaccagctgtgcgtgagcaagtgcgggacgtgcccgacgatctgcacggcgtcgccgccgacgatcctgccgatgacagcgccgccgccgccggcccttgcgctgctgccgctgtccgcgcccccgccgccgtacctgcaactggtgctgccgccgccgccaacgggggacgtgtacgacctgctgcctccggtgacgcctctcacgagcccgccggagtccccgtgcacgaccccgccttcgtcctcatcgtcgtcgacggagcctccgccgtcgccaccctcctcctcctcgccgccgtcgccgccgccgccgaagagcggcggcgacggtggcagtggctcgtcctcgcacttctcgtccccgccgtcgtcgtcaaacccgtactactacctgtacctctccggcggcgccagggcccgcggcggcgcgtccagcagcgcttgcgcggcgctcgtcctcgccgcgttcctgcccgccgtcgccctcttcaagtgacgcgcgctctgttggttactagttacgactgccatccatcagtcggctgtccagaccggccggcgtaaagactaggacatgcattacgtactctcttcgttttggcatccgattcgatgatgatctgtcgacctttccgatgccagatgattgtccatgcagacagtacgtagttgtgtttacattttgtccattgtaccttaatgattttgtaaagtggattctgatgatggtttattgtgttcgttctgcctttggcttcgacgttgctcagtgtgcctgtgaggaagctgttgcaacttacaatcttcttcttttccttgtttgtctca

SEQ ID NO: 45 - DNA, 1462 bp, Zea mays
cacccgtaaatcatctgctttgtctacctcggcaggtttgcaacatttacgcgatccattgcattgcgacttgcagctgcagagccggtgatggcggaccggcggagcaatggtggttcgccccctagctggagcttcgcgtctcaaagcagccactaccacttggcggcgatgagaggaagctacgcgccacagagcctctggcgcccgtcgccgatgccggtccgtggtgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacaccaacgtcatccgctacttccccacgcaggccctcaacttcgcgttcaaggactacttcaagggcctcttcaacttcaacaaggacagggacggctactggaggtggttcgcggggaacatcgcctccggcagcgccgccggggccacgtcgctgctcttcgtctactccctcgactacgccaggacgcgcctcaccagcgactacagggcggcggctaagggcggcgagaggcagttcactggcctcgtcgacgtgtaccggaagacgctccggtccgacggcgtcgtggggctctaccgcgggttcaacgtctccgtggccgggatcgtcgtgtaccgcggcctctacttcggcatgtacgactccttgaagccggtgctgctgacggagaagttgcaggacaacttcttcgcgagcctggcgctcggctggatgatcaccaatggcgccagtctggcctcttacccgctggacactatccggagaaggatgatgatgacctcgggggaggccgtcaagtacaagagctccatggacgccttcgcccagatcgtcaggaacgagggccccaagtcgctcttcaaaggcgccggcgccaacgtcctacgcgccatcgccggcgctggcgcgcttgccggctacgaccagctgcagctcatctttttcggcaagaagtacggctcagggggggcgtgaacagggacaagtttcagcgaattcagtaaaactcagcgaatagacgacgacgacgaaaacggcatttgattccttcatttactatattttttttacaggttcacatatttgtatagctcaaaattcacaataagaagcattcagattgcttccatttgttttcgctctgattgattttttttttaaaaaaaaattatgtttgtaagattgcagtgatgtaatataagtactaaaaataataaagagttgcttgaaagcattcagtgttatc

SEQ ID NO: 46 - DNA, 1189 bp, Hordeum vulgare
gcgtagctttgcttcttcctctgctctcctcccaaacagaggagacgcaagaaacatagctccctcgaccaccggcgatggtgtggacgacggtgcaagagctggcggcggccgtcgaggagccaccgcgacagtacctggtgcacgaacaagaccaaggcctgctggccgctgaccagatgccggagcccatccctctcatcgatctcagccggctgacggccgacgacgaagccgacaagctccgggcggctctacagacctggggcctcttcctgctcaccaaccatggaatcgaggagtcgctaatggatgccatgatgggtgcgtcgagagacttcttccggcaaccgtcggaagagaagcagaaatgcagcaacttggtagaccacggcaagaaatctgagctcgaagggtatggaaatgacaaggtggtaaaccaggatgagggcctcagctggaacgaccggctgcatctgcgactggagccagaagacgagaggaatttcaccaagtggcccactcacccggcatctttcagggatgtgctgcttgagtatgcatcaagaaccaagagaataagagacctcgtctttcgatcgatagccaagatcctggaccttgacgaggattactttctcaaccaaatatcaaacaaggatcccgggttcgcaagattcaactactaccctccgtgtccacgacctgacctcgtgttgggcatgaggccgcactccgatggcggtctccttaccatcgtttttgtcgaccacgacgtcggtggcttgcaagttgagagagacgggaaatggtacaatgttccagccaagccttattcgttggtgatcaacttggctgactgcatggagataatgtgcaacggaatcttcaggagcccggttcacagggtggtgacgaatgccgagaaagagaggctttcactggccgtgttttatgctgtggatggagaaacgatgctggagccagcgcctggtttgctggatgacaggcgacggccaagatatgggaaattcaaggccaaggatttcggtctttctttggactgaacatttccatcaaagaaagaggttcaccgagaacctgaaaatacaaatttgatggttttagttagtttatttacggatttgtagcagtgattgcctgggagaataaagagaggtttctcttc

SEQ ID NO: 47 - DNA, 1471 bp, Oryza sativa
agtagcctttcagttccttgctttgcctctactcctaaaccttctttaattctttccctcgtttctgtactctcctgatgaaatcctctctgaaaaccgttgcaggagaggagtcttcttcttcactgaggcaagttcttggccggagacaagaatgccaccagtgaatagcgacggagcaggaccaagctccggcgaggatggctctgcagccgccgtgaagaagcgcaacaggcctaagtaccatcggtttacgcagcaagaacttcaagcatgcaagcctatactgataccccagactgttattcttgtactagtgtttgtgggcctaattttcattccaattggtcttgcttgcattgcagcctcaaataaggtcgttgaattggttgatcgttacgatacaaaatgcgtgccacggaacatgcttcgcaacaaagttgcttttatccaaaactcatcaatagataagacttgcacaagagtcttcaaggtccctaaagatatgaagaagccgatttacatatattatcaacttgacaagttctaccagaaccacagaaggtatgtgaagagcctcaacgatatgcagctgagaaatccgaagaaggtggccgacacgcaatactgcagccctgaagctactgcgaatggcagacctattgttccttgtggtctcatagcttggagcctgttcaacgacacatacagcttcactcgtggtcatggcaacgagacattgagagtgaacaaggatggcatttcgtggaagagtgaaaggaatcgcagatttggcaagaacgtgtatcctaaaaactttcagaatgggactttgattggtggagggcagttaaatccaagcaaacctctgagtgagcaggaagatctgatcgtctggatgagaatagcagcactgccaacattcagaaagctgtacgggagaatcgacatggatctgcaggccggtgaccgtgtagaggtgacgatgcagaacaactacaactcgtacagcttcaacggcaagaagtcgctggtgctgtccaccgccgggtggctcggagggaagaacgccttcctcggccgcgcctacgccatcgtcggcttggcctgcttcctgctggcactgctgctcgcattgctctacttcgtcttccccatgagagaggagcatctgtcgctgcactacactcctgctcgacttgtacgatgattgagcagttgggcatggaatgttatggatctttttggaccatggattttgggaatcatttcttagttgttctgtatatatacgataaatgttagacaggctatactactactatgtgtacatatgtgttatctgtaaggctgtaattgaacttgcttgtgatgtactagttcaaacttcaaacatgttcttttaggaatacatgattcagacatggttgctgaaagaattttttaatacagtgagtgctgtgcaaagtgc

SEQ ID NO: 48 - DNA, 3076 bp, Oryza sativa
acacgtctctcctctcctcctcctcctgacctcgccgccctcacccaccacccgctcccgccgccggctttaatgcctccggggacaagccctctcaagcgtcaacgactcatccactgctccacccgcgtgggcggcgcgtacgtagaccctagccggcctctacctgctcgctacagagctcacgtacgtacgcgcgcgcggtggtggttggcgcgcgcgcgcgtgcggtgaggcgtggtactagtattatttattcgctcctgcctcctggggaggtggaggatgctggcgatcatgagcttgctgctgccgtgggaggaggaggaggagacgacggaggcggcgccggtgttttgatccgtcgcgcgcgcgcggcgagtaggaagaggttggagacgtggagaggagtggccgtctcgtttcagattcttctgcgcaaattctggttacaactagaagttgcaggacgcgagagggttgattggtaagaagaagaagtgctgtcaactttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggcatcgcctcattgttggcacaaaaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgcaattccagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcaggaagagaggaggggatccttcatggtgtggaaggcgtagtaggagagatcctgatcacgtacaggtttttttttcctgttttttgttctgtgtaatgtagactgggctgccctctctcctcccgtggcagctggcttcagatccggtggctatcttatagggtatgtttaccaaagtatctttgtgccagcttggactccctaatcctcttaatctcttggcatctatggaaggaatgcaactctagagatttcgactctgcgctcttttttatcagtggttcagtgtaaacgatgtctggttttcaggtttatgagggtaattcggttgaccgtgatagtttgggagtaattcgtacttttttcatttctaaaataaatagttgtaaataaatggatctacgtgttataaac

SEQ ID NO: 49 - DNA, 844 bp, Oryza sativa
tgagctcattgtgacacccaggaacacatcatcatcatcatcatgtctccgatgccgtcgctgctactcgtgttcctggtcgcctcgtcggcggctggtgttgcggccggcggcggcggcggggagctgaagcacatccacctgtacatgcacgagacgttctcggggccgaacgccaccgagggcggcgtcgtggcgtcgccgttcaacacgacgttcgggcaggtggccgtgttcgacaacgagctccgcaccggcgaggacagggcagcgtcgccgctggtggggaggtaccagggattcatcgtcggcacggggcggagctcgccggggtacctgacgtcggccaccgtcgcgttcaccgccggcgagctcaacgggagcacgctgtcgctggagggccccttcttcggcttcgccggcacggcggagcgcagcatcgtgggcggcaccggcaagctgaggctggcgcgagggtactacctcctcaagctcatcggcaagacctcgccggagacggccgtctccgagatcgacttcttcgtcctcatgtacagctccacccactagctatgtataagcaagaagcgtgtaaacactagtgtaacactgtaccagcgaggcaccgttcttttctgatacagattctatcctgatttatgttagcacgttttttaaatagttaaatagtgtatagagaagttgctctaaaatatcaatcatttttttaagtttatagtaattactaaaatcagttattcaagttctaatgtgttttctcatttgacgtgtccttgcttagtctttacggaattactaaatagctgtcgaatcattactactc

SEQ ID NO: 50 - DNA, 1891 bp, Oryza sativa
aaatcttgacaccatctcgctcgttgggttgtctccgtcgaagcgagcggctcgatccccaccaccaccaccagcagcggcagcctcggccggcgcggcgcggcgaggtggggaagcgaggaagagtgggagggctctcgccatggcgtcgaagcagatggaggagatccagcggaagctggcggtgctggcctacccgcgggccaacgcccccgcccagtccctcctcttcgccggcgtcgagcgctaccgcctcctcgagtggctcttcttccggctcctaggcgacagatcgccgttcacgcagcagaactggcagggggatagcctcgaccgcgacgaggagaacagcaggatccaacacctggccgagattgcgaatttccttggtataacgccttcggttgacacggaggcaattcagggtagaggtagctacgatgagcgtgtagagcttctctgtctcattgttgatctagttgaagctagctgctatgctgacaatccagagtggagtgttgatgagcagctggcaaaagatgtgctgctcgtagattcaattgcagagaaacaagcccaaatattttctgaagagtgcaaactatttcctgcagatgttcagatacaatcaatttaccccttgcctgatataacagaactggagttgaagctctccgagtatactaaaaagatgtcaaatttgcaactgatggttcaggagttagcatctaagtatgactataatccgaatgaagactatgccgagacagagttaaaactgagggaacatttgcaatcgttcctagaaacagtaaaatccttcaatatgatctacactaaggaaattcatccttggacacatatgatggaggtccctcaattgcatggttttggtccagctgctaatcgcttgttggaggcatataacacacttttgaagttccttagtaatttgaggagcctacgggattcgtatgcagcaatggctgcaggatcgctttcagcatctaatgagccttcatctgtcaccaaaattatctccgactgtgaatctgcacttacattcttaaataacagcctttccatcctttcaacttctgtggcacgggagcagggtgagactctgaattcacagtagcctgatatcaggatacttgaataaccttgtagcaagtcgatcatttgctttttgtggcttgtagtattgccgttgtgccaattgtcgttgtgttcttgtgtctgtagttcgtaactgcatagatgaaaactttaacattagcttatattgaaatatcatgccgagagctctctttcaaggctgtgtacggctgcacgttgcagcggctgcaacgctgtacaaaataatgtgcgaggcggccgcagccgcagtagtgcagccgtaacaggccccaagtttgtgcagtacttgtatgttttttcttttttctttttttccccctttgattctttagacagtagtaagtttcgctaagcaaatgtaccttttttccccctgaaaacggttctaaatttgacacatcaatgatgaattgaatcaagtcacagcctgcacgttgagccacttcccggcgcttcgttttccggatgctgctgcctgtacagatcttcaaaacttgacaccatggttctgaatcttctgataaacgaagggaaaagcctgcatttctacagagccacagcgatgcacgcacttgtgtttgtgtacgtataatcaggcttgacatatttgctttcaagagttcaagaccaagcatttcccagtccgatcgcagccacacgacgtttcagttttggacgtcacaacgccgccggcgtacgattgtacgagctgagggcgatggactacccaccacctactccctctgtcaaa

SEQ ID NO: 51 - DNA, 1405 bp, Zea mays
cttcgtgcggtagctgtccacaccgcatcgcacgctgctggggtttcgcttgcattgggttcttgtggagacgaaatgggtcagaggctgctcgaccgcttggcgggcttccttcttgtcgtcgtcgtcgtcgttgtcctctatggcggaacagagcagcggatagcagaggcggcggatggagcgaacccgcacaggctgctggccaccgtctcggtgtccaagccgtcgtaccccacggttgtcaccacgccgatgtcagcctacggcgccgacccggcctccaagccgtcctactccacgttcccgtcgctggcgaccgggaacggcggtgccggtgccggtgccggtgcaggcggtggtggtgcagctgcaggcagtggcgggggcggcgggacgtggtgcgtggccagccagagcgccagcccgaccgcgctgcaggtcgcgctggactacgcctgcggctacggcgcggactgctccgcgatccagcagggcgggagctgcttcaacccggacaccgtccacgaccacgcgtcctacgccttcaacagctactaccagaagaaccccgccccgaccagctgcgacttcggcggcacggccaccatcaccaacaccgatcccagttcagggtcgtgccagtacccatcatcaagcggcggcggcggcgctcagaacatggtgcccccgccatccccgacgacgaccatgccgccgacagtccccagtaccgtcccgatgaccccgacgccgacggcgccggacaccggtaccccggtctacgggctgtccccgcccgactacagcggctcaacttcccctcccggctacggatcgacgtctcccccggactacaacgacgtcagcgccgccgccgcgagggtgaggcagcagggcggcgcggcgctggcgctgacgcttctgtgcgtcgtcgtcgcgacagtgtcgctgcgcgtctccaaatgagagcgcgcggagctaggtggagattatacagggcggtctcaggcgagacgtacgttacgtggcgcgccccgtacgtggtggctggctgaaagacgcagaggtccgtcgtcgccgtggaccgacggtggtgtggtgcccggccagccggggggagcttccgagcagagtcgcaagtctgcttactgttgtataagaaatgtgacgagcttcctagcaacgcctataatataggccattccactgttgtacttaggagtatgtcagaaaattcttttctttgctctctccgtttgctcatgctgaataatatagttatgataaagtaaggagcgaacaattaagctttgaagtagctgtagcttgcgattttgttactaggatttaatctccgttttagggagaatcggaaattaaagggtgtttgatttaaggaatc

SEQ ID NO: 52 - DNA, 1767 bp, Zea mays
gcgacagagaatccatggcggcggcggcgtggtgggagacgctggtggtggcagcggcggcggatggaaccggtgggagcagcaccacggtggtgtccatctgcatgttcacgacggtgctgtgcctgtgcctcgtcgcgggccacctcctcgaggagaacaagtgggtcaatgagtccatcaccgccctcgtcatcgggtgcatcataggagtgatcgtatttctgctgaccaaggggaagcactcacacatcctgcggttcgatgagcagctcttcttcatctacgtgcttccaccgataatcttcaacgccgggtttcaggtcaagaaaaagcagttcttccacaacttcatgaccatcatgtccttcggcgtgttcggcgttttcatctcaggtgcaatagtttcggcaggctgctattggctcttcccgaaagtcgggtttggagaacttggtgcggtagattatttagcactgggagccatattttcttcaacagacaccgtgtgcacgttgcaggtcataaaccaagatgagacaccaaggctgtacagcctggtgtttggagaaggagttgtcaacgatgcaacggcggtcgttcttttcaatgccatcaaggatctcgatatcagtcggctcaagggtggggttgtgctaaaagtgatatttgacttcctctatctctttgcaaccagcactgtcctcggaatctcaatcggtctagtaactgcatacgttctcaaagctctgtattttggtaggcattcgaccgatagagaggttgccttgatggctctcatggcctatctatcgtatatgcttacagagttgctagagctgagtggaattttgaccgtgttcttttgcggcattgtcatgtcccattatgcatggcacaacgtgacagagagctcaaggattacaacaaagcatatatttgcaacattatctttcattgccgagacattcatcttcctttacgtcggtatggatgctcttgacattgataagtggaggacatcaaaggaaagcttcaagacatccatcggtatctttggcatcctcatattgctcatactactgggacgagtggcatttgttttccctatatccattttgtcaaatatcatgagtggaagttctgaaagaaccccgatcacattcaagcaccaggttgttatttggtgggctgggctcatgagaggtgctgtttccattgcactagcatacaatcagttcacattttcaggtgtaacatcggatccagttcatgccaccatcatcactagcacaataatcgtcgtcttcttcaccactctggtgtttggcttcttgaccaggcccctgatcagtggcatgctcccgcaccagtcgagggcgctgtccagaggccatagcacaggcagcaactccccgaaggatgacttcaccctgccgttcctgtcgggcgatgaaggcgcgtcaggcagcggtatcgtcttggagcaagccaagaggagcttgtctatgatgctggagaggcccgtccacacggttcacatctactggaggaagttcgatgacaggttcatgaggccaatctttggtggaccgcggtcgcactgactgcaggtgcatataagaggagttagtttctctgaattctgtcagcatagttcgcccatggcactgtaaagttgataacactgaatgctttcaagcaactctttattatttttagtacttatattacatcactgcaatcttacaaacataattttttttt

SEQ ID NO: 53 - DNA, 1347 bp, Hordeum vulgare
ggggggagaaaagtaaacgccgcgcaccgcaaccggagagaaatccccccgcaacaccgcgcgcgccgaatccgtcgccggaaaccgtccatccatcgaccggaccggcgggccgatccatccagccgtccgacgggagcaggcggggatggtgagcgccttcttcctcttctgcgggtgcgtggagcaggccaacgtggcggtggtcgagaagtggggccgcttcctccgcctcgccgagccgggcctccacttcttcaacccctgcgccggcgagctcgtcgccggcaccctctccacccgcgtccagtcgctcgacgtcagggtcgagaccaagaccaaggacaacgtgtttgttcagctgatctgtacaattcaataccgggttgttaaggagaatgcagatgatgcattctacgagttgcagaatccccaacagcaaattcagtcctacgtctttgatgtggttcgagccatagttccaagaatggagctggacagtctttttgagcaaaagaatgaggtcgcaaaggctgtacttgaggagcttgaaaaggtgatgtcagattatggttacagcattgagcacattctcatggttgacatcatccctgacgctgctgtccgcagagcaatgaacgacataaatgcagcccaacggctccagctcgcgagtgtctacaaaggagaagcggagaagatccacctggtgaagaaagcggaaggggaggccgaggcgaagtacctgtcgggcgtcggcatcgccaagcagcgacaggccatcacggacggcctgcgggagaacatcctcaacttctcgcactcggtgtcgggcacgagcgccaaggaggtgatggacctgatcatggtgacccagtacttcgacaccatcaaggagctcggggacaactcgaagaccaccacggtgttcatcccccacggcccaggccacgtcaaggacatcggcgaccagatccgcaccggcatgatggaggcatcgagcagcggcctgtaggccgtggctgtccgcccgccgcgtgatcatggttcggctgggtgggttctcggtgtgaggctgggagagtcgatctgtttatatattagattataatatagtggactatttcgtttgtttgatattcgtgtgttaataatacgggtgcggggacttcgttgtgtatgaagattgtcgaattttggtaataagcgaaacattttgtgtattttgttctaggatttatggtgggtttgcttcttatgagatgtgatggaagcatatgtatccagagtacatagctactcagtgctgtttcaatttatttgaagttctagctttgcacttgcaac

SEQ ID NO: 54 - DNA, 1220 bp, Hordeum vulgare
cgctaaactctgcgacagccgcggcgaaattcctcggccgaaagggaaggcgacagtgacacgggcgcacgtcgagctctccgctgcccagcgttaaatccgcacgcaactcagtgtcacggcaaggtaactaccgcacggcacgacagtcaccactcaccaaccaccacccgagtccacgccccccaaacccaaaccacccacaggccacagcgaccggcgacgatgtgcacgctggagcagcgcggccgcgtgttcgtcctcaccctcacgggcgacggcgagcaccggctgggccacccgctcatcgcctccatccgctccgcgctggcctccgtcctcgcggcggcccaggcccagccccagggcccgggggcggccctggtcaccgtcgccgagggccgcttcttctccaacgggctcgacatcgggtgggcgggcgcctcccgcgcgcggctcggggagctcgtcgacgcgctccgccccgtcgccgccgacctgctcgccctccccatgcccaccgtcgccgccgtcacgggccacgcctccgcgggcggcttcctcctcgcgctctgccacgactaccgcctcatgcgcgccgaccgcggcgtgctctacatgagcgaggtcgacatcggcctccccctcccgccctacttcgtgcacgtgctccgcgccaagatctcccaggcgcacgcgctgcgggacgtcgtgctcaggggcaagaagctccgcgcgcccgaggccaaggagatgggcgtcgtcgacgtcgtctgccccggcgcgcccgagacagccaccgaggccctcaagctcgccgagcagctcgccgccaggaagtgggacggcgccgtgtacgcgtcgattaggatgtccatgttccccgatgcgtgcagggccgttgggatcgccgtcgagagcgacgaggagaagagcaagcacttcgcctccaggctctgatcaggggaggtcggaggttctgaaccgacctgcctttgttctggcagagtgtctacggagcctgatgtctctcttggtattctgtatctgtacatggatcagccaatgatgctttgtatgaaacatgcattatatatattacttctgtaggcgttgtattttttgttactttgaaagtgtgaaacaaatagaatgcttgtgtgttaccgttggactggttattttgttgttgctgcagtgaaattctcatttgcaaaatc

SEQ ID NO: 55 - DNA, 971 bp, Hordeum vulgare
cttttcttcccctaaacccagaacccgaagaatggcgcagtgtctccggggcaagggcggcgccgccgccgtcggggaggcgctccgcaaggtggccccgtggcggcgggcggcctcggcgtcgtaccaccacacgatccaggcggtgccgcgtgagacggccggcccgcgcgcggcggcgcgcgagcgccgcaacggcaacgtcccggccgtgctgctcaccctcgccggccccgggcccggggaaggggtcgcccaccggaagctccttaccaccgacaagaagcagctcgcggagatgctgaagcagtcgccctacttcctctccaccccggtccgcctccaggtccgcgccggcgagcgatccaccgccgtcgtgcactctggcaccgtgctccccatcaaggtgcagacagatgaatcaacagggaatatattgaacttggtgatggtggaagcagatgaaggaacaatgctgaaggtgaatttgcccgtagtgttcaagggggaggatgtctgccctgggttaaagaaaggtgggttcttgcagaaaatcaggaccagtttggtgtatctctgcccggccgagcacatccctccaaaaatcgaggtggacctcacaaatgttgacattggggatagagtgttaatgcaggacatccccgtccatccatcgctcaagttactgagtaaaaacgagacgatgcccgtctgtaaggtcctgtcctccaagccagccgagtaggaacgccgtgccgtgcgaccgtctagagctggacacacctacctacaataggtggtacatcggcctgaaaatttaatccctctatctgctttgccttttggtacctagttgctatgctccagtttgctcatagtagattcaaacaagtttattgtgttcaagatacgatcaatctcggctgtaatgtcatcatgaaataatatatcctggttttttcaaaaaaaaa

SEQ ID NO: 56 - DNA, 1276 bp, Oryza sativa
acacacaccacagtcgcaatcagacattctctcttgttggttaactaaatagcttaattaatttgaggagtttagtctctgaaacatggcgatggcgacagcagcatgcagaaggcctgcagtgatgctcatggcgttcgccatggcggctgcggtgacgatgagctccgtgccgccggcgtcggggacgacgacgctgcagtacgacttctactcgtcgtcgtgcccgaaagccgaggagacggtgaggaacgtcgtcgagccgatgatcttcaacgaccccaccatgggcgccgccttcatccgcctcttcttccacgactgcttcgtcaggggttgtgacgcgtccatcctgctggacccgacgagcagaaacacgcagccggagaagacggcgatcccgctgcgcggctacgacgccgtgaacaagatcaaggccgccgtcgaggccgtctgccccggcaaggtctcctgcgccgacatcctcgccttcgccgcgcgcgactccgccgtcgtcaacggcaacttcgccttcgccatgccctccggccgccgcgacggcaccgcctcctccgcctccgacgtcgcccggttcatcccgtccccggcgttccacctccaggacctcgtcgacagcttcgccgccaagggcctcaccgccgacgacctcgtcatcctctccggcgcccactccttcggcctcacccactgcgccttcgtcaccggcaggctctaccccaccgtcgaccccaccatgaacgccacgttcgccgcggcgctcaagaagctgtgcccgccgccggcgagcggcggcggcgggagggcggtgagcaacaaccaggtgaccgaccccaacgtgctgagcaaccagtacttcaagaacgtggccgccggggaggtgatgttcacgtcggaccagacgctgacgagccgcgacgacaccaaggcgatggtcgacgacaacgccgccaacccggtggcgtggatggcgaggttcgcggcggcgatggtgaagatgggcggcgtcgaggtgctcaccgggaacgccggcgaggtcaggaaggtctgcttcgccaccaacacggcgagctgataattaagctacaagttctctttctccagcgatcggctggatcattaccacataatatatatattccttgttattttgatctcttaatttgtactccgtagttacctgcatcgattcttgctgttgtaaaactgaattgtaattcactatctttgaatattcagtgatcagttacagtggtta

SEQ ID NO: 57 - DNA, 624 bp, Arabidopsis thaliana
ctacagcaaaaataacaataaacaagataaatggagggtctaattccgttagtatacaaagccgtcatgcaaatccgttacggtaacgagtcgcagcaactttcttcttcttactacgttcgtcttcccggtgattcgggtcggtttgtaagatccgatttagatgtatcgggtcctggatctaattcctccaatagggcgtcgtcgtcgacaagcacaactacgtttgctgtttacgcgggagtccagtcacctgtttctcgtcaggttgtcacgtgattcacacgcgctttttgaaggaacctgaagttgcgtgtgagggaagggttcgtgacttttgttttgtgcgttttttttttgtaagttaggcttggaccggtttaataaacctgatgtaataattcggtttggaaaattgatttctctaagcgtagactttaacccaaaagggtggtctcgtggcttttgatttgtcaattgtgtgttttcttttaattgtataaagtttctatgaatatatttagtttattcgagaacaattgtatgaaatgtttagttaatgttttcatggtatataggttgtaaaacaggttaattacgttacaatttcctagttttggtatt

SEQ ID NO: 58 - DNA, 572 bp, Arabidopsis thaliana
tctctttcttgatttggccgacacatctgatctaacaatggcgacgaacaacatcgtacgtttgatcgctccaagccgatccgtctcctctagattcctcgagccagtgtcacggtttctaagctccggtacacctcctccgccgcaagctccatctccgaatcaggatctgaaccgggacgtgaagccagatcagaatcttcaacagaatctgcagatgcagaaggaagaagaagaggaaggagaaggaggtggaggtggagagtttgtgaacgaagatactggtgagattggagggcctagaggtcctgaaccgactcggtacggcgattgggaacaacgtggtcgatgctctgatttctgagaggattcatgtatccctgtgttttagcttgttcttatatatttctgggaaaaatggaaataaattcgttttatgtgtttatgtatttgcaaaataatggagaaaatggaagaaaatgtagtagaacttcaaattcgttgcctttatttggatcatcattctctggtgatcttgttattccagtaatagttaataagttcttcctcag

SEQ ID NO: 59 - DNA, 1112 bp, Hordeum vulgare
acgagacggccgcctctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtctagctctgtgtactccatatgtcaccatttgtactctgtatctgatgagccttgtgcgttgttccctgaactatatctgtagtagcaggtagccaggttaaacccgcagtgatatatctgttattgacttgttgagaaggccactgggtaacatggtatcttgctttgggcggatccgcgggtgggcgcttttcttctgtttttgatggtgctgtactcccttatattaattgtaagatgtataagattccacaacagcagtgagaatttaatttttttttggttaagtagcgtgcattattggcggtgtaattgttgggtgctgtgttcatgtactgtaattggaatttattgttggctttggaacacaggcaatcag

SEQ ID NO: 60 - DNA, 638 bp, Hordeum vulgare
gggggtccgacgacgacgaccacaccgccaaccacacacacaggaactcatttccgtctctcaagctcgcagcgcgcgcaccgagccgccggcgacgacgacgatggcggcgaccacggccgaggcggccctcctggtcctgctgctggtgaccctgggcggcgcggccaaggcgcagccgccgcgcggcacctgcggggcgcagctgagccagctggccccgtgcgcgcggtacagcgtgccgccgatgccggggcaggcgctcccggcgcccgggcccgagtgctgctcggcgctggggtccgtgtcccgcgactgcgcctgcggcgccatcgacatcatcaacagcctccccgccaagtgcggcctcccgcgcgtctcctgccagtgatcgccgcctggctccatgcaacgacaagaggaacaactgaagaaggcgaggatgaataagacgtcgatggtcggagcagacatcgagtagtagtggtagtagtactcagtggctgtccggttcgcctagatcgatctcctgtgatccattagaggctctcgtgtttgttgccatctggtgaaagtcggattgataataacaatggaaccccccaaaaaaaatttttttttgggcccacaaagacccg

SEQ ID NO: 61 - DNA, 719 bp, Hordeum vulgare
gcctcgtgccgaatcggcacgaggcttgtacattgcactgcatagggctgtaaaacttggaaagtttctgaggcaagcagcagcagcagccatggagcctgctagtgctagtttagtctccttgagagcatccactgccacgaaccgtagctgcttcttgtgtcggcagccagtgacgcccaagaccaggatgcttccggccatggcgtccaagtccggggcgagactggtggcttcaggctgcaagacatgcagggggaagggtgcagtggaatgcgaaggctgcaaggggactggcaggaacaagaagaacggcaacatcttcgagagatggaagtgcttcgactgccaggggtttgggatgaggaagtgccccacctgtggcaagggaggcctcacgccggagcagagaggagaaaggtagaagaaacatcaagcatccatccatccatggcagcaccaggcagatgcactctccaatgtcgtatttatcatgctcaactctgctcgaattctgactactatctagaagtaagtatcaaccagaatcgccaaacaaatatcgaaaaccgaatatggtgatacacataattggtttgagaaacaagcagaatgttgtgaggaaatcaactggtttctgcacgtattgactggtttggatgcttttgaatctatatgttgtaagtattttttgttttctgaatatattcagtttgtcg

SEQ ID NO: 62 - DNA, 1291 bp, Hordeum vulgare
tggttgacttgggtgtctggtccgcagtccgctagcggatcgatccgtccgaccacggattgattcccctccctggtcgcctatccgctgacggatcacgccggctggccgcccgcccgcccgcccgccgccgcgagaccctgccggactgccggtgggcaggtttactacgatgagccctcctccgccgttgcgtccgactcccacttacagcctgcttctgctgctcttcttctcgctaaccgcatcggctgcacaaccaaaaggggtatgtgtttcacctggcggacggttccctgctttctcatctgaaggcaagcctcctggaaaagcggcaaaggggcgccgagacctagcattatgtaggatattccgccagaacacatgttgtgacgttacacagacatttcctgccctgctttcagtgagaaagctctcgtcaactggcgaaggcagtggagaatgccttcatttgtgggagttgctcgagtgctcagtttgtgatccaagggtgggtgtcaggcctggacctcctgttatatgtgcatcattctgtgacatggttttcaaagcttgttcggaggcatacttctccattgatatgaaaacacaggccttatctccttgtggtttaggtgacatcctttgtggcaaagcacataagtgggtttctaacggcacagagctatgtcgccttgctggtttctctgtgcaagtttctgatgccagtctcagtgaagttgacgaaaccttctgctatggcgggaaagcaagtttggattccatctctgatacatggacgtcttcaaaagatcgaccagcattacatggtatgccctcttgggatcttgaagattttcagagatgggcaaaagaaatgcctgttggtgaaagaatttcgtgggcagtcggaggaatggttcttacagcaggccttatttttatcagcaaaagagagggctacagccgtcgtcgtaagcaagcttccgtcgctcaaactgtaagaaaaaaatggaatcgggagctaacccgcagcaactgaagcgatgctaggaagacataggcacctgtagcattactaatagatgatctcttggatttgtatttttgctgctctgtggttatattctaatcaactatgaaagattggttgttagactgtctcctctctatcctggtgcgtaggcacaaccaccttttctaaatgttgtgtgaaagaaaagctggagaggtctatgaattgtggttgagattgtttcttaatgcagtttttacttttgctttagtatct

SEQ ID NO: 63 - DNA, 1238 bp, Hordeum vulgare
agcacacacagcgacaagtccgcggcacgcagcgacccgctggagaaagtggaagagaacatgggcggcggcattttcccactgctggagccatggttcgtttccctggccgtcctcggcgcggtgtactcaacagccgtcgtgctccgcctcctctcacacctcaccctcctcctgcgtcggccgaggaacccccgccgccgctacggggcatgggccgtcgtgaccggtccaacgtctggcatcggccagtccatggccctggagctcgcgcgcttgggcctcaacctcgtcctcgtcggccgcgaccccgccaagctccaggatatctccgagaccatctccaaaacccacgccgtgcagactaagaccgtcctcttcgacctcgccctcatcgccactcctcaaggggacgaggcggtgcggcgtctccgggaggccgtggaggggctggacgtgggggtgctggtgaacaacgccggggtggccaagccatgcgcgctgtacctgcacgaggtggacgtggaggcgtgggtgaagatgatgcgggtgaacctatgggcgctgacggaggtgacggctgcggtgctgccggggatggtgcagcggggcaagggcgccgtcgtcaacatcgggtccgggtcgtcggaggccatcccttccttccccctctactccgtctacgccgcttccaaacggtacgttgctcagttctcccgaagcctctacgtcgagtacagaagcaaagggatcgatgtgcaatgccaggcaccgctgttcgtgcagacgaagatgacgtcgatagtcgcgggatccggcaagcggcgccgtggcgtgctgccgcggctgatggtgccgacctcggacgagtacgcgcgggcggcggcgcgctggatcgggcacggcccgatatgcatgcccaacctgggccaccgcctccagtggtgcctctgccgcgtcgtgccggaccggctgctcgacgcgctgcgcctgcgcgagaacctgcggcagagggccgtcttccagcggctcaggtcgccgaggtcgccgtcccatgccaacggcggcaagcagagctagcttggtccaggctgcgcttgtttgtgcatactttgtgtagtactgtgtgtgatttgacatggatctgtggaccgcagttcggtttgagtcgccgttgatgcgcgcgcagctgatgcctgcctgtatctgcatttccgttggcaataaatcaaattcac

SEQ ID NO: 64 - DNA, 1498 bp, Hordeum vulgare
cggacgaggaaacatacaggtcgattgagcggacgcaacagcaggagagaggaaaccctaacgaagataccctgatcgattgtgcggcgcgccgtagatggagctcatcgaaagcgggttggcgctgatggacatctccatgggcgagtccagtacaaagacgaggatgaagagcattagagaggcggagttgaccaatctgaggcgcatcagagaatcgcaggagaggatccggaggaggcaggagcaacttcttcgcgatccacagccacctcttaggtacgagtttgaagaggaagaggagaaggctcctacagatgagcaggagactgaggagtaccgtaggatgtgggagatgtgctttcgcaacaatttcggttcaatcgacgcggaaacttctcttggtcccatttactgtactggaaccagcccagcagatgctcttccggagagttgcatgcagatcttctccatcaaagtcactgacctaaataatggtctcagcttgccactggaggttcacggctttgttgctgccagggactcggtagatcataaacgcaactatctcttcagatgcaccagggataactgccaaatcctcactccaaaggatccattcttgcacttaacaggcccctctcgggcagttctgttaattgcccgtgtcgcgattgaagttgagctaaaagtaaagggcaaaaaagagtctgaagatgaagtgttagctttcaaatggttttatttccacgaagggtatcatttagaagatgggatccgttttcgcatccccagcaagcgctgcatgcttgagtttgctttggcagtgctgcctatgtcagttgaggccattgtgggcatccgggttgttgatggctcatggcctgatcattgtcgggggttggttgtttgcagtaccaacagtgtaaaaaaagggaaagtggtgctgcttgattttcaaaatggagaactacctaccaagtcagatggtgtggttgagcttgcaaggagtgttgtttctattgattacccagagggagaactgactgtttctgtggaggcgtcgcgggatcgattttctgcacgaggtacagtcggctttgggatgaaagtgccaaggggaagtattactcgcacgtgtgatatggttttctgcaaaatgaaagtttcagtttcttggtcccttgtttcttgctatcgggtttaaagtccaaccttatctatttggccaaccttacccgtggtttgcccagctaagccattggactatttatgtatctatattgtcatgctttggtacctacctacctgttgtacttgattattcatgtttgcttcgatgtggtattactcaggctgctcaggtaatgagcatattagttggtgctactaaactttcccactccgctctaacgttatatattatctgtggtttatttgtaatgttgctgctacattgttatatatagcatgtaccagaactttgcggcaaataaag

SEQ ID NO: 65 - DNA, 1451 bp, Oryza sativa
gagaaaaagagttctctctcccataaaccttctccctctctctctctaaattctctctcctcctccactatttcttcctcccctttatctttccggggcgctgccggcctcaagtctcctcttccacccctccacttgctggtgcggtgctgcgggccgacgaggccgagaaggaattttggactttgatgagggagctgctgattgtgagtcaagaacagttgtgaagagtgagaagaaagctagagaagatcaaatggcagctgaatcctccctggttccacaaacctcctctgaatcgattgcgcagaagatgggcttcttcagggtccctgaccttcttgtcaaactgagcagcaaatgtttgattgagctggatgcagtccgcagcccaacatcgcccctagacctcatattcttcccaggcctcggtgccaaatcgccgaggtcgtctttccttggcgacagggttgggcttggactggtggattcacttactgatgatagctccactcccttgggcagcaggaaggttcttcttggatctgagatgaggattactgataatgtaacttccaagaacagcttcactgctcctgtcgaagctggggtggttgatcagaaggatgagagtatgtgtgatgacctgaagggtagtttcatgtctctggatgacattgtcaattcagaggattacacccgtgttgtttgtcgtggtcctaaccctaggacaacccacttctttggagatcatgttttagaatttgaaggtgagcagctgatgcctgatgagagtaagagtgaggagagtttgccccctcgtctggaagagggtatgatgagcttctgttatttttgcggtgagaaactcgaagaagggaaagacatctacgtctatcagggtgacaaagccttttgcagcatggagtgccgggagaatttcatggaagatgagatggaagaaggcgaacccgatctctctgcacctcctagcagcccagtcgccaacgatggttgtattttccaactgatccagtgaacgagcatcagtaaacaacttgatatggtcttatctgaagtgctgtccgaggttaataagttgcagccatggatgtgatcatatttcattgagttgttgcctgaagattttgtctgccgcggcactgatgaatttacctattgatttcttaattttacttacccggatcctcgaatttttggaggagcctgaacggtaactttgcttccggtcatattattattttggtcggaaagggcgtgcgtctgagtttgaatttgtgtttgcttgaacctcatcttcaatcggctgtcatgttgacaccattgatcactatcatgtatctgaatatatgtgcttctgctctttctggcagaaaggaagtgctaatcttcaagtttactaataaatgataatcatgatgtatctgtca

SEQ ID NO: 66 - DNA, 1021 bp, Zea mays
cgggtcggtgcctacccacccccgctggccgccgcacccaggcgaggcgaggcaaggcgcgtcccgaacaacggaaccaactgcaccgaccgagtcaatcaatccggcgagtgaccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggaggctgttttggttgctgcgataagactgtaaagcaactgggtgaactgtccagaaacttgatcacccaggaccaaattaccattggagagccattttggagcacaaccaccatcgaggttgaaccagcagatctcagtggtgttacttcagtcaatacatctaacttggcctctggaactggtagcagtcataaccttcctggacttggtaataatggacttgttctgtgggaacatacaaggcaggagtggactgaaactagaagtctgcggctgaaggtgaagcaggttcgtgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatgggataacatctgggataacacatagttgttcctcaagagaggggaaaaagaatgacatagagggtgtaggcttgggatgtggtgatgagttggcctgtcatacttgttttttgtcaatggaggcctgctgtacttgcagaatacagagctgtggttgtaagcttgtaagaagtcctgatactaatagtggctttgtttaatttgtcaaagaaaggtgtgtgaggttgagttgtgacaaaagtggattaggcctgctgatgggtttggattgaaatgagtttaaagggctgtgtttt

SEQ ID NO: 67 - DNA, 1265 bp, Hordeum vulgare
aagccacacgcttagcttagccttagctagctagcttactccacagtgcgcaaagcacaccacatcaacgatggcgactacgggcagccgtagtacactggttctggtctatctgaccgtcgcagtgctagtctcccctgccctgtccgcccctctggacggcgccggcttccactcggcgacgtgcccgcagctggagagcatcgtgttctcctccgtgcaggcggcgctccagcgggaggtggcgctcgccgccggcctgctccgcatcttcttccacgactgcttcccgcagggctgcgacgcgtccgtgtacctcaagggcagaggcacggagcaggccatggggcccaacaccacgctgcagccgcgggcgctgcagctcgtggaggacatccgcgccaaggtgcacgccgcgtgcggccccaccgtgtcctgcgccgacatctcggcgctcgccacccgcgacgccgtcgtgctctccggcgggcccaactacacggtaccgcagggccagttcgacagcctcgccccagcgtctcagaacgtcgtcaatggcctcccgtcgccggcgacctccagcgtatccgccctcgcgcgcgccttcagcggcaagggcctccgtgacctggccgacctggtggcgctctccggcgcgcacaccgtcgggaggactggctgcccgttcttccgtgaccgggctcagcgcatggacgacgccttctcccggaggctggcggccaactgcagcgcggccccgaaccggctccagaacctggacgtggtgacccccgacctgttcgacaacggctactacaaggcgctggtgaacagccagggcgtcttcacctccgacatggtgctcatcaaggaccgaaccacggcgcccatcgtgcagcagttcgcgcggaacaaggacgccttcttcgcgcagttcgccaagtccatggccaagctcgccaccgcgccgaggcccggcgggaacgtcggcgagatccgccgcaactgcttcagccccaacgccctgcgcgccatcgacaccgtcgtcgacgccggcgaggaggaaggattcacggcttctgcctgatttgcgtgcgtgcatttgctggcacgtgcatggcttcgtgtatgttagctgttaatttctgctcgcgtgtgtgcgtgttcgtgctttggatctgtagtgtaataagagacttcatcagtgagtcgctgagtgcttgcttgctcaaggttcaacatttcaatgaaatttcacctgctgg

SEQ ID NO: 68 - DNA, 816 bp, Hordeum vulgare
gtcacgccgtccagtcgtgctgcctactcaacgtagttcctcacctgcggagttgggtgggcgaaggcgagatcagaccaggagagaagatggcgcaggggacgctggaggtgctgctcgtcggagccaagggcctcgagaacaccgactacctctgcaacatggacccgtacgcggttctgagatgcacctcgcaggagcagaagagcaccgtcgcctcaggaaagggaagtgaccctgaatggaacgaaacctttgtgttcaccgtctctgagaacgcacgcgagctcgtcatcaagctcctcgacagtgatggtggcacagaagatgacagcgttggtgaagcaacgatcccattggatggagtgtatactgaaggaagcatcccaccaactgtttacaatgttgtcaaggacgaagagtaccgtggagaaatcaaaatcggtctgacgttcactcccgaggaggctcgggatgaggatcaacccgaggaaaactatggtgggtggaaccagtcatcttgagaagaagcggatgttttgctgagctatggtgcgtgacaagtcgtgtgctagaactaaagcttattttaattctttttaaggactgtatttatcgttgattccctcagtgctaagactctccttattttatttttttgaggggagactctccttattgattggtatcattttctagtattcaaaattgtaataacggtgttccccacttgtatgaagtattagccctctttaatgttcactaaactgatttgcaacagtgatggtcccatttcttaagagatagtaattcgtt

SEQ ID NO: 69 - DNA, 1113 bp, Zea mays
cgcctacagcgtcacggaacaccggcgaaccaaacctcggagaaaccctagcaaggccgcttgcccctctcaggcgcgacacagcatcggcgactagcgatgacaggatatcgcagccgcagtccgagccgaagctacagcccacggaggcggtacagccggagccctcctaggcgcaagcgctacgacgatccacgcgaccgctaccgctgggccggggccggcggaggcggggaccgacgtggttacggtcggccgttggcgcagtccggtctcctcatccgtaatatctccctcacagccaggccagaagatattcgagctacatttgagcaattcggccctatcaaggatgtttacctgccaaggaatttccacacgagggaacttcgtggttttggatttgtcaaattccgctaccctgaggatgctgcagttgccaagcgtgagatgcatcatcaagtcattggtgggcgagaaatttcaatagtttatgctgaggagaatcgaaaaacgccacaagaaatgcgcatgagaacaagaactagtggtaggtacatggatgaaagatacacaagactgtcaagatctccaaggtctcgttcccactcttattcaccaccgccttctccagttaggcgtgacttcaggggcagggagcgcccggatagttattcccctcagtactcgcactctccacgccctcgggacagcaggcaccacaggtcagatggtcgctctccaactccaagcctagatgaccacaaacctaaggcgacaccagtcaatggtggacatggtccagcagttgcatccagatagtatgatgccattatggatgccttgaattgtgttcggaggctggagactgcagactatcttttcaccaatcttctctaagagatgagtagggttgtagtaaacagatacttggtagttgtattacaggtgatggtttcggttatgaggtgcgctgttgcttttgtgacgctgctttaatgctttcccaaccgagggtagtagggtaccgtcgtggaattttgcgtgtttgttttttggctacaatattactaatactagtaacttgctcgcttcgagcgcgagtctttatct

SEQ ID NO: 70 - DNA, 2175 bp, Zea mays
cttcacaacggacgagaggcgtcagacaaaaaatagaatctggttgctcatctcatctcacgactcataaaaaaatagcgtcttttatcatatccgttgctcgcaaaacgcccccacacgccgccggcgaatcggcgactccccttgcgacgggaggaagcagccacgccgccgtctcggcgactccctgacgactgcctctccggtctcgaacgcgatctggcccatggtggctctggcgccgttggttcgtgagatctagggttgtcgagcgccgcggagtgggagcggatggggcgccggaagatgtccgcagcggcgccgccgtcccggagctggtccaacgttggcgggagcgtaatccccgaactacttgcaaaacacaaaatggacttggaaaatttgacgctgacaaaacatccaatcagaacattacattttttcctgttagccatgttacaatacttgaaaagattagcaacatatatcctgagaaagagtggtttgttctttctcttaattgttttggtggtagcttccggaatcttactctctatttcagatggcctgcataagaagcatgtgcaggagttccttaattatgctaaattcgtgttgtggtggatttcattaggtgtggcttcatcaattggactaggttctgggttgcatacatttgtgctgtatctaggtcctcatattgctctgttcactattaaagctgttcaatgtggccgaattgatttgaaaacggctccatatgataccatacagctaaaggttgggccatcatggctcgacaagaaatgttctgaatttggtccgcctgtgtatccagcatcagctcattctgttaggatccccgtctttgatttactacctcagatacagctggaagcagttctttggggcattgggactgcacttggcgagcttcccccttattttatatcacgagcagctcgcttatcaggaagcaagtcaaaagctgttaaggagcttgatgccgctacttccaaagaagatgggacagtagcatccactcttgatcgctccaagcgttggcttctttctcactctcaacatctcaacttcttctctatcttgatacttgcttcggttccgaacccactctttgatctcgctggaattatgtgtggccaatttggtgtacctttctgggagttcttttttgcaactttgattgggaaggccatcatcaagactcatattcagacgctgtttatcgtgtccttatgcaacaaccagctcctgtatcttatggaaaaggagctaatctggatattcggtcacattcctgggttttctgctaccctaccatctgtgattgccaaactccatgctgccaaggacaagtatctatcaccaccgacaccagtctcggcgtcctcacagatggaggagaaaagttggaatctctcttttacattggtttggaactctatagtgtggcttgtgcttctgaacttctccgttaagataatcacgtcgacggcacaggattatctcaaaaagcagcaggatatggagatggaacgcgtttctgattctccgcccccggaacaaaactaactagcggcgcaagtttatttcagctgctagctgcacagattctcctctgcatttttagcaactggttaagcgtctgcagacgattccaagttccaacgattatcaattagtattagtagctattcatctacacagtcaacgaaaacatgggcctggcaactggccgggtgatggctgtgacctcctatcatatcattgagcctgtagtgggcagttcctggaggagaattctactgttcttttttgtttttccggacatctacacggatagacagtagggattgtttgtgtgaagcacggttggcttatgccgagatttagcactggtagatgtttctatttgttttggaaatgctatagaaacatgtgagcattcaacaatgatacgctctgttaagtttgttgtgtattttggtttgcaactggtgcccgaaagagcaaacagtggctccatcaatttcctttggcaagtaaaaccccctatagaagacattgcttgtcctaaatcttgtccgctgaagcatgtagggataagctgtatttgagtgtttgtatttgtgctgttataagtgtatagtaatt

SEQ ID NO: 71 - DNA, 1610 bp, Zea mays
cagaaggggaaccccctagctcccctccgaaacgaagcaaactcacgagctcccgccaaattaatctcctccatccataaatacgaatttcgacgcagaagacgacggagcgtcgatccatctcgatcgatcgagttgttcgtccgtcgcatgcaacttgcagcaggcgccttcttcttcggcgcgacgaactagctagctaggaccccatccggcggtgcaccatgctgcggtccaccggcgaccgcgtcgtcgtcgtgggcggcggcatcgccggcgccctcctcgccaagacgctccagaaccacgccgacgtcgtcctcatcgacccgaaggagtacttcgagatcccgtgggccaacctgcgcgccaaggtggacccggcggcggtggagcgcacggtgatcgcgcactccgactacctgacgcacgccaaggtggtcaccgcctccgccgtcggcctggacgactccgtggtgctcacctccatcggccgcgccgtggcgtacgacttcctcgtggtcgcgacggggcgcacgtgcaaccggccgcagaagcggtcggaccggctggagatgttccagcgcgacaaggaccggatcgacgcggcggagtcggtgctgatcgtcggcggcgggcccatcggcgtggagctggcggcggagatcgtgatgaagagccccgagaagcgcgtcaccatcgtccacggcgcgccgcggctgctcaaggtcatgggcgcccgggcgtcggccaaggcgctcgagtggctgcggtccaagaacgtcaccgtgctgctggaccagacggtggacctggcgtcggccaccccggacacccggacgttcaccacgtcggcgggggagacgctggaggccgactgccacttcgtgtgcacgggccggcccgtggcgtccggctggctcggcgggacgatcctcggggagcacgtggacgaggagggccacctccgggtggacgaccacctgcgcgtcggcgggctgcggaacgtgttcgccgtcggcgacatcacggacgtgccggaggccaagcagggcaacctggcgcagcggcaggcgatggtggtgtcccggaacctccgcctgctggtcaagggtgccccccgggaggagaagctgcaccggtacaagccgtccccgaggacgtccatgaccgtgacgctcggccagcgcgacgcgctggcggagctgccgttcatgacgctcatcgggcacatccccggtgccgtcaagccacgggacctcttcatcacgaggacgcgcaggatgatggggatcaagagcaaaccctacggcacgatgccgcacgtcatgtgagggagatcccatctatcgacgatgacgtccccggccccggtccggcgatccttcaattccgatgaccaaacggagactagctagctaggctgaggctctgtctctggattttgccacgttctagttctagctgatcatttgatctggtcgtctgagatgtacgcttggtgttatgagtgaacccggaatatggaagcacgatcacttgctatatgtattatacaggtacattctggacagtatttttaaagggagccgtttacctttttttaccta

SEQ ID NO: 72 - DNA, 929 bp, Oryza sativa
gtcatcgatcgtggcagggaagtccggagttggaagcgatcgatggcggctactacgacgggacgagttgttgcactcggcgcggtggccgtggtggtggcgctgacattcctcgccggcggcgcggacgccgactgctacgacttctgcttcaaggactgcatggccagggagaacaacatggtcgactactgcagctacgcctgcgacaagacgtgccagccggacaagcccacgctgtactcgtcgtcgtcgtcgtcccgcctcgccggcgacatggagtgccaactctcctgcgccttgggctcctgccaccgcctccttccggacggcaagggcgccgtggaggcctgcttcgggcagtgctacgacggctgcaagaccacggcggcggccagactgccgaggcctctccgcgccggccactacgtgctctctagtccccctgatgacgtagaccatgatccggaccaccgctacgtgttctctagcccccatgatgacgtagaccatgatccggaccaagtgttcgctagtccacctgacgacatagaccgccatgtattcgctgctcctcctgatgttctcgctgctcttcctggtgagccggaccacgcctgacaaaactgatcacacaacttcgctacctgctgcgaacgaataatctagcgctgcatgcagcagcagcatgcacacatgtgcacactaattatatgtcatatgcacttctatgtcgcaatatatgtatatgttctccatgtaaagatagcgtagtagcgtgtgagtgactgtatgcgtgcagaaggccggattggtccactactagactgcttgctatctatgtgtaagcgaaagttcagagatatcactgctcatttgttttcttctccttctctgcattgacaacaaattgtgttctgaacgagacc

SEQ ID NO: 73 - DNA, 1709 bp, Oryza sativa
gccacgcccaccgtccggattggccccgtcgcactcacacaacttgtgtgcagccctgacacacaaccgcatcagatgagagctcccccggaaaaagcaaagccaaaaaaacccccgagattttacagccataccccgcacaccacgccacgcagatcttttctcctcttcctcctcctcccttgactttcccccacggcgaggcgagggcgcgaggcggcgatcaccgcgtccaagccggcgatggagggcgcggaggcggaggagcggaggctggcggcgtcgctgacggcgcggtactcggactgggtggtggaggcgctggacgagctcccggggagcttcatcctcaccgacccggccatgccgggccaccccatcgtctacgcctccagggggctcgcctcgctcacggggtacccgccgcgggaggtgctcggccgcaacgcgaggctcttccagggcgccgacaccgaccgcgccgcggtggccggggtgcgggaggccgtgcgcgggcagcggccgcaccaggtctccatcctcaactaccgccgcgacggggaagcccactgggtgctgctccacctcgcgcccgtcttccacgcctccgacggccgggtgctccacttcctcgccgtgcaggtgcccatcgcgccgcccgcgtcccggcgccgcacgccgccgtgccgggccgcccgcccgttcgtggtgttcgcggcgtgccgcgaggaggccagggtggaggaggagtgcccctgcgcgagccacgcgggggaggtgttcgtggatgtggataagagagggcaggatgctgaggaaccgcgggtagctagcgaacatgagaaagaaaaagcactgagtacagctaacagcatcttctctgcgttgaaccgctacagcaaactcactggtctagtggtctgcgggaagagatgtgattctgttggcatcccagcactcagttcttcattaaatctttctcttggtagaatcaaacaaagctttgtattgactgacccccatttgcctgacatgccgatcatctatgctagtgatgcttttctatcactaacaggttactcaagagaagaaatcttgggctgtaactgcagattcttgaatggtcctggcactagtgtggaggttttagaacagataaatcaacatatttgttctgagcaagcttgcacggttcatctactaaactacaggaaaggtggaagctcgttccgtgatcttctacatatatctcctatacgaaatgcatcgggcaaggtagcatttcacgtgtgggttcaccttgatgagggtgcaaagtatgattttaatgggctgacccccgaggtatggcagcttggtgctgttggtgcggtgagagtggcagtcagaagcttgtctgcgtcaggaagcctgttgagaccgtcccaatagcattatctagtttcttgccattttatgacttgtcgacttgccaatgtacattgagttgcctgttgtctgtaaagtaattgcttggtggaaaattttcagctcatttgttcgcgtaaaaaggcgaggtgggtattacatgatggttgtgatttttgtaaatacgcaaaacgaagggaatgggggaaatggttcgtttccatatgaagagaagtggttcttatgacagaactcttacatagcaacagacctttttaaccatgtagcattgacattacagg

SEQ ID NO: 74 - DNA, 1262 bp, Oryza sativa
atcggtcggtctcggtcgctgccgtccctgtgcttggagtagacacgagccggtgacgcgcatatcgtcttctgctcgagatcgatcgatcgatcgcttggttggttgctgcgactgcgagggaggccgcgggtggtgaggaggattgtgcaaaaaaaatggggcgcgcgccgtgctgcgacaaggcgagcgtgaagcgggggccgtggtcgccggaggaggacgagcagctgcggagctacgtccagagccacggcatcggcggcaactggatcgcgctcccgcagaaagcagggctcaaccgctgcggcaagagctgcaggctccggtggctcaactacctgaggccggacatcaagcacggcggctacaccgagcaggaggaccacatcatctgctcgctctacaactcgattggaagcaggtggtccatcatcgcgtcgaagctccccggccggactgacaacgacgtcaagaactactggaacaccaagctcaagaagaaagccatgggcgccgtgcagccgcgcgccgccgcctcggcgccgagccaatgcacgtcgtcagcgatggcgccggcgctctcgccggcctcctcgtccgtcaccagctcgagcggcgacgcctgcttcgccgccgccgccaccaccaccaccaccatgtacccgccaccgacgacgccgccgcagcagcagttcatccgcttcgacgcaccacccgcggcggcggcggcggcatccccgaccgacctcgcgcccgtgccaccaccggccaccgtcacggcggacggcgacggcggctgggcgtccgacgccttgtccctcgacgacgtgttcctcggcgagctcacggccggcgagccgctgttcccttacgccgagctgttcagcggcttcgccggcgcggcgccggacagcaaggccaccttggagctctcggcgtgctacttcccgaacatggcggagatgtgggcggcctccgaccacgcctacgccaagccacagggtctctgcaacaccctgacataggaggacacgctaaaacctccattgaattcttgcgtagctgcgaacgcaacggcgatcgatcgatgcgtcgccacttgctactagcataattcttgctctcttttttttttcaatttttttctcttcttcgagtggcccattctctagctggcgttttctcgtgtattatgagtgatcgattattacatgtaaattaatccatagatgtatctgcactgatccaaattctccagc

SEQ ID NO: 75 - DNA, 1502 bp, Oryza sativa
ctttccctttgattcctccgttgctctctctactacgcgtgggacatgagggagacgggcgcgacggatgaggggcacgcgtgcgaagttgtagtagccggaggtgacggcaaggccgcggcggcacgccggcgccgacgtctcgagctccggcggctcgggctggcggcggaggatgatgcggcggcgaagagaatccggtcggtgaaggacgggtcgtcgtctgatgactcgtcgacggaggttgttccccggagctggccggcgtgcgtgtcgcacggctcggtgtcggtgatcgggcggcggagggagatggaggacgcggtggccatcgagcggacgttcatggcttcgacgggggatggtgcgggcgctatcaggggcggcggggagggcgaggaggacttcttcgcggtgtacgacggccacggcgggtcgcgggtggcggaggcgtgcaggaagcggatgcacgttgtgctcgcggaggaggtgagcctgcggcggctgcgggggcagagcgcgtcgggcggcgacgtgcgctggaaggaggcgatgttggccagcttcgcgaggatggacggcgaggtcgtcgggagcgtcgccgccgccgccccccgcgtcgacggcaccgagccgtcggggttcaggacggtgggctccaccgccgtggtcgccgtcgtgggacgccgccgcatcgtcgttgccaactgcggcgactcgcgcgccgtgctctcccgcggtggcgtcgcgctgccactctccactgaccacaagccagatcggcctgacgagttggaacgagtggaagcagctggaggcagagtcatcaactggaacggttaccgtgtccttggtgttttagccacttctagatccataggcgactactacctgaagccgttcgtgagcgcagagccggaggtgagggtggtggagaggacggacaaggacgagttcctgatcctggcgagcgacgggctgtgggacgtggtgtccaacgaggtggcgtgcaagatcgccaggaactgcctcaacggccgcgcggcctccatgttcccggagtccgtctccggcagctcggccgccgacgccgcggcgctcctcgccgagctcgccgtctcgcgcggcagcagggacaacatcagcgtcgtcgtcgtcgagctcaggcggctcaagagcagggcagcttgagcttcgacatcatccgcgatggaggcggcacgtcgctactaattaataagctactagtagctccctgtacattacgtcgatgatactattaatttgggcatcgcgcggcgagacgccggaattaaacggttccggcgatgaaggtttcgattgagaagagatgatcgattctgtggtttgtatagatgtagtagtcggatgtgttggactctcgggtctgataattatagcatccaatgcatgcactgttagatcttcagttaattatttcttgctgcatcgtgcggtgaggtaaactggcttacgttcat

SEQ ID NO: 76 - DNA, 2062 bp, Oryza sativa
aggctaaccaccctcgacgtttctctccctcgattcacggcaacctctcggagcgtggtcgcagcaacggccgcggcgttggtggcaatggaacgcccaatctccatgcttcttcttgctgtcgaacaccagatcgcaggagacaagaatcagtgagcatgcatcatgtcgtccaacatgttcggcaagaaagggtgggactcgaatgggatggatacatctggttctgtctgcagaagttcttcagatatcaattacattaatcaacgggcaagattgaagagtgcgagcctaaactgtgtgggttcgccgccaaggaagaacaacaatgctacacagtaccggatgtttgttgccacatggaatgtgggaggaagaactcctaataaacgacttaaccttcaagactttctgcaggttgaagaatctcctgacatctacgtcttagggtttcaggagattgtccccctgaccgccggcaatgtgctcgtcctcgaagacaacgagccggcggcgaggtggctggcgctgatccaccaggcgctgaacatgccccaagaaccggccgacggcgacgagccatcgcctttgacgccgccgccgtcgtcgtcgacgacgacgtcggagtcgtcgaacggcgcccggacccggcggcgcgacgccgtgtcgaggtcagccagcggcaacctcttcttccacacgccgtcgctcaagatgctcagcaacagctaccgcgtcgacagcgcgctagtcaagacgtgcaactgctcgccggagcactcctccgtgcgccgccgtgccgcggaggtgcgcgagtccgtgtacctcgccgacgcacccgcgccagccggcgagacggcggcgccagctgccgacgaagacgacgcgccgacgacggaggcgcagtgcgaggcaggatgcggcggcggcggcggcatgagctactgcctgatcgcgagcaagcagatggtggggctcttcctgtcggtgtgggtgaggaaggagctcgtcgagcacgtcggccatctccgggtggactgcgtcgggcgcggcatcatggggtggctcggcaacaagggctgcatcgccatcagcatgacgctgcaccacaccagcctctgcttcgtctgcagccacctcgcctccggcgagaaggaaggcgacgagctgcggcgcaacgccgacgtcgccgagatcctcaagagcgcgcacttcccgcgcgcctgccgcccggcgcccgccgccgcccgccgcgtccccgagaggattcttgaccacgaccgaatgatctggctcggcgatctgaactaccgcatgtcgttaagctacgacgagacaagaacactactggaggacaacgactgggacgctctactggagaaagatcagctgttgatcgagagagaagcggggagagtgttcagaggctggaacgaaggaaagatctgcttcgcgccgacgtacaagtacacgcacaactccgacgcgtacgccggcgagacggccaagtccaagaagaagcggaggacgcccgcatggtgcgaccggatactgtggcagggagacggcatcgagcagcttcagtacctgcgcggagagtcgaggttctccgaccaccggccggtctgcggcgtgttcgccgtcgaggtggacggcggcgatggcgacggcggcggcgccgccggcaagatcatgaagggttactactccctcaacgcccggatcggcggtgacagatcgcagtgtcaccagggtgacgtgtcgtgaactgattatatatttcatccccttttgcaagtttgcaatgatagggtcttgtgtataagaaggtttattaccaagaacagaggatattgtagatactagtatctgacaagaatcccatgactgaaattagtacgagtactgactaattaagaatacagtaattttcgtaatttgtagaacctgtctagctgtatggttatttttgtccacttatatgaaccccttgggcagagaaagttgtctcgtatatatgtatagacaaattatgtactcgttatattgttatatttttttc

SEQ ID NO: 77 - DNA, 1064 bp, Oryza sativa
caacccgttcacacctcaccgagcgagcagctagctagctgcggcgatggcctccagagcggcggcggtcgccgtcctcctcctcgccgtggcggcggcgccgctcttcgccgcggcgagcgcgcatggccgaggctaccttggtgccaagtcctggcctcctgacggcagcctgagctcatcaagctccggcgaggctgcagcggcggacgtcgacgacggccacacggactggaagtgctactcctcctgcatgagcaagtgctgtcaccgccacgacgacgacgacgacgacaaggccaatgccaaggccaacgccaccgccggcgccgccgccgtcgggctcgacgatgactacaagtgcaagaagcagtgcctcggcaactgcttcaaggacgtgccggccgtttgctaccacaagtgcgtcgacgactggtgcgcgaagctgccaccatatagctccgcgaaggtgcagtgctacaagaagtgcggcgataaatgcttccaccacggcccgaagcctgggcccaagcccaagcccaagccgagcccaccaaaacccaagcctggaccgaagcctaagcctcccaagcctgggccgaagccgaagcctcccaagccagggccgaagccgaagccgaagcctccaaagccagggccgaagccgaagccgaagccgccgaagcccgggccgaagccgaagccagggccgccacagccctggtggcctataccattcccgaagccgccgtgtccccccggcgccgacgggtcgtcgtcggcggtcgacgacaagaacaactgatcacacatcatacctaaattatacatatgattaatttgagatcaaagaatttacagagtaaatacagccagggcgacgtctcattgctgcaaattaactattgtatagatggcatatgcacggtaattgtcaagtgatctatctgtaaacctggcatatcagcatatgcatgcctactcctatggatgaattctatacgtactttcgttcaaaaaacaattctatatgtattgaattggggaccgtgcgtacacacact

SEQ ID NO: 78 - DNA, 1859 bp, Oryza sativa
tttttctactcttccccttgcttcgcttcgctcatcagcttgaccgcctcacctcaccaccccaagctagacgacctcgtcttcctcctccacctcctcgcgacctcgcattgttagatcagcctcgattcatctccaatctttcggcgccgctcccggagagagggacagcggcgcaggcggtgagcacgaggaggagcagagctaatcaaaagccctctcgccgctcgagctctcgtgcaccgtgccgccgccgccgacgccgacgctgacgccgacggcttaattcagtcttgtcggctacatctcttggcgtgctgaaattggtgggagcacgagagcggcgccaatggggacgaggccgtgcgccggcgtggcgtcggcggtggcggcggcggtggccgttctgctgctcgccgtgtcttgcttcgccgcggcggcgacgacgacgcagaagcatggcaggatgtcagggaagggcggcgacgtgctggaggacgacccgacggggaagctgaaggtgttcgtgtacgagatgccacgcaagtacaacctgaacctgctggccaaggacagccggtgcctgcagcacatgttcgcggcggagatcttcatgcaccagttcctcctctccagccccgtgcgcaccctcgacccggaggaggccgactggttctacacacccgcctacaccacctgcgacctcaccccgcagggcttcccgctccccttccgcgccccgcgcatcatgcgcagcgccgtccgctacgtcgccgccacgtggccctactggaaccgcaccgacggcgccgaccacttcttcctcgcgccgcacgacttcggcgcctgcttccactaccaggaggagcgcgccatcgagcgcggcatcctcccggtgctccggcgcgccacgctggtgcagacgttcggccagcgccaccacccctgcctccagccggggtcgatcaccgtgccgccgtacgccgatccccgcaagatggaggcgcaccgcatcagccccgcgacgccgcgctcgatcttcgtgtattttcgggggcttttctacgacatggggaatgatcccgagggcgggtactacgcccgcggcgcgagggcgtcggtgtgggagaacttcaaggacaacccgctgttcgacatctcgacggagcacccggcgacgtactacgaggacatgcagcgggccatcttctgcctgtgcccgctggggtgggcgccgtggagcccccggctggtggaggcggtggtgttcgggtgcatcccggtgatcatcgccgacgacatcgtgctccccttcgcggacgccatcccgtggggggagatcagcgtgttcgtggcggaggaggacgtgccgaggctggacaccatcctggcgtccgtcccgctcgacgaggtcatccggaagcagcggctgctggcgtccccggcgatgaagcaggccgtgctgttccaccagccggcgaggcccggcgacgcgttccaccagatactcaacgggctcgcgcgcaagctgccgcaccccaagggcgtcttcctcgagcccggcgagaagggcatcgactgggaccagggcctcgagaacgacctcaagccatggtagccgccatggatgatgagctatatacacacagattatagagacgagacatggattggatcgcgagagatgtacattgattggttcgtttcttctgattaagccgctgttaatttcttcttctttctttcttttttctagttttttttccttgttgttttttctttcaaggaggcgatccgtgttcatgtattgtgcaattgtgcgtgcttaattaatcgttgcaatgtgcacgatttcttct

SEQ ID NO: 79 - DNA, 1776 bp, Oryza sativa
gatatatataccacctgccaccccttcttctcctctccacccccctctctgcttccctccacactgcctcgccaaccaaccaccgctacacacgaggcggcgcgtggccggagagcgagaaaaggcgacgtacccatcgatagcgagaaattaagttgccggagaggaggaggatgacgatgaggttggcggcggcggtggtggtgatggtggtggtggcggcggcggcgatgtcggtggaggcggagctgagcgtggattactacaagaagagttgtcccggagtggagaacgtggtgaggtaccatgtcgccaaggcgctcaaggcgaatcgcaaggaaggcgccgccctcgtccgcctcatcttccacgactgcttcgtcagggggtgcgacgcgtcggtgctgctggacccgacggcggagaacccgcacacggagaagacggcgccgatcaacatcggcctcgccgcgttcgagctcatcgacgagatcaaggcggcggtggaggagcggtgcccgggcgtggtctcctgcgccgacatcgtcatctacgccgcccgcgacgcctccatcctcctcagcaacggccacgtccacttcgacgtcctcgccggccgcctcgacggccgcgtctcccgcgccgccgacgcccagcgcgacctcccggactccaccttcaccatctccgagctcatccgcaacttccgccgcaagaacttcaccatcgaggagctcgtcatcctctccggcgcccacgccgtcggcgtcggccactgctcctccctccgcgcccgcctcaccgcgccacccgagcagatcctcccgggataccgcagcctcctcgccggcaagtgcgccgccggcgaggacccgatcgtgcccaacaacgtccgcgacgaggaccccgccgccgtcgccgccaccatcccgtccttcctcccgaagctgaggaagttcgagttcttggacaacagctactaccacaacaacctcgcgaggatcgtcaccttcaactccgattggcagctgctcacggagaagaaggcgcgcggccatgtccacgagtacgccgacaatggcacgctctgggacgaggatttctccgacgcgctcgtcaagctcagcaagctgccattgccgcccaaggccaagggcgagatccgccgccattgccgccgcgtcaacacccaccactactgattcttcatcctcatcatcccaacatcaagccttccatcttgagctctcatctgcatcctcattttcaataattctttgtttcattattcgcatggttggttcatcatcgtcgtttaattttgtgtatcttgttcttttttttgatttgttggtgctcgtcgatctcgtgttgaattggtttaattttgtgttgaattctacgcgcatgtgtatgtgagaacaccagtacagcgagaattcatggtgtatagtagcttttgtgttgttgcattctctgtctattggtgtcaaaaagaaagaaagttaattagttgttgtttttttttttggtatggtttggattggatttgtattcatccatccaaaactttctccattttcatgtaataaggagggattacagaaagatcgatatatggcactggccacttcaattatgttccatttccagttttaactgtgatgagcaagccctactgtcattgctagtccagatcctctgtttttaatggatgtcaatttgcttctagcaaaaaggaaacatgaaatgaaaagaaaagaagcacaaaattat

SEQ ID NO: 80 - DNA, 2065 bp, Oryza sativa
gactcgtctcctcgttgctcctccctaccctagtcgatctccccttcgcctcgtctccccgtctcctcctcgcgagctcgcccgcccgccgcctgcgccgagcaccgccgatctccaccccggcgagcagtagcggcggccggcgtcctgctgcatcccgccgagaaatttgggggttcagctgaaccctctatgcgcgacgatagatccgcccttggggagtagggaagggaggtgaggtgaggtgaggagataggaggagttgagaaggcgctgattgttgggaggaggaggaggaggaggatggtggaaggccccaagttcgccggcatgatgggcggcgtcgtcggcggcgccggcggccatgacgacattggtgggaatttctgcgacatggcgtactaccggaagctcggggagagctccaacatgtcgatcgatagcctcaatagcctgcagaccagcacgcatggcggtggctccgtggcaatgtcggtggataacagcagcgtcgggtctagtgattcccacaccaggatgctcaaccacccgggcctcagggggcatgtcgcagccaattactcggttgggcacagcattttccgccccgggcgggtgtcgcatgcgttgagtgaggatgcgcttgcacgggcactgatggacccgaggtacccgactgagacgctcaaggattacgaggagtggacgatcgatttgggtaagctccacatggggatgccctttgcacagggtgcatttgggaagctatacaagggcacctacaatggggaggatgttgccatcaagcttttggagaggccagaggcggatccggagagagccgggctaatggaacaacagtttgtgcaagaagttatgatgcttgcaactttgaggcatcccaacatagttaaatttattggggcatgcaggaagccgatggtttggtgcattgtgacagagtatgcaaagggtggctcagttaggcagtttctgatgaagaggcagaacaggtcagttccattaaagcttgctgtgaagcaagccttggatgttgcaaggggcatggcctacgtccatgctcttgggttcattcatagggacctcaagtcagataatctcttgatttctggcgataaatcgattaagatagcagactttggagttgccaggattgaagtcaaaaccgaggggatgacacctgaaacaggaacctatcgttggatggccccagaaatgattcagcacaggccatatgaccagaaagtagatgtctatagctttggcattgttctatgggagctcattactggcatgctccctttcgctaacatgacagcagtacaagctgcatttgctgtggtgaacaagggtgtccgtccagccataccacaggactgcttgcctgttctcagtgagatcatgacaaggtgctgggatccaaaccctgatgttcgccctccattcaccgaagtagttaggatgctggagcatgctgaggtggtgatcctgagcacagtccgcaaggcccgatttcggtgctgcatctcccaaccgatgacaactgattgaatgagacaacagagagttgcgaagaccttgatggaaggaagcataatcgagtgtatttatcacatgttagactctgcgccgctgaagtagaaatccaacttgagtgtacgactgagttatatactcaggtgtaaggcagttctatattcaaaatatttctctcttagagtggtgttttcagactgctttggtgtgttaggctctatccttttgtcgaaacatcatgcagatttccttttgttgtaactgacgcatgttcctgctgctttatgcctgtgttatataatccccctgctggaacatgcacaaactttgctgcgttcagagtatatagtatgtacaatttgaaatgttcccgtggcagagttctgctaatgccaagctttcggttaatcttccttacccgtttcctagattcagctcctagttactggctgagtttgtagtgcctgccattgatgaatacacaagctgtaaaatgttctgtgagatt

SEQ ID NO: 81 - DNA, 1785 bp, Oryza sativa
attgaaaaagacgagggcctagtagccatcgtcgatccccaagtctccgcggcggaggcgctcgcgtcgcgaccccgtcgccgccgccggcgatccgctccagccgaaccccgccgcaccgccgcggtagctgccgtcggcgaggtgcgtctcggcaccggactccaggaatcgtgctgctgctggaacgccgcgcccgctcagccggcggccgggcgtcccgcgtggctcgctggcatcgatcggggatccctcctacgggctcgccgtcgcggaggtttcaggggaccggcgcttggacacgctctttcctcatcaatctgctgacgttttgaaatattggaatgcttctgtcgtcgaatttggttatctacagcatctgaattggttataacttataacttataagtggcatgtctgcgaaggttccaaggcgcctagaagctaattccgttgggatggcagattgggctggtcttcagactgatatccttggtgtaattgtaaagaagcttgccgtccctgactatctgagattccgtgctgtatgcacatcttggaaccatctctgtagggatgtattcaactgtccaaggatagacccatggctgatgctccctacaaatgcgcttaatgattctaaatttttgtgtgtacctgaaaggaagaaccaaaccattcgtctcccgagcactgttacaatctttggctccacctggattcctgttggttcttcccatggttggctcatcttttacagcccatctcatggaaccatgcagctggttaatcccattagtggcatgcagttcaatcttcccccaatcggacgaagggccttctccaaggccatgttgcttgacatgaatgacacaaacttcactgttgctgtcatcttacgtgaccagaaaggatataaggtaacgcgtaaaggaagcaacagctggtcatcagtggaatcaaagcatgatctagtggatatcttcaagcacaggagacagctttacaccgttgatatatatggcacagttcagttgtgggcagaaccgccccgttcatggccagatgaagatgccccgcaggtgaatgacccgtatcataacctcattcactatccgcatcaacatggaaagcttaactgtttggtggagtccccagctggtgatctaatgagggtgaagcggcaatcaaatgataagtttgtggtctggattctggacaaggggacattttcctgggagaaggttgataacatcggggactttgcgctgtttgtcagctactacagctcggtctgttaccgggcgaaggatcatctcaacctgaagtcgaattgtgtctacttcattgactcctacagcaacctgtgcgcattcaacctggagaacaggacgaaggagctcgtcgaagctcttgagcccgcccatgcccacggtcatccagagcctcacgctgtccggcgcaggccggaaggacagaggtacatgtggttaatcccttcgctgagataaaccaatggaggatgaaagctacggtacacatccccgttgtctctgaacttactacagtatatgtgactgtcgctaatttcataaaagtattgggcatatctatagcacttctgtagataaatcaactgtctgaactttggacaactcgtggtttgtgattatcgtgtattttgtaatatatatatatatatatatatatatatatatattatataagttatccttgtccaaattgtttaaattatcatcacccggtcagaaattcagaattgta

SEQ ID NO: 82 - DNA, 1920 bp, Oryza sativa
tcgatcgagagcctatttaagcttcgccgccgcgttaatccctctttcctcctccaaattaatctcatcctaattctgttttaatttctggtgggaatttcgctgtttgatctggcctcttcacgtaaccgtaatgttctatgtgtaaattgaattaatggagttggttgtgaaatcgttgaattgatggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtggcggcgaagccgattctgccggcgatggatgcgccgagcctgcagaaccagatggagaatcagctgacaaggaactgcatcggcgcggcaactccggtgacccccaccggaaacctcgccggatcaggtgcgccgagcaagacgcggatcaggtggacgcaggacctgcacgagcggttcgtcgactgcgtcaatcagctcggcggcgcagacaaggcaactccgaaggggattctgaagctgatgaattcggatggcctgacgatctaccacatcaagagccatctccagaaatatcgcatagcgaagtacatgccagcgtcatctgaagggaagcaactggagaaaagagcaacaggaaatgacatgcagaatctggaccccaaaactggaatgcaaatcacggaagcactgcgtgttcagctcgacgtgcagaggcgcctccatgaacagctagagattcagagaaatctgcagctgaggatagaggagcaggggaagaggctgcagaagatgttcgaggaccagctgaaggcgagcaggagcgtgatggaaccgcaggagctggacgacgtcgtcgccttcgccgccggcgacggagacgacgacgcgttcgatgacgtcgacgtgcagctgctggccgtcgctggcagcggctatgacgacgccgggttccagtccaaaataagctaggacagccttttttgcgttttgtgttttggcactttgatttgacaaatattgttctggttcttcgacgtatgatacgcacaatgctattttttgcccgtgtagttggcgaaagtttcaaaaagatattttaagaaagagagtgggatccacagattcgcgcttaatttttttttttgtagctagtttgatcagagttgtaaaatttaggctttttcaattggcctgcactgcatttcttaatggttttagttaggtcttagcaggcaaaaaacaggttaagttcaagtggcaatatattgctcatgtcacattcacatatgggcttgggatgctctacgtgtaccaccatgacaccatcctacgcagaaaaaggaaattacaaaatggatatcaaccacagaacgcaataatgctgttgtggattgtct

SEQ ID NO: 83 - DNA, 3162 bp, Oryza sativa
tagcatttcattttttagaagagttcacaaacaggagtagatacaagaacattcaggatgagtgttgatccattccggttctatgtgtaggaagaggaataatggcatgcattagtcatgtcttgagcaagagttggagtgctgctgccacagtagtcttctcctttttgttctctagcatttggccataagccatagttctttctcgagctgttgttgctgcaaaggcattgtcgcaaagtcatgaagaatttgatgtggcaattaatgcctatccggagaaagagttgaagcgactggttttccaggatttgttgcatttattcgctcataagaaacggcaagagagagagagagagatagagagaggggaagcaagaagaggctttgaaagatttttgagtttgaatttcttgttcttgtgggcgtgtgcgtgtggagcggtggaggcatgaaaggcggcagctccgccaccgcggcgagcggcggcggcggcaacagcctggcgatcgtcgagcggcagaagccggcgacgtcgtgcgtggcgtcgctgttccagatgctcgccaagaagaagctcttctcctcgtcctccaagaagaccaagctgcttcccccagtgcgcacacagaagttctcgcctgggagaccacctgccggcggcgagaagacgccggcggccaagatgaggactctgctgcttgatgctccatactatccaaatgaagttaccactcgcttgccacctcctggccaagacaacaaaagcagtgaaatgtgcacaccgggtgtggtagccaggctaatggggctcagcgcaatgccagccaccagccatcaaaaggcagtaaaaaccatggatgcctccgagcttggtggtcaccggagtgaatgctcctatggaagcatatacaactcgcatcagaagcaacaaaagccagggcatatcagagatggccggcatgacaatggcaatcagctcgatgcagatgcgcagccggtgtggtcacggaagcatgcagcacacaagttagcctcacctattaagagtccaagatcagtttcaagcaggaacaaggttaggctgattgaagcagcagtcaaggtcctggaacccggtttacaatccaggcaccaccatcaggctcggaggcaagcgcgcctcgagtatagatgcaacagcagtgatgtgcagagtgctgctgaagccatgcacgatttctccgatcaattcgcaagagaaatgtgtgatgttgatgcatcaaggtcaggtgctcaaaatgtaggagccacctctctgcacaattctacttccaatcagtggtccgaagaggatactatgaggaatgtttctgttaggaggccaaaccagaacatatcatgtcaagcacaatctgaaggaaaccataagggtcagaggaacggatttaaggacagtggtcagagaacatcagatgatgtccttgtttcaagtcaaggtgtccaaaaaatacagccgaaaaacatatcccgagagaatgttgattgtagacctcttaaacagaacaatctgaagcagaatgcattgcctgaaacttatagagcagcagatacagggcatatggtccaaaggcagaaacatagagctaaggagcaaaatgtggcaaacacagccaatgactttgtctgttcaaacagaggtatgaacaacagtgcatctttgaggtccaaaggaaaagtaaaggataaaatcggcatgccacatggtagtgcggagaacaggaacttgagcacaaaatgtcaccgaaccagtggcctgcatggtgattgttctaataaacagatatcaaagactgcaacactgaaagctacagagaaagacatgataattgcaaaaggtgcagggttagttagtgagaagccaaagtctaccagtccaaactctgtaaggaatgactcgcggagaaaggtagagtcacgcattgcttctaggggtaacaactcaggcatcatttccatctcttctaattcaccgagaaaggctgtcctcgctttgctgaatggtcatactaaaggatcagatagtgttgttctgggatctccaactggttcttgtcctaagagagactatcgtagggactgccaaaatatttcttcagaaagggaattggtcttgagtgaagctttacaaggcatatcaagtctggaaagtgcagaatcagtgtgctttaatcgaaatgagttgagaaacagagaaattctggacgacagagtaatgtcttcattgtttcgaaagacgagtgctatcaatgtaatggaagaatctccaagtgatgaatttctatggcagtgtaactttctggacagtctgacttttggcttcagagaggttcctagaagtggtaaattgcgtgaaactcataaaaagcatgaggttactacaaatgctagcgatccatcttattatgcagatgatgagtgcttttctgggagcctgctcaaaactgcagcatcagaagctggattcagagaccgacgccgctcggagaattgcacaatgcaacaagatggaactaacaaaagaaactccaggtgctctgaaactaattttggccaagacagcagcaacctgatacaccctggagaggttgcagcaactgttgagctgctactaacaaacgttcgccggtctacttctactactcctccacgaagaagaagaagaagaagaagaacgggttcagcttcaacgccggcgtcgtcaaggccacagaaggggagaagagcaggagcccgctgggaagcctcgcgttcgattccgtcatggagtgcttggactcgctgttcacccagttctgcgactcaggatacaggtcgttctcgagggttcccctgatctgccccgaggagaggctggctgctcaggtggacagggagatcgcgaggtgcagcggcatggccgggaaggaggtggatgagctgatcgcgagcgacgtccagcactcgggggtggagatcggcgtggatgtcctgcacgaggcgtttgagattggtgcccagatcgaacgggatctgctccaagagctggtggccgagatcgggatggatatgttgaggcgtttgtgacgtgatgatgatgatttcgtagcaatatggtgaaattatatgttacaagtttggtca

SEQ ID NO: 84 - DNA, 709 bp, Hordeum vulgare
gcttcgcctcgcgcccgcaccccaggaaggtaagttcaagaggctgtcctgagaagctcaaatggctcccaaagctgctgttgccaagaagggcgatgccaaggcccaggctgccaaggttgccaaggctgtgaagtctgggtcaatcaagaagaccgcaaagaagatccgcacgtctgtgacatttcaccgccccaagaccctgtccaaggccagggaccccaagtaccccaggatcagtaccccgggaaggaacaagcttgaccaataccagatcctcaagtaccctttgaccaccgagtctgcaatgaagaagatcgaggacaacaacacccttgtcttcatcgttgacctcaaggcagacaagaagaagatcaaggctgcggtaaaaaagatgtacgatatccaggccaagaaggttaacaccctgatcaggccggacggcaagaagaaggcctatgtgaagctgacaccagactatgatgctcttgacgtggccaacaagatcggcatcatataagtcagagagagcctcctgcagtaggcgcgtgtgtcgtggtttcttatgttattggagttttgtagtagttgttacttgtcaaagggcctcagtgggctctattgcctaccatatcgctgcacactttcatgaatttgatgcaatcgaagtgactcgtgttgatgctaatttgagcttcgtgtttggtct

SEQ ID NO: 85 - DNA, 1415 bp, Hordeum vulgare
gctcccctgttccgcttccgctccagcacacggacgagccgccgtctcgcagccctcctcgtgtgcgcagcctctgcctccgtccatcgccccccttcgcggcatgggaatggagatgatcacgaatgtgtccgagtacgagaggctcgccaaggagaagctgcccaagatggtgtacgactactacgcctccggcgcagaggatcagtggacgctcaacgagaacagggaggccttctccaggatcctattccgaccgcgcgtactgatcgatgtgtcccatatcaacatggcaacaagcatcttgggctttgatgtctccatgccgatcatgatcgctcccacagccatgcagaaaatggctcaccctgaaggagagcttgctactgcaagagcagcagcatctgcagggaccataatgacattgtcttcatgggctacttctagtgtggaaagggttaactcagtaggacccgggatacgtttcttccagctttatgtttacaaggacaggaatatagttcggcaactcgtgaaaagggctgaaatggctgggttcaaggcgatcgccctcaccgtcgacactccgaggctcggccgcagggaagctgatatcaagaacaggttcatcttgcctccacatctggtgctggagaatttcgcggcgctggacctcggcaagatggacaagacagatgattctgggctggcttcctatgttgctagccaagtcgaccaatctctttgctgggaggacgtgaagtggctgcagaccattacctcgttgccgatcttggtgaaaggtgtcatgactgcagaagacactaggattgccatcgagtacggcgcggccggcatcatcgtgtccaaccatggcgctcggcagctggactacgtccctgcaaccatcagctgcctggaagaggtggtcagggaggcgaaggggcggctgccggtgttcctcgacggcggcgtccggcgcggcaccgacgtgttcaaggcgctggcgctcggagccgcgggagttttcatcgggaggccggtgctgtactcgctggcggtggacggtgaggcgggggtgcggaaggtgctgcagatgctgcgggacgagctggagctggccatggcgctcagcgggtgcgcgtcgctgcgggacatcacacgcgcccacgtcgtcaccgacggcgacaggatccgccgcgcacgcctctagatagggactaggaggcgccgcatactgctagtagtactatttgtgcgcgcgcgctggtcgatttgagatgccgctcgttcttgttcctccaatttgatcgatcgatgtatctggcaataattcgtactcgtagaaataaagattggagaagggtgcatgcattgccgtgtagtctgcccgcggaatgctgctgatcacgttc

SEQ ID NO: 86 - DNA, 2811 bp, Oryza sativa
accacactccccgaggatggaagacaagcgtcttcttcgtcttcctcgcttgttctctgcctgcccctgcctagcttaatgtggaactaactaggagtattaattaattccttccactaattaccaagcggcaatcggcggccacggccagtgaggtcaccgtccgctccgacgacgacaagctgccactgctcactgctctctcgagtctggaagcaggcgttgctcggcttctctcactatgaagggccaccattccttgccgccgtcgacgccgcccaagcgccgctgcactgccctggccgccgccgtcccggcgctcgtcgtctgctccatcctcctgcccctcgtcttcctcctcggtctccaccgccccgggcatggatcggaggagcgcgccgcggttgtcatcagcactgaattagggtttagcaagcacaagcatctggatgggagaatgaagcacaagctactcaaggatgtttctagaaagaaaattcctggatctgatgggattttggatgagaaatctggtagtagatcaaagtccaagagtgtttctaccaaatcaaaagaaaagctcaagggtgttttctctttagttcagctaaaaaatgagaccagaaaaaacaaagaacttcatacacaaagaagataccagttaaaggacttatcctggagatcaaaggatactactattgataagaaagagaaccaagaccaagaagtcgagcatgagaaccccagatcctgtgaacttgaatatggtagctactgcctctggtctgttgagtataaggaagtgatgaaagattttattgtgaagaggcttaaggatcaacttttcatggcaagagctcactatcctagtattgcaaagctgaagaaccaggaaacatttacacgtgaactgaaacaaaacatccaagagcatgaacgcatgctcagtgacaccattgcagatgctgatcttccaccattttttgcaaagaagctagagaaaatggagcgcacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgacagtagaatatttcaaatcaacgtctattcatacggtccagtcaaacaagcagaaacttgaagaccccaccttccatcactatgtgatattctccaagaatgtgcttgcagtttcgactacaattaattcaacggttatgaactccaaggattctggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgttccgtaatcattatcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggaggtaaagtggtgggagctattcagttctgtgaagttaaattaggacaattgaaggcttacaccgaggaacgtaattttggcaccaattcatgtgtgtggttatctggtctgaatgttgttgaactgaaaaaatggagggatctccacattaccagtcggtatgatcaattgcttcaaaagttgcaaaaggacagtgtgacatcatttccacttaaagtacttcccataagcttacttgtctttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattacaagggctactggaggaaatatatgaccaacggggaaaggtttatgacagaatgcaatatacattaataacagactaacagtgacatgagattcactacattctacatttctgggattttggagcaacagaactttcgggaacaaagagggttagagtgagatgaaatctgatgcagcattataatgaattgagtatagtaagggtggcatggtggcactacattaattccaaaatggagataggatgaaatgtttttgtgccagattttaagcaatacttcatagtagctaaagatggtagcaggccaccagcatgatacctttgaagtagatccctggttaacaatggtgtatgttgattccttcacctgttacacgatttggatggatcttcttcacatttaccactttgggattgcaaaagagcagttccctggtggttattttttcgtataaattctttcatgtgtatctttgctcgttgtataagagctatactgtataacttgagtgttcactagcatggcatgtacagatgtagaatgcctcaacccgcaagtattgggtgattctttctttcttcttcaaggcctatgtaccatgtcacaccaatgtctaagttttgagatctttgcattttgtacatcggaaggattcttgtatcatcagtttgataaaagatagtacatagagctaaaacagcttca

SEQ ID NO: 87 - DNA, 985 bp, Hordeum vulgare
tctgccctatcaactttcgatggtaggataggggcctaccatggtggtgacgggtgacggagaattagggttcgaagctagcgagccactgcacgcacacccaccagccaccagtcacacagagcacagcacagagagcagagccatgagcaaggagaagcaccacagacacgagcaccacctccggcgctgctgcggcggcttcgccgcgtgcctcctggcgctggtcgtcgtcgtggcattcattgcgctcgtcgtctaccttgcgctccgccccaccaagccttccttctacttgcaggacctgcagctccgctccatcaacctcggggatccctccctctcagccaccgcgcaggtcacgcttgcctcccgcaaccccaatgaccgcgtcggcatcttctacaggcgcctcgacgtcttcgtcacctaccgcgatgagcccgtcaccgtgccggtctccctgccgcccatgtaccagggacaccgggacgtcaccatctggtcccccgtgctgtccggggagtccgtgcccgtcgccggatacgtcgccgaggccatgaagcaggacatcgccgccgggtacgtgtcgctgctggtcaagatcgacggccgcgtcaagtggaaggtcgggagctgggtctccggcagctaccacctcttcgtcagctgccccgccatgctcgccgccggccccggtggcatgccgctcgggggtggcctcaacggcaccgggggcgccgtcgcgtcactgaaattcacgcagccgacagggtgcaccgtcggcacgtgatagaatggaccgcgcatacggtcgcatgttcgtactgtaagtggaagaaactactacgtagcaggatacttcttctcttcgtgtctctaaacaatttctatttatatattgtagtaatataagttgtctaaagctcttaatttttgtatgtctcgttaatcggagaataaactgtgttgatgtatgcatttc

SEQ ID NO: 88 - DNA, 1698 bp, Oryza sativa
gtggcaaccctctctgtcctacatttcctgatttccccttgccgtcgccagcgtaggcccgtcctctcctcccgaagccaccaccggcccaccgtccatccacgccgccgcaccacgtgcccccacgcccccgacgcgcaaatcaccgcgtgatccgatccccccttcttcccaaagtccaagcctcactctctccctctccatcccacgcctcgctcactagcgcacagatctcctaccaccaccaccaccgccgcagccatggcgaccgggtactaccgcggcggcggcggcgccagggaccacgccgacgagcccgacgacttcgacgagtacgaccccacgccgtacggcggcggctacgacctcttcatcaccttcggccgcccgctcccgccctccgacgagacctgctacccttgctccgctccctccacctcctacgacgccccgcactactccgccgacgagccctccccctacgcccaccactccaagccgcagcccgcctacggcttccgcccccagcacgagcagcagcagcagccgtcctacgcctcctccggctaccgcccccagcacgagcagcagcaatcctacggctcctctggctacggatctaagccccagcccgcctatggcttccgcccccaggccgaggaggagaacacctacggctccggctatggatctgggtacggtggtggaggaaggaagcagcaggaagaggagagctacggctccggctacggtcgcaagccgcaggtcgaggagagctatggatcagggtatgggaccaagccgcagcaggaggagagctatggatcagggtatggatctgggtatgggaccaagccgcagcaggaggagagctacggctccggctatgggaggaagccgcagcaggaggagagctacggatcggagtatggttccggctatgggaggaagccgcaggccgagagctatggatcggggtatgggagcaggccacagcagggtggggaggagtatggtagcggtgggtatgggaggaaggctcaggaggagagctatggttccgcgggctatggcggcaggaagaccgaggaagagagctatggtggtggttctggttatggatatgggaagaaagcccaggaagagagtgaagggacctatggctctggtggttaccccaagccgaagccttacagtcaggaggagacgcagggttcttatgggtatgggtacggcgagaagcctgcgtatgagagtggtggatacaacaagccgagctatggcgggggagacgaataccagggaggctacggccgcaagaaacatgatgacaatgactctgatgatgaaaagaagcagcgttatcagaagcaccaccaccatcgccgccaggagtacgatgattaagcttccggtgcgttatcttctacggggccatcgattgctgctatcacttgccagccatagtactctgcgtgaataaaagatgctcctgctcagtcgtttcatcgttcgtctcatggacactatttgttatccgtctccatgatagtatgatgtcgcttcaacactgataataaattgtggctttgcgcgtgtttttttatgtttgaagcatgtctaaacaatcactctgtcagttatcatttctttgcttgggatgattggtgtatatatgtgcccctgttgcgtctacta

SEQ ID NO: 89 - DNA, 3911 bp, Oryza sativa
ggagcgcacacagacaagcggaggcgaaaagtggcgcattattttatccgagcgagcgagtcagacgcgcacgcggagcagccgcctccgccgccgccgacgacgaggaggaggatggcgaccccgttggccgacgagggctcgatcgccgccgcggtgatgccgcgctcgccttctccaccggccgccgccgcggggtcggcggccgaggcgccgatgctgatattcgtctacttccacaaggcgatccgcgcggagctggagaggctgcacgccgcggccgtgcgcctcgccacggagcggtccggcgacgtgggggagctcgagaggcggtgccgcttcctcttctccgtctacaggcaccactgcgacgccgaggacgcggttatctttccagcacttgatattcgagtgaaaaatgtagcaggcacgtattcccttgaacataagggggaaaatgatctgtttgcacacctgttctctctgttaaagcttgatgtgcggaatgatgatggtcttcggagggaactcgcgtcctgtacaggtgcaattcaaacgtttataacccaacatatgtccaaggaagaagagcaggtcttcccactgctcattaagaagttttcacatgaagagcaagctgatttagtctggcaattcttatgcagcatccctgtcaatatgatggcagagttccttccatggcttgctacttctgtttcatctgatgagcaccaagatattcttaactgcttacataaaatagttccggacgagaaacttctccaacaggttgtatttgcgtggattggaggggaagcagtgaaaacaatatcacatgatttttgtagtccttgttcaaaaagcaatgttagatgcaaggatgctattgatcaaacagacaagtatggatgctcacatgagcactttaaaactggaaagagaaagcgtgcagaatctagttatagtcagcttgttatgcatccaatagatgagattttgtgttggcacaatgctatccgaaaagaattgagcgatatagtagaagaaacaagaaggatccaacaatctggggacttctcggatatatcagactttaatgtgaaacttcaatttattgcggatgtgtgcatcttccacagtattgcagaggatcaggttatatttccagcagtcaacgatcaagtgtcctttgagcaggagcacgctgaagaagaacggcggtttaataaatttagatgtttaattgaacaaatccaaataacaggagccagatcaacagcagtggatttttactctgagctatgttcacaagctgatcagataatggagaaaatcgagaggcacttcaaaaatgaggaaacaaaggtacttcctcaagctaggattcatttttcatcagagaaacaaagggaacttttatataagagtctctgtgtcataccgttgaagttattggagcgtgttttaccgtggtttgtatcgaagctgaatgatcaggatgcagaagcttttcttcagaatatgtttttggcagcaccttcctctgaagctgcattggtcactcttctctctggttgggcatgcaaaggtcgctcaaagggcacctctaactctggaaaattcatatgcttgacaccaagggcactgagcagcccattggatgaaaatgggtttaaagactgccagttatgtccatgttctttacaatcagatatttgttctaggccagccaagaaatggaatgacacagaatctagtaacataagcaactgctcacaaacggctgatatagcattgacatgtaaaaacagaccttgtcacattcctgggttaagggtagaaattagcaatcttgctgtcaattcgtttgcttctgcagagtccttccgatcgctgtctctcaattattctgctccttcattgtattcaagtcttttttcatgggagacagatgcagccttttctggcccagataacatttcaaggccaattgacacaatattcaaatttcataaggcaattcgcaaagatttggagttcttagatgtggaatctagaaagctcatagatggggatgaatcttcccttcgccaattcatcggaaggtttcgtttactgtggggtctttatagagcacacagcaatgctgaagatgaaattgtatttcctgctcttgaatcgaaagagacactgcacaatgtcagccactcatatactcttgaccacaagcaggaagaagaattatttaaagatatatccactattctttttgagctttcacaattgcatgctgatttgaagcatcctcttggtggtgctgatgcagttggagcgaaccacattcatccatataataggatcgattggtccaaaaagaataatgaacttttgacaaagcttcaaggaatgtgcaagtctatccgggttactctgtctaatcatgtccatagagaagaacttgaattgtggccactatttgataaacatttttctgtagaggagcaggataagattgtaggccgtataattggaagtacaggagctgaggttctgcagtcaatgttaccctgggttacatcagcgcttagtctagatgaacagaacaatatgctggacacatggaggcaagtaactaagaatacaatgtttgatgaatggctaaatgaatggtggaagagatcacctacttcttctggcccttcaagcgatgcctcccatccagaagaagatcatttccaggaaaagttcgatcagagtgaacagatgtttaagcctggttggaaggacatcttccgaatgaaccagagtgagcttgaggctgagatacgaaaggtttctcgtgattctactcttgacccaaggaggaaggcttatctaatccaaaatctcatgaccagccgctggatagctgctcagcagaaatcgccccaacctcagtcagaagatcgcaatggatgtacagtattacctggatgttgtccttcataccgagatccagagaatcagatttttggctgtgagcattacaaaaggaaatgcaaacttgttgctgcatgctgcaataaactgttcacatgcaggttttgtcatgataaagttagtgaccatacaatggaaaggaaagcaacggtggaaatgatgtgcatgcaatgcctgaaagttcaaccagttggtccaaattgccagaccccttcttgcaatgggctatccatggcaaagtattattgcagcgtatgcaagttttttgacgatgaaaggagtgtgtaccattgccccttttgcaatttgtgtcgtcttgggcaaggattgggtattgattttttccattgcatgaagtgcaactgttgcctgggcatgaaattgatagagcataaatgtcgagaaaagatgctagagatgaattgcccaatctgctgcgacttcctatttacatcgagtgcagcagttaaaggtctaccttgtggccatttcatgcattcagcttgctttcaggcgtacacctgtagtcactacacctgcccaatctgctctaaatccttgggagatatgacagtatactttggcatgcttgatggcttgctggccgcagaagagcttcctgaggaataccgggaccggtgccaggatatactttgtaacgattgtgaaagaaaaggaaggtctcggttccattggctgtatcacaaatgcggcttctgcggttcatataacactagagttatcaagattgatagagctgattgttcaacatcagattaaccaggcgagattttccctctcatattcgaaattccttttgaatatatatattgttgtaaatatacatcaacttaaagaaatccatgcgtcatgcgtgctcttgtgtgttgctgcgattaacaagtcataggagatgctaatggtgggcgctt

SEQ ID NO: 90 - DNA, 1074 bp, Oryza sativa
acgacgcttgcacttacagctgcagctagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgtcgacgccgacgccgcgatgaaggagcaggacaggatcgcgcaggaggagaagaagaggcaggccagggagaagggcgctggcttgccttaggctaaaactgcatacttgttgcatgcttatttgtactaaaagcttttttttttagctgaattttagtcggttcagttcttttggttgaataatgttggcaaacttgagcctcctaatgtctgtaagactgtaactgtaatggaaaggaacttattgaagttattagccatgc

SEQ ID NO: 91 - DNA, 1519 bp, Hordeum vulgare
cgtggacgagcaccgccggtattccgttcccgaattccacagatttccgctccccactcccaaagccccgatactttatagccggcgacagcaagcccagcaaaataccacctcccaacccggaaatccgcccactcccgcgaatgaatcagcttccccttccccttacccttccctgagatcccagcccgagcctacgcgccaggaattccaccggaatcctcccctcctagccgcagcgtcgccggattgattcaggaggcattcttggtggccggagaagtggtatttgctcctccgcttgagagaatataacagaggctgtagttcagatcatcatcatcaaacatgtcgcttctatcgaaattacggttggtcactgtggatgtgactggtactctgcttgcttataaaggacggcttggtgattactactgtatggccgctaagtctgctggaaagccatgccctgactatgatcgaatgcacgaaggcttcaagcttgcatacactgagatggcaaggaaatacccatgctttggatttgcagcaaagatgccaaccattgaatggtggagaatttgtgtcaaggattcatttgttaaggctggctatgactacgatgctgagacatttgagaaagtgttcaagagaatttattctgcctttggctcctctgccccgtactcagtgtttcctgatgcgcagcccttcatgagagagctgagggagaagggtatcacagttgggatcgtcagcaatgcagagtaccgttacaaagaggttatcttgcctgcattagggctgaatcagggctcggagtgggacttcggggtgttctcaggcatcgtcggtgtcgagaaacctgacccaaaaatatacaagatcgcgctggagatggcggggaacgtcgcgccggaagaggcgctccacatcggcgacagctaccgcaaggactacgtccccgcacgaagcatcgggatgcacgcgctgctcctggaccgattcaagaccgccgacgccgagagctggaggaagtccggcgcgccggtgctccctgatctcgaagccacaaaggcatggctcgccaagaacccgaccgaggaacccgctgaggagccactaggggccgcgctgctgcgcaggatggccgagaagctctgaacctcagcccctggggtagttcctgttgtgctcttgctggggagtgagggagccaaggaaaagggatgtgttgtagtgatggttcactggccagtttcagtttgctggagctgcttgaactttggtagtagcttcctgtgctgttgctgactgctgaatgtggcaagtgatccagttgcgcgacgaacatcttgcaatgacgaataattctaatcgtgtttcacataatggagaaatttgacatgattctgcatttgtatgaggttggtaggatcgcgatgtcggggttatattcaaactcccaagatgaatgtgatagctcagcagaagccatgtaatctgttgagcggccgcc

SEQ ID NO: 92 - DNA, 1431 bp, Hordeum vulgare
gcatgctgcagtactgtggtaccaaagatagctatgcaagtatatgtagatgtaggctgctgagtcataaagctgaagagcacatgctccgtccttgcaaggttggggcttactcggaacaaaaaggtttcttgcaagcaactttttgatacatataaccatgagttcataacaagaaggcattctctaccactccattccattccccacaagcagagggagagagagtgagagggggaagggaaagggggagctgaaggcatggagggcaagcacaccgatcaggcaaacgtgaaggcaaagcactccaaggtgatctgctgcaagctttacatctctgaaagccggaatgcggcgattgtggatgccatcagccgcataggccagaaaaaccctgaggtggttctgctcagcaagtttgatgacaagtactacaaccgtgtccgctacacgctcgtctcctacatcaccagcgaaagctcagccggtgaagctgtgttcggcccaatcaggaaggtactgctggagatgatcgaggctgcattttcagccataaatctccaagcgcacagcgggactcatccacgcattggtgtcgtggatgacatctcattccaccccttgagccccgcggccacaatggaggatgccgctcagctggctaagctggtggcctctgacattggaaatggcttgcaagttccagtgttcctctacgcggcagcacaccccaccagcaagagcgtcagtgcagcacggcgtgagctcggctactaccggccaaaccacaagggcgtccagtgggcaggccaggtgctcccccatactctaccggtaaagccggatgttgggccagctcatgtctctcgcgaaagaggcgccaccatggttggagctacacctttcgtggacaattacaatgtgccgatattctgcaaggatgtcccgaccgtgagaagaatcacccggagggtgactggacggagcggagggctcccaacggtacaggcgcttgctctcttccatggcgacaattgcacggagattgcgtgcttgctggatccagatcatgtcggtgccgatcaggttcagtggctggttgagcagattgcagaagagcaagggcttgaggttgacaagggctatttcaccgacctgtccaaggatatgatgctggaacggtacttcgagatgatttctgcagctgattgacatgaccacaattttcttattgtaatcatgcatgtctgcacttccatgtatgctgctgtttaaactgtggcaccaacttggaccccggaccgaccaattccaacattttgtatatacttagttatatctgcactgaagatggtctctagaaacttcacccgagtaactgccagataacaggtctggtcactgaatgagaatcctgttttcagtcattct

SEQ ID NO: 93 - DNA, 573 bp, Arabidopsis thaliana
atatataaacaaaattacgcatttttgccatgagactttagtttttttcacagttgagaaatctcgccgccgtttgaagaaagaagaagagatgggagttttctcattcgtgtgcaaaagcaaaggcggagaatggaccgcaaagcaacacgaaggagatcttgaagcttcagcttcttccacctacgatctccagcgcaagcttgttcagactgctctctccgccgattcatctggcggcgttcagtcttctttctctcttgtctctcctacctccgccgtcttcgtggtggtcattggtggtggtggtggtggaggatttgctgccggaggaggtgcagctgctggaggtggtggtggtggtgaggctgccgcagccacaaaggaggaagagaagaagaaggaagaatctgaagaggaagagggagactttggatttgatctctttggttaagagacctaaaacaactttgttagtgttctgaggtttttctatctcaattttctttttgttttctgatattttcgagactataatgtaatgtcagaaatatatgtttgtttctggtttca

SEQ ID NO: 94 - DNA, 758 bp, Oryza sativa
actggttccattcctcctcgtcatctccagctcgcggcggcggcggcggcgattggcttgtgctctctccggcgaccgcgcctccttccctccacggtgacctccttccggcgaagcactgcctctctcgtagtctcagttctcctcctacgttctactggacttgtgctgcgaggggagatctaccaatctgggcgtggattggtctgtttcttctggtgacaaaccttaagcttgctcggatttgttcggaacaataccatggaggtgagaccaatggttgctttgcgtgctgccctagttggtggggtagcagcatttgcgaagattggtgcggcgatgaaagctgcaggaggtgcgaaggttggtgcagcggctgcagcaatgacagctgcagcaacagctgctgtatctagcaaagacacaaacaaagataatccgaagactgaaacaaaatgatatgtgccttacttagtggagaaaccctgtatggaaatgcctctccagagcttaatatttttttttcctgaattgcacttccaccatcgctgaagagttgtataagctaattgcgacatctgaaatgatgtcattgaaatgatgtcataataagcaactagatgatcaactttcagcttacatgagaaagttatgatcatggtgttttttttaaaaaaaaacttgagaataagcatgacaataatgtgtacttcccctactgttgttgatgatatgataacgtccaatagtttctctga

SEQ ID NO: 95 - DNA, 1166 bp, Hordeum vulgare
ctcgcctcgccaagtcacacttcgctcttcacacacagccaagatccgcagagatgatccgagcgatgctggtcgtcgtcagtggggagagccgccgggcagcggtggctggcgctggcttcgtcggccactgcggctactccacggcctcgagctcccagaggttggctggcaaggtggccgtgatcaccggcggggccagcggcatcggcaaggcgacggcggccgagttcgtcaggaacggcgccaaggtcgtcctcgccgacgtccaggacgacctgggccacgccgcggcggccgagcttggcccgaacgcggcatgctacgcgcgctgcgacgtgaccgacgaggcgcaggtcgccgcggcggtggacctcgccgtggcccgccacggcaagctggacatcatgctcaacaacgccggcatcgtgggctccctggcgcgtccccggctgagcgacctcgacctcgccgacttcgacgccgtcatggccatcaacgcccggggcgtgctggccggggtgaagcacgcggcccgcgtcatggcgccgcgccgcagcggcagcatcatctgcatggccagcgtcgccggcgtgctgggcagcgtgacgccgcacccgtacagcgtgtccaaggcgaccgtgctgggggtcgtgcgcgccgtggccggggagatggcgcgctccggggtgcgcgtcaacgccatctcgcccaactacatcccgacgccgctggtgatgcgcatcctggagcagtggtacccgaaggccagcgccgaggagcaccgccggatcgtggagggggacatcaacgagatggagggcgccgtgctggagcctgacgatatcgcgagggcggcgctctacctggcgtccgacgaggccaagtacgtcaacgggcacaacctcgtcgtcgacggcggtttcaccgtggggaaggcgcccaacatgccgccggcgccggcgctgtaaaacgacgcaagcacttgaaataaattaattggcgttgtattgcaccagaaccatcgagctcgagctgtaaaacgaagcgagcttgagcattgcgtttttcgaaagcaagagcatctacaacggctgcataaaaatttcgctatcaataaaaattataatgcgtcatttttaatgcatcggaaccaacattatttt

SEQ ID NO: 96 - DNA, 693 bp, Hordeum vulgare
cctcgagccacccactttctttccccttctttcttctcggcggaggcggaggcgacaggaaggcgaaggaggaaccctagccgcgcgaggaacaaggaacgcccagatccgcaaggccggcgacgatggcggcggttcgatgcgcggctcggaggctcggtggcgccctgctccagcgaacgcaggcggaggaggcacgcctgctcgcgccaagcaggctcatgcgctcccgccacctctccaccaaggtctccggcgaggctcgcaacatccagaagaaaggggatgacatctgggcggggttcaaagagacggtaaagagggtgtcggagcgccccccagaaaagaagccaaatgtccttctgcagcgcatgatgttgatcgaacaagtgactaagagtgtggtctatggagctttcagggtgacagttgtgtatgcgactgctgctgctgctttcggtggcagttggctagaaaactagcctaggccgttaccaaggaaaaccagtgaagacaagatgaaggaatgagaaccaaagatggccccctgcttgtttttctgtttaattatgaccccatgtagtttggccggctaggcactatgctatggtacgccgtgatattacatctcctatctatctatttcagcagattatgcaggaaactgtagcttgaaatgaacatacttgcata

SEQ ID NO: 97 - DNA, 723 bp, Hordeum vulgare
tcaaacctccctccctctctctctctcgagtggcgtcctaatagctgcttcttctcttctctctaccttcttcttcggtcagctctctcaagcaaaagcgaagggccatggagggcctcatcccgttcatctacagggccgtggcgcagtacaggaaggagggccaggtctccctcgccgacctcctcttcgacgacccctcctcctcgccgacggccacctcggcctacttccgtctccccggagactccggccggcaccagctcttctcggccgactacggtacggcggcgcggcggtctcccgcgcaccgtcggctcaccatggagcacggatcgtggtgaccgaccgtggatgatgcgacgccgattgctgaggagctgcgagtattgttggcctagctaagctaatacgagctgcaaaactagcagtttgtgtgtgttatgcatgcatgtatttgtgtttcagttaagcttgtaaaatgatcggtccgtgagtcggtgagtatcaactgtaaataattatgggatgcataagcgcaggacctccgaaggaggccctgcctgtgaagaagatgtatgtatagtgtcggagtgcatacgtggagtgtaatatggcaataaaaggtttaccatgtatttacacaagacagaagacagaaggttataacatgacttgctgcaatgcaacgctgcaaaaatgcgtacaaagcatcaagattgc

SEQ ID NO: 98 - DNA, 595 bp, Hordeum vulgare
gcacgaggctcaagcaacgcaggccagaccaaaaccatggcggccaaccaccacctccgccggctcgcctccgcgtccgcccccgctctctcccgcctctccaagccggccccctcgccgctcctccgctccgcgttctccagctccgcctcccccgcggatcagccgccggccgctgcggcccagaagggcgaagcccagagcgccgtgaaggaggcagacgaggcgcagggcggtggtggttccggcgccacgaaggctgcggaggaggatgacggcggcctggacataaacgaggccacgggcgagatcggcggcccgcgcgggcccgagcccacccgctacggcgactgggagcgcggcggccgctgctccgatttctgagggtaagctttctcctggatccctgctactttgtactcgtaaggatggcatggcggtggtcgtgtgtccatgttactctgtttggggaataagttcagacatctggctcttgtactgaacaacggtcctaaagttcagagtactataccatcttcgcatgtaatcttggtaaggtctctgcatgaaattgatctggaaggagatgaattgg

SEQ ID NO: 99 - DNA, 2853 bp, Hordeum vulgare
aacctccttccaaacgcccacccccaccacccaattatcccaatcccccgctaacagcagcaccaataaagaacgcggagaaaaagagagaaattttccgccgcattatcatagtagcataacagttgttggtggttggtgcccgctttgtttacccatttatttttggacccgaggagaagaagcagcagcggaaggaggaagaagcagcaaagatattgtaatcttcggtgggagggatccgattttgtccccgtgccggaggagagagggagagagacagagagaggagcaaagattcaccgattttctttctcctctccgcccctcgcccccctctctctccttccgctatccccaaggtcagctcgtgacagcaatcgttctgccggccgctgcctgccccccacgaggagcgcgccgccgtcagaatcatcctgaatcatcggcgcacgctgatacctctggtggttgctgctgagctggtgaaggagccctgcggagtcctgtgcacgcctctctcagccatcaataattgatcggacaaaggcaggtcagttagaatttttgttgggttgacttcacaagtgacatgcagttgcttcataataagtgagcagtcaaagttgtgacatgtctaattattactcaagcccgggcgacgaaagggacccgcaaaccatgtactcaccggagacgggaagcgcatcgtatcccgtgccatcagccctggggaacttgctctattcaaacaatgcatcttctgggccgtatacggaattcagtggcataatccagcctcagcagaatttcatggagctgcatggccatccttcagaacattcatcatcaagggaacctaacatggtcacttcgcttgcagagcaaagctccttcgctcctgtcaaagatatgagaaatgagatgttgatgcatttcatggatggcgcacacagtggtggtggtgatctcatccacaatgatgcccatagcagtgcgcagcttgagtttggcttgttgaacaaccccagctcggcgattgttccatcagcaccaggccaaggattgtcgctgagcctcaacacacatatcctggcaccttcatacccatactggtccccaaagccagacttattgacgacccaatcttaccagggagatgaaaacggaatgaagaatatgcagtcggaggcctcacgggcaatcaggaattcaaagtatctaaaggcagcacaagaattgcttgatgagattgtcagtgtttggaagagtataaaacagaatgcgcagaaagacaaggttgaagcaggaaaaatggatggaaaagacgctgatgaggtgttgaaaagcgagggggtatcttccaacccacaggagtctgctgccaatgcagaagctgagatttctgcggctgagaagcaagagctccagaataagatggcgaaacttttggccatgttggatgaggttgaccgaaaatacaagcattattttcatcaaatgcaaattgtagtgtcgtctttcgatatgattgctgggtctggagctgccaaaccttatactgcagttgcccttcagacaatatcgcggcatttccggtgtctgaaggatgccatcaacgaccaggttaatgtcatccggaagaaactgggagaggaggataattcatcgggcagagagggcaagttaactcgcctccgtttcattgatcagcagttaaggcagcaacgagctttccaacagtatggtatgttacagcaaaacgcttggaggccgcagaggggtctgcctgaaaactcagtttcaattcttcgtgcttggctgtttgaacacttccttcacccgtatccaaaagattcagaaaagctaatgctagcgaggcaaactggtttaacaagaagtcagatttcaaactggttcataaatgcccgtgtccgcctgtggaaaccgatgatcgaagacatgtataaaaaagagaccggggaggccgagctcgactcaaactcctcctctgacaacgtaccaagaagcaaggacaaaatggcatcctgtgaagacagagaagatcagaaatgctccatgagccagggccaggcttaccaaaccagtgaattcaaagccaacgttggaatggtgggcctcaccggagggccggccagcttccacaatgaggcgagctccgacgacggcttcatgaacctgctgttgaaggaccaaagaccgggcgaggcggacggcggtctcctccatggcgacgagagcgcacggttcatggcctaccatctggcggagctggggggatatcagaacagcaatgtgtcgttgacgctaggactgcagcacactgagaacaacctttcagctccaaacaacactcaccggccaggtttcaccgtgggcggggaaggggatatctacaacactaccgcggctcatcccggtggtggcgccgccgccgcctctccggattacgaatcgacgaaccagttggatcagcggcagcagtttgagccgtcgcctctgctgcatgatttcgtggcctaagtgaaatgaacgctcgttgctggtgaagatgggatggggaggattatctgtaatttgtaggccatgataataacgtgcctgaaaaagcctggaaattgtagctgtagttgcatttggtatagaagagagggggtatagcatgaaatgtattataagtttgtgggggtggggtaaataatttttgtaaagatgaatggaatgcattatacgtgtaaaagattatgaatgaagaagaccaaccatcctgtaaaaaaaactacacaatccggtttaacgaatacttctggtggtttaacgaaaacagaaaac

SEQ ID NO: 100 - DNA, 752 bp, Zea mays
caccaccaaaccgaggaagacgacgctcagccgctcaggaatcgaaggagcgacgaagctaaaggagggcgcatctaagccgaattgaagcatgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtatccggtccttcatggctaccacacttcggtagtcatttatcgtgacggttggagctacatgtaccattgtacgaacactgggaggtcgatcttgttggggaccaagggtgcaggtactgagcatgaaaaggatcagtgtgatcttcatgatgctatcgacatgttcctcgtcagacaggcggttggcgtgatttcaggtgtagcaacacggagttataaccctgaatactgtaccgttaaaggaaccttgtagtttgtaatgctacattgccttatcattgtatcaacagatgctttatttcacaattagaaaacagaaacacaatcttgatataaatgactacactaatgtgcatc

SEQ ID NO: 101 - DNA, 1444 bp, Oryza sativa
agcttttagctgcaccttctccaaggagagagaaagaagagagaaattaaaattacttttgttttacacatgcatatccagatgcttcacattcttgacacagctcaactcgtctatataagcagctcacagctttagctttgcttctcacattatcactcagacactcacacatacacagtcttctcctagattaatctgagctcttcttgccgggatggcgaagaagcagagcttgttgcttgcaatgatgctcgtcgtcgcaggattggctgtgtcggcgatggcggataggaagctgatgtctttggtcaagccccagccgaaccagctcacgtaccacaatggcgccgtgctgagcggcgacatccccgtgtcgatcctctggtacggccggttcacgccggcgcagaaggccgtcgtcaccgacttcgtcctctcgctcgccgcgccgctgcaggcggcgccggcgccgtcggtgtcgcagtggtggggtagtattcaccggctgtacctctccaaggcggtggccgtcggcaagaacgggggcgcgcacggcggcggcggcggcggccgggccaagaacgcgcgcgtggtgctgtccgggcaggtctccgacgaagggtgctcgctggggaagagcctgaagctgtcccagctgcccacgctggcggcgagggcgaggccggggaagggcggcgtcgcgctggtgctgacggcgcaggacgtggcggtggaggggttctgcatgagccggtgcggcacgcacgggccggtgtcgcgcgccggcgcggcgtacgcgtgggtgggcaactcggcgacgcagtgcccggggcagtgcgcgtggccgttccaccagccggtgtacggtccccaggcggcgccgctggtgccacccagcggcgacgtgggcatggacgggatggtgatcaacgtggccagcatggtggccggcgcggtgaccaacccgttcggcgacgggttctaccagggggagcgcggcgcggcgctggaggccgcgacggcgtgcacgggcgtgtacggcaagggcgcgtacccgggctacgccggcgcgctgctggtggacaaggccaccggcgccagctacaacgcgcacggcgcgcacggccggaaatacctcctcccggcgctcttcgaccccgacacgtccgcctgctccacgctcgtgtaacctgtccaccacgcgtcgggttgtgtattgtgtacatgctgatagtagtatgtctgtatgtatgtatgtgatgtgagtacgtgaccatgttgtgtacataagttcgtgtcaaactcgatcggctatgtttggctcttcctgctgcctgcctgcctgcttgctgggtagcaacaactatagcaaagttagcgacgctttataaataaaaagaacttttgaatttgtaagtggaagcgcacatgctgcaccgta

SEQ ID NO: 102 - DNA, 1323 bp, Zea mays
ccccggcaccgagccggacggcggacgccctggacctcatgtcctcctgctcacgtaattggagcaacggccattatctgctccgtcgcgcacgcatgttctcatattccacgcgcccccgccggtcgtaaccaccgggcaaccaccgcccggctcactcagtacgccccgccccaccaccagctcagctccagccgtgcgacgctgtaccccgcccccgctttcagccgagcccctatatcaaccaaccccaccactctctaccctctgtacccatcgctcactacgcgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaggcgcccgccgccgcgcccgccgcgtcccaggggaagcccaagaagggcgggtcctcggacgctccctccgggtcggccggttccgacgacgccgcgcccacgggcgccgccggcgccagggtcgtcggctggagcttcgccggcctcgccgccgtccttggctgtctgttgtgagagtgagaccgtgcgtcgtttctagggacggacggacgacaagctagttgaagatgagaatgctatgcccgggttcccttccccttctttctctctgtttatttaaacttctttcatctcgctagtttctttaatttgtactattggtggtttgtaagattggcttatgtgattcaatttatgcgcctgccgctgttgatactgc

SEQ ID NO: 103 - DNA, 1211 bp, Triticum aestivum
agtgcagcaaatagtctccatgttcaacaatagtgctgctccaaggagactatttgctcttggatttttgctcttcttcactacatgacagatgctgtcttgagatctggttgtgtgtggctgatgggtgttccagcaggctttaaactgaatactgagttagcagagcttctaggcatgatttctctgaatgcaatccaaatatattctaccctttggttcatggtgggaggcttccttaggcatataattcaaggccttgcattttctggaattcttttaggcttcacggttcctgtttcaatcttcattgacattatccagcttgcgacgttgcatgttaccatgcttcagtggttaatctccttaatatattcaaggcagattcagacagtgacatcattgtggcgtcttttcagagggcgcaagtggaatcctcttaggcagagattagatagctatgactacacggttgaacaacatgtggttggttcactgttgtttacaccagtcttgcttcttctacccacagcttctatattctacatatttttctctatcttgagcagcacaatcatctgtctgtgtatagtgttggaaactgcaatttgtataatccactctactccttacgctgcggtaattctatgggtgacaaggaggcaaaggtttcctgctggattaatgttccttcctatgtcatcgtcatctgtatctactgatgatgatgctccatcagttgaatatcgttcaaccagtttatctggcgaaaggaaaacagatgaacccatccatgtacattcagtaccactagtttcagaacttaactgtaactataacaccctaggacaagtaatcgggccacattaccagaaagttttcaacgggatcgctctccccttctgcaaacaactggcacatggaatccttaggggcacaaggatacctacaacactgcatctgccgtcttctccactgccctggatgcatattggcattagagaatactggatgctttgccgtcgcgcaaccaagtggggaaggaattaaaagttctccgcttatgattaactattagtcgctcagagaattttgcttagttgccaccgttttgcagtggatgttttgctttagttgccttgacacagtaacaaatgttggtagttgccaagatgttgcgttgtggactgctttgtagcactgataccatt

SEQ ID NO: 104 - DNA, 998 bp, Oryza sativa
acagtctcacacagatcgcttcacttttacacgaagcccctcgcaattcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggagatggaggtgaagctgtggaacgacaagcgggagcgggagctcctggagagcctcgccgacctgtacgccatcatcaaggcgacggagaagctggagcgcgcctacgtccgcgacctcgtctccgccgccgactacgaggccgagtgcctcaagctcatctcccagttcaactccctctcctcctcgctcgccggcgtcgtcaccatcccccggttcgtcgaggcctaccgcctcgactgccccgccgccctcaaccgcctcgttcagtccggcgtccccgccaccgtcgagctccgcgccgcggcgtcctcgtccgcgccggcctcctccgcggcgtccgcggccgccatcgcccagtgcgtccagagctttattaccgccatggatgccgtcaagctcaacatgctcgccaacgaccaggtccgccccttgctccacgacctctcgacctccatggggaagctgggccccgtcctgccgccggacttcgaagggaaggtcaaggtgagcgagtggctcgccaagctaaataagatgggggccggggatgagctcaccgagcaacaggcaaggcagctcaacttcgatctggattcggcgtacagtgcgttcatggcatcactgcccagcaccggcctatgagcaagcctcatcctggttctgagttggtttcttctttttatttttctcatgtgtttttctatggatcaccgctgcagtgttatagccttataggtatgtgtaacttgaattgtgctatattatttgtcaataatagtgccaattttgtggt

SEQ ID NO: 105 - DNA, 1727 bp, Oryza sativa
ctccttctcccctcactcgtagtctcgtcttcgtctactccaccaccaccatctcctctccctctcgtcttccctggcgcgcgcggccggcgagccggcgagcggcgtcgcggcggtgaacttcctcgtcctcgtccccttcccgactccccgccccccacctagcctcctcccaagtgaggactcctcgcgctcgcgcgcgcgcggccggcgaggggcgacgcagccggggcctccgtcctctcggcagcacgaattgaattggaggtaggtaggcacatttgtaaaaatgggagtttaccttagtacccccaaaaccgagaagctatctgaagatggcgaaaatgataagcttaaatttggactctcatctatgcaaggatggcgtgcaactatggaggatgctcattcagctttgctagatatcgataatgacacatcattctttggtgttttcgatggacatggaggaagagtggttgctaaattctgtgcaaaatatctgcacagagaagttctcagaagtgaggcctattcagcaggtgacctgggcaatgcagcccataaagctttctttagaatggatgagatgatgcgaggtcaaagaggctggcgagaactacaagcacttggagataagataaaccagattagtggcatgatagaaggcttgatctggtctccaagaggcagtgattcaaatgatcaacacgatgattgggcttttgaagaggggccacactctgactttgctgggccaacctgtgggagcacagcttgtgttgcaatagtaagaaatagccaacttgttgtcgcaaatgctggtgattcccgctgtgttatctcaaggaatggtcaggcatacaatttatcaagagaccacaaaccagagcttgaagcagagagagaaagaatactaaaagcaggagggtacatacagatgggacgagtaaatggaactataaacttgtcaagggcaattggtgacattgaatttaaacagaacaagttcttgtctcctgataagcaaatgttaactgcaaaccctgacatcaacacagtggagctttgtgatgatgatgactttcttgttttagcatgtgatggcatctgggactgcatgtctagccaacagctggttgatttcatccacgaacacataaacacagagagcagcctttctgcggtatgcgaaagagtgctagatagatgcctggctccatcaactttgggtggagaaggatgcgacaacatgacaatgatcctagtgcagttcaagaagccaattagtcagaacaagaatgtcagtcctgcggaacaatcagctgccgacaaacaaccaactggagacacacattggtctgagattcatgtgaccgaggagagtagctcgtgatgttctagcccgataaaaccggtacaccaaagaacacccagtgtatcctgatgcgatatcgcaattggctaaacaggcataattcacgaaatttcggtgtacataccagcctcgttaaattgttgacacagcgtttacacccgtggccattcatgttctgctgcattagcagccaatcagtttgttattctccaaagctccagtttgtaatttccggttgtgatttcatctcaccaatcctcttctaactactgtacaagtgtacattttggtggaaatgagttacctgttgagtgtactaaccactcgtagtggtgctgtgctcttttga

SEQ ID NO: 106 - DNA, 2446 bp, Oryza sativa
agttgaggacctcccaaccagtaagcatttcgaggctcctgcctatgcttgatgtcaactatcaaagatgttgtttagtgctgtggaggtcaagtagcattggatcataaattcaaccaaaacaagacaggcatggaccgtgcagacacctcaggctttgtcagtggtggttgcttcagtactacactcctgctgatattcttccattttgtctattctgtgatctgtgtttgaaagatcatcagttccctgttcttcagctattcagtgattcagttgtcatttgctctcaccccgttgtcatattgtcaagctgtgatggataacagctttgtggatatcccaaatcaacctccaatgaataacccgtttgtgttaatggaaccctcagctcagagctacatggtgaaccttggcaaaagcacaccccacatggactgcctgggatctgcaatggctaattatggccatggtaatcaaaatatacagtgcattgatagcatcacaactagagatgatggttgcaggttagtccttgggttgggtccaacgccgaatttttactctgcagagtgtcagcccactggagtagacaagcttaaagaagctccttcgttatctggacagggtttgactatcaccgatcctgggacattgaggcttggccttcaaatggatgtttctcaaacaattcaacctttgcaagcaccagatggaacagttcattcttttactgttgttgatgaagcctcagcatctccttctgtaaggagcatcggtggctacatgccatccctactctttgctccacgctccggttcttctgctgtcaatgagacccacgaagcagaaacccaggattcactagacctgacgcacagcgacaatgataacactcagcacgttcaacatcaccttcagctgagccctgagccttctgccatgacagatacttcatttggtgtgagctccgacgttgtcacggcaacaaccacatcagaacaaaggaatcatccccggcatcccaagaagtgcaggttcaagggatgctcgaaaggtgcgagaggcgcatcagggctgtgtattgcccatggaggtgggcagagatgccataagcctgggtgccataaaggtgcagagagcagcactgcctattgcaaggcccatggcggtggtcggcggtgcgaggagcttggttgcaccaagagtgctgaagggaagacagattattgtatcgctcacggtggaggtcgtcgttgtgaacatgatggctgtcctaaagctgcacggggtaagtctgggcggtgcatcaagcacggtggtggtaagagatgcacggtgcaaggttgcatccggagcgctgagggtaaggccgggctctgcatttctcatggtggtggccgccggtgccagttcccggactgcagtaagggggctcaaggcagcacattgtactgcaaagggcatggcggtggcaagcggtgtatctttgacggctgcagcaaaggtgctgaggggagcacgcctctgtgcaaagcacacggtggcgggaagcgatgcatgttcgaaggtggcggcgtctgcccaaagagcgtccatggtggcactgagtactgcgtggcgcacggaggagggaagcgctgttcggtggctggctgcaccaagagtgcccgtggccgcacggactgttgcgtgaagcacggtggtggcaagaggtgcaaggtcgacaactgcagcaagagcgcccaggggagcacggacttctgcaaagcccacggcggcggcaagcggtgcacttggggaacgggctgcgagaagttcgcccgcggcaggagcggcctgtgcgccgcgcatgggaccttggcggccaagcagcaagagcgcgacgcggcgaacaacggcgcgggcatgatcccgccaggccttttcagcggcatagtgaccgtcgctgccacgagcagcatgacgaacgagtactcgtcgtcgggcatcagcaccgcgtcggactgcgacggcacggtgaggagccaggcgatgatgatacctccccaggtgctggtgcctcgctctatgatgccctcatcgtcgtccgaacctaccgtgcatgggggcagagagggaggctgtgccgttccggagggaagggtgcacggtggcggcctcttgtcactcctcggtggcagcttcaggaacgccgacatggataagctctgaatttgcttctccggctgccgaattctgttagtttggttgtgtacataaacaaggcaatttattttgccgatttgaacttctttggctttttttcctttgtctagataaatggtccgtggttgctttagtccagtcatttgtacattcatgtccgtggcaattgtcctgaacaccttctcatgtcagtttagtcagtcggaggaactggcaataaaatttgtgtattggttta

SEQ ID NO: 107 - DNA, 1417 bp, Sorghum bicolor
ggcagtttcagaattaagactccccaggtctttttcccacgcccgtttcttttctcaaaaagagggggcatggccgccccggcgtcgccgcactgttcccagtaaagacgcccactccttcccttccccctcccatcgacctctcccctccgtcgtctcccccaggagcatccgtgtcttcaccttttgttcccccacgttgatccttgatcctcgtgctccctttcttgattctttctcccgaaggatctcttgctaggagtagcctgccccgtgtgcgcgctcgcacggacatgcttcttgccgcgtcttgaaaggggagaaaaagtggagatgggtacttgcgcttcggttcacaaggacccggagtaccccaagaagcagtttcttgactcgcccaccaaggcgaagacagccaacgggaagggcggcggcggcggcgttgctccggttggtgatggctttggtgatctcaagtccaaggtcgacgctgagcagcagcgggcagagtttaaccccaagagcccggattctggtagcaaggatgaagtgttcttcgagtctcgagcttggttagattctgactgcgaggatgacttttacagcgtgaatggagatttcacaccatctcgtggcagcacacccatctaccagcccagagcacagacggtgatgagcaacatctttcaaccagacacgcacagctccaaatcaccagagccttctccaactggacggaggaagctagctgagctcctgcaggaggcaatgcaagacggccctgaagaaagcaccgacgagcagcagcagttgcaatctgttgtcgcagatgggaagccggtgtctgaatccacatccagctccgcttgcagcactgtaccgacgccgacggcagtcgacaagagcaggaaggagaaggcatggtatactggacgctgttgcctgccgagctttgttcatagcctgaccttagatgagagtgagagggggcagaagatgagctctaggcaatgtgctgtttgacagtggggctcaagtgccctcctgccctgagctgtatttaccggattgggacgctgaagagtactatatatgcatatccttagtaatcaagtggataatatagcagtactcgttaaatgctgtgcacaccatgttaatcaattgtgagggcagcgaatggtccttacctgtgcatatatcttatcgaatctttatggatatataaatatatatacttttcagatgtcaacagccagctgagctaaggcatgtggcatgtaggataatacctttctacagttcctacaatgttattgatctgagatgtcctcttggcacttgcatgattgacgccagacaaatgtgttgttcattgctctattctattccaagtggacctttttgtttcctcctc

SEQ ID NO: 108 - DNA, 1812 bp, Oryza sativa
agacacagccgagctcaggcgacgacgcccccgcctttaatgggctttccctcccaccgacatggccggcgatccccacacccgcgccgcccccggtgacctctcctcctcctccttctccttctccccctccccttccgccgccgcggttgcgcttggagttgggggtggcctcggcctcggcccctctaggctcctcctccacctcctcctcctccactccctcttatagcccaccgccaccggccgccgcgcgcccatggccgccgtgttcttccaccatgttgtcggcgacctcaccgtcgggaagcccgaggtcgtggagctgcacgacaccgacacgctcgacgccgccgcgcgggccatcgcggccagccccgagggcgccgtgcccgtgtggcggccccgggcggcgcccgacgagccgccgtcgggcgccaggttcctcgggatgatctccgcgctcgacatcgccacgttcgtggccgcttccggcgtcggtgaccgggccatggccgccgtggtcggggaggtcgtgcagcccaaccctggcctgctccgggaggtcgatccaggcacgaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacggacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacactgcgcctggttggttcttttttgtctttcgagagttggggagttttttgtccgcatgagactgaaactgaagggtatattgtgaattccttgtggatcggtgctactatggcagactcaggcttgtgctttggtacggtggaatgatagtctactcattcgtatatgtataatgtatcgtttctctgtgctcccttaccaatggcccaatgggatcagagatggggtaattaacccagcagctgccatttcttgtcaa

SEQ ID NO: 109 - DNA, 1611 bp, Oryza sativa
gaaaagggaaatgatatccatttcccaccctcctaatcccattagccatacgcagcccgagtgtcttccccttccctttgtggcgtaaaagaaagaaaatctcccgtctcctccgctccttgcgccgccaagacgagtcgcggctgaacaggggaggggcggcgatctccatctggcgagcagagcaggcgagaggattatgttctcgtttctcctaccctacaggatgtttagataattcgagaccctagctttgaactttgagtaggttcagttcttagctgtagaagatgaatggttcaagtggctcccaaggacataatgtcaatggaggacagaagaaagtgcagcatgctagcccactcactctgaacaatgggtcaaagcaccgtccattgactcccatgagacgatgccgcggtgtagcatgtgtggtgatcatactgtcaacagcattcacattgatagttttcatagcccctattactactttccttgttcggctagtcagcgtgcattacagtagaaaggcgacctctgttctgtttggaatgtggctatctttatggccattcttgtttgagaagatcaacaagaccaatgtggttttctctggtgaaagtgtacttccaaaaaagcgtgtcttgttatttgccaaccacaggactgaggttgactggatgtatttgtgggatcttgcattgaggaaaggctatttaggatatatcaagtacatccttaagagcagcttgatgaaattgcctgtttttagctgggcatttcacatttttgagtttatcccagtagaacggaaatgggagattgatgaagcaattatccagaacaaactgtcagcatttaaggaccccagagaccccctctggttggccgttttccctgagggcactgattatactgagaagaaatgcatcaagagtcaagaatatgcttcggagcatggtctgcctatacttaaaaatgttcttcttccaaagacaaaggggttcctttgctgtttgcaagagttgaagagctccctagatgcagtttatgatgtcacaatagcgtataagcatcgcctgccagattttctggatattatatatggcaccgatccttctgaagtccacatccacatcagaactgttaagctctgtgacattccaacgtcagaagatgaagtaaccgattggatgatagagaggttcaggcagaaggaccagcttctgtcagattttttcatgcaaggccacttccctgatgaaggaactgaaggggatgtatccacaccggagtgccttgctaatttcattgcaatagtcagctcgacaggcttcttcttgtacctatctcttttttcgtctgtgtggttcaaggtctatgtattattaagctgcgcttaccttacatttgttacctatttctccattcaaccaccccaactgatatgctcatcagagggtggaacccatgccaaaaaggtactgtagaaagaggctgtagctttgactggaaactgtatatctgcaaaagatatttactgtagaaacccttggcttgtgcaattgtcatcgttcctcttttgttttacttctgcaagatgatttagta

SEQ ID NO: 110 - DNA, 1702 bp, Hordeum vulgare
gaaaagagagctctgcacctgcacccacatccgccattcgatttcctttgctcctatccatccgccacaagacaccacaagccccgccgcctccgtcgccgtcgtcgccgcccgatccaaccgcccgccggcccgccagcccccacgcaccgggtcagggaacccgcctgcaaagagataatcgccatgagctcgctctgcccgttcgcgaaggccaccaccggcggcgtgtgccccatgaaatccgacaagaagcccgacaagagcggcggcgctgctgcgtgccccgtgacgggcaagactcatggcggcgaggacaaggagaccggcgccgaccgcgccgccgccggagaagagggcgcagaaggggaccctcgcctggtgcctgcaaagtgccccttcggctacgactccaacaccttcaagctcgggcccctcagctgcatggtctgccaggccctgctccacgacgccagcaaatgcaagccgtgcgcgcataagttctgcaaggcgtgcatatcgcgctttaaggactgcccgttgtgtggtgctgacatagaggggttcgagccggatgccgagctccaggccctcgtcgatcgcttcattgacggccatgcccgaatcaagagatcgcttgctggaggggatggccaagctgcggatggcaagagcaaagtgatatatgaggatgtctccatggagagaggcgctttcctagtgcaacaagccatgagggctttccgcgcacagaacattgaaagtgcaaagtcgaggctcagtatgtgtgcagaagacatcagggaggagttgaaatcttcagaagataacctagacctatgttctcagcttggggcagtgttgggaatgcttggggattgctgtcggaccttgggagatgcgccctcagcgattaaatactacgaagaaagtgctgagcttctgtcgaaattgcccaaaaaggatcttgagttggtccatacgctctcagtttcgcttaacaaagttggagaccttcgctactatgatggggacctacaatccgcaagaagttattatgcccgttcattagatgttcgcagaaattcagtgaaggaacactcagctgtggcctcccaggtcattgatctagcaacttctctagccaaagttgcggatgttgacagaaacctcggtaacgaagatgcggctgtcgagggctttgaggaagccatcaagtgcctggagaagttgaagctagaatctgagcaggctggcctagaacaaaggcggcgctcggttctcgatttcctgcagaagcaattgcatgaaaagtaacatggatgggcccagcgtgcactatccataacgaggttcagccgcatcgttgttgtgttgcaatatggaagttgttgtggtgcataagggaggagggaggtgctccagaaatggtgtcttgtgtgtaattccaatcacttgaattctgccgcggcacaaacgcgaacaaaggccgtgttgtacgtatcctaggagagttatcttcactgccgccaacatatgctcaggctctagctgccctgcggtcttctctctcaaacccgaaacaacatgggtgaaggcgaaacttgtctgaagctccttgttgttgcgcttggaatgcaaacaatcccgttgtatataacaataacacacaaaactgctagaatcttgaccatttcgcttt

SEQ ID NO: 111 - DNA, 1710 bp, Zea mays
gtcacactccagcccttccccccgcgccggcgcggcgaggccaccgaccggctggcgggtgttgcttcttcttctcccggcccacccggcctgcccgcaccaccgacccctccgctgagcgcgctcccacgcccattgaatcatagcgcgccgctcagtcgagcgaggatttctctaggatagcagccgccatcacctcctcgcctcgccgcgctccgctggtgctgctgggtcgctgctgagcggagcgggaatcggaccggactcggttcgaattcgtcctcaccttttcgtcgttcggatgccagaagccgagtggaatgatgaacacactaggattgtctgcgaactctttgaagaacaagttcgggctgggaacaggccaaacacgcatctgaacaacattggttaccgccaagttgcggctaagtttcagcagaggacagagcttctctatacaaaattgcagcttaagaacaaatgggacaagtttaagaatgattacatcacctggaggaagttgcttgtagtagggaagggtttaccctgggacacagcaaaggggacatttgttgctgacgaagaatggtggaagaagatcaataaggagctgccgggtgcaaggaaatttcgacatggcggtctacatcatgaggataagttgaatgtaatgtttgactacatcaccagtaatggtgtggatccttcaccgcctgcgccggaaagcccgaagaatggggtgaatcattcgccaccggctgcaactggtttgccatctgctccagactgcgcgctcaatggagtggatcattcgcctgtgactgcacatggtttgccatctggtccatacagccccatgaatgggatggatcagttgccactacccgcacatgatttgcgaagtgttcaagaaatccccatgaatggtgtgaacctcgatggattggacaacaacactgaagataatgatgacatttatcaagagcctgtgtttcagtatacttcaaacaggaagaagagaccgattagtttcagtgctacaaagaagaacaagaaaaacaaggctgaaactgctctgctcatgcaagctcatttgtatcgcataactgagctggctcagaaagcacaggatactttcaaaaagttcagctcccaagctgacttggtgccatggcctagcatccaggatgttatgacacttgtctgggaatgcggagcacggtgtggaagcaatgagcatttcatcgcaactgaactgtttgtcagtagagaacagagggagatgttcctgaccatggaaacggctgaggaacggttccagtggcttcgaagaaagtacattgtcaagtatttgtcaggtacaacgggtacaaatctgggtactagataaaatgatcctgggcatttgcattagattttctcccatgtctgttaggctctgttttggaccagcttcagaaaatttgatggagttgtgaatctttaaaagatatttagataagtcattttgtttattatttagattagaaatattttctaaaactatttaaatttatattataaaatatagccacaccctggagctggaacctgtagcagtctaaacatccccttaatatccgacatgacacatcacattttgtattggatcctgatatagcatgctttgcatcttgacaagtatggttgtatgaatgtatattctgatat

SEQ ID NO: 112 - DNA, 2250 bp, Zea mays
ggcacgacgaggcagggaaagccttcgtgctgcgtactcctatattaggctcgctccggaaggcgagcaggcccctcccctcgccctcgccctcgcccccgtccgccgccgagtgtttgggaagcgagcaagccgctcctccccatccttgttctacgattgccccgcgcgcatcccattcccacgtcgaagcggccgaggtagtcccggctgttgccagcgagcgatggcgagcaacggcatgtcgcttgtgcatcgagccgccgaggcggtgcgccgcacgccgcgatggaagaagaggctcgtcttattcgccgtcggagctagcaccttaacttacgcttgtcaagacaatcgagttcttcaaatttgtgatgggactggaaacaagaagaaggtggttatccttggtacaggatgggcaggtgcaagtttcttgagaaatatcgacacatctttgtatgatgtccatgtggtatcacctcgcaattacttcaccttcactcctttgttgccaagtgtgacatgtggcacagttgaagcacgtagtattgtggagccaattcgcaatattgtgagaaagagaaatggttcatttcgattttgggaggctgaatgcatcaagattgatccaagaaacaaaaaagtccattgcagatcagatgttgggacaaacattaatggaaacggtgaatttgttgtggattatgattacctgattgtcagtattggggctagacctaatactttcaacacacctggtgttactgagaattgccatttcctaaaggaagtagaggatgctcaaaagatcaggaagagtgtcatgaaatgttttgaaagagctgcccttccaaatctttctgaggaagagcgaaagaagaaccttcattttgttgttattggtggtggcccaactggggtagaatttgctgcagagttgcacgattttgtgaatgcggacttggcaaagctgtatcctgatgtaaagaagtatgtaaacatttcagtaattgaagcaggaggtcatatccttacaatgtttgacaaaagaatcaccgaatttgctgaagagaagttcaagagggatggcatagatttgaaaacaaattttaaagtcgtgaaggtgtctgataaggatattaccatgaccaatcctgctacaggagaggtcgctgttccttatgggatggcagtttggtcaactggaattggaacccgtcccatcatcttggatttcatgaagcaagttggtcaggagaaccggcgtgtgctagctactgacgagtggcttagggttcaagggtgtgaggatgtatatgctcttggtgattgtgcaacgattgctcaaagaaaagttatggaagatgttgcttccatattccgagtagcagacaaggataactctggcactttaaccgtgaagaaaataaaagatgtccttggggacatatatgagagatacccacaagtggaattgtatcttaaatccaaccaaatgaagagcttccacgagctacttaaagactcagatggtaactccaaggagttgaaagaactgaacatcgaacagttcaaaaaggcccttgctcaagtggactctcaagtcaagatgctcccagcaacggctcaggttgctgcacaagagggaagttacctagccgactgcttcaacagaatgaagacgtgtgaacaatatcctgagggtcctataaggatcagaggtgcagggcgccatcggttcaaacctttcaggtacaggcatctcgggcaattcgctccactgggtggagagcaaactgcttatcaattgccaggtgactgggtgcatgttggacacagcacccaatggctgtggtattctgtctatgcaagcaaacaattcagttggcgcacgaggatgctagtcatatcagactgggggaggcggttcatctttggaagggactccagtagcatatgaattcaaatctcccgattttgtagttcacctgcgttctagatactacttgcatcagttttgctgtcccactatttccgaagcttagcctcgcaaggtttctgataccaaattttgaccttgccaaatgttttgttacctcgtcatgcacactgagtgattcagatgttatatacgtcttatcggatatttgcttttttatgtagggcactatgatatctagctataccgatactaattgtaagtttgagttattttggtcattggcaatcaagtatctatttttgcta

SEQ ID NO: 113 - DNA, 2590 bp, Zea mays
ctctccccttctcctccttgcgggcctcctcgcccagcggactcctactctgctgcgctccgctccgttccgttccgctcccctcctcgcggcagcaatcgaatgtctcccgacgtagacgccgccgtggcaaccgccgtcgctcccgggggaggctgcggcggtgacggagaggcgggcgccggcacgtcgtcgtccccggcgtccgcggcgaacgggcgggcgttggtgcggtgggaccagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgcgagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaaccagtgagaaagaatgaactgcgtaacttatggcaacatgtgtggaggcggcatgcaatgaattgccagacaaatggatcagaaaataatgcagccagcaatcatattagtgccaacgttgctaatgggtcaaagacaggagaaaacagcgacgaggaaagtgatgcccaaagctttggtagcaagagggatactgaaattcatagtgttgaggcggtacaagatattcgtagagatgaagtggctggctcatccaaaaataacgaactacaaaataagtcttatgatggagtaaacacaaaagtggatgtgtcaaaatataccaatggtgctccaagtggaagtgagaagaatgtgcggtccaaatgccttaacggtattacttctgcaaaggtggctgagcaaattatggataatgccttgaggatcacggatgcaagttcacgccgtccaacaaatcttggcaatggtttggctatgactgagccagcagctgacagaaaatgtcaatcttcggtcatggaaaataatgctgtcacagaaaataaccctggtgataagtcgaagggtgctgcaataggtcatgctgattcttgcccctccgaatttatggtgaccaacttggggaaggaacaccatcttaatggttacaaaaaccaagaattcagggaaaaagatatctttaatcactcgaattcctctgccttttcaagatatggcaataaaaggatagaaccatcaggtgagattcagtttttcccttctccctgcgtcattgggcaagggcatgttaatggcaagaacccagttttccaacccaatggggtgttgctgcctcccaatgaacataatacaggtgagagtacaaggcaagctcgaatttctctggacagtaggacagagggtgctgccatcctgtgttccactagtgccagggaagatgctggtgcaaatagttcttcccatagaaaggacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaagctcccggtaaaccatctcatgttcttattgaacacaaacagtcagaggaaaaccaccagttgcatcattcaagacaaattcttcgggaatcaggagaaccaattgacatggcgagagctcacgtggatcgtgctaaccagactgcaagctgcagccaaggtatctgtaaaggaagtggatgcacatgtagtggtgaagccgatatcaacgcaaacacaatggttgccctagagagtggcaacgagagtggaatccaaaatggtgacaggtctcgccgtgaagctgcgttgatgaagtttcgcatgaaaaggaaagatagatgcttcgagaaaaaagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaggctggcagaagttttttcccttccatggttagcctttctgcacaacgggtgaactcttgtgtcgggtgtttggtgccgttgtggccttatttttgtaaagtgcatcaaattgacaaatgttcagaggggaatgggttgggggtttaggaaaacggtgcagctgccagatttcgcctctgtacttagatgtttgtgggggtgagaaagcagagcatgtacagcttattcacccattttgttgccattacactagtagtgacttgtactatgacaacagtagacattgttgtacagccttaccagtcagcagcgggtctttctcatttta

SEQ ID NO: 114 - DNA, 4796 bp, Zea mays
aaggtgaaaccctagctgctgcatctaccactcacgccgtcaccgccgacgccgactatcgccggaagcaggtcaacaggagagggacctctcaattgtcccttttctctctccccgcccaacttcccctgctctgccgccgcctccccagtccggcgtgcatcagcagcgacatcagagtcggcgatgggaggcgtcaccgacgttctcgtccccttatgttgatgaagtggcgtgccgtggagattcctttgaccgatttcttgccggttttaccttctctccgtcgtgcaagatcaatccttcattttctccgtcgtgcaaggtgagtcaattgaatcagatgctccacgttacgtccacccttgagctcgatggcagaaggaagcagtagccataggaggagtacattctcccctgggctggctgtgttattatctggcgatgaagctaagattagctcccagaagtcgcacctggtgtcctatcatgacgaaattgggcaccaggctgttgagaggacgatagagcacatctttgatctccctcacaagtcagtggtccggcctcctggaccaattgacataggcttcgtgcgctcagtggtgaggaatcaagctagaaaatttgatcttgactgggaaaactgcattcggggataccatcgcagcgtcttcattgtggacaaaggtgctgggcagaggaaggtggctcttgatgattcgagcatttgtggtagcttcaggaatgtccggggaccttcacttgttgagagttccgcccctttcagcagtgccagggctaatgcttgtgtgtggaaaggcaaatggatgtatgaggtgacccttgagacgtctggagttcagcagcttggatgggctactctctcttgtcctttcactgatcagaaaggtgttggtgatgctgatgattcatattcctttgatggccggagggtgactaagtggaacaatgacccaaagccatatggccagccatgggcagtaggtgatgtcatcggttgctgcatcaacttggatgcaggagaaatttccttttacaggaacgggacttctcttggtgttgcatttgatggaattcgcagcgtggaacctaagaagggatattatgctgcagtatccctctcggaaggagagcgttgtcatcttaatttcggctcacatccattcaggtatcctgttgatgggtttgatccattagaggcgccaccacgctcttggtcgtttgtcacataccttcttagatgcctgttccggttgctagaagttcacaacctggagaaatctgaatcagcatacttcgagaaactgaggagggtgaaaaaatttgcaccactacaagaactctttggacccatttcagaagggatctgtgcagaaattttcagtgctattgaagcaagccaggggtgccttgagtatattgcctggggctcgttgatcactctactcttagatgttttcagaactcgtgagccgcatgatttctcatgccttgatcaggttcttgaccttttcctccggttcccaggttgcacttcattatttcaggagctcattgtggccctttcttgcatgtgcaaagttgcaccacttgtgttgacagaatgcccatattctgggtcatatccatttttagcgctggtttgccaccttcttaggcataaggatgtaatgtgtttatggtggaaagcagaagatttcgttttctcgtttgaaggcttccttacaaggaagattccaaataagcaggatctacagtgccttgtgccatctgtttggtggcctggttcttctgaggatgaagttagcatgacactgacgatgacaacactctcagatgcaataaaaaagattgaggagatgcatcgtgaactttgcagcttggtaatatgctttattccaccaatgtctacgcctcagcctccaggctctgtatttaggtcctttgtacaaagtttggtgctcaaagctagaggtggagatcataggatggttgtcaatgggactttcaacaacactgtgcttgtttcattgtacacagtaatcctgcatttgttgtctgaaggattttctatggattctgctggatctgcatcatcctctaaagcgaactttgggaatggtgttggatttcttcacaaaggtggaaaacgcaagtttccgacacaattatttttcaggaatgatgcctatcacagtgtaattcctagaatcggtggaccaccaagtattttgatgcatcaccaatttgatgctgtggaaaatgaagtgcagtgggatgaaggctgcatgaatgatgaagagacacgtgttacacacactacagcacagaagccttgttgctgctcagtgacagatgttgctgttggcctaagatacaaagaaactgctaagtatgtgccatcaacttcaaaaggctcatgtaagcctatgcctgaaagatctcctcatgttgctgctgagtgcaatggtagaggtctgagtgatgagatcgaagacaaacctagcacaagtgctcaatcagaaattgaatatggataccaatcactgcatagtcttgaaaacatgccaatggcaactcaatcttcgtcggaaacacttaaagaagaagagctgcttgatgttatgttgttgttatatcatctcggcatctcaccaaattttaggcaggcattttatttcatgtctcagcagtcgcagtccatttctttactagaagaaactgacaggcagatacgagaaaaatcatgctcagagcaagtaaggcgtttgaaagaagcccggaatagctatcacgaggatttggtagattgtgtacggcattgtgtttggtaccgggccacccttttctcccagtggaagcaaaggggaatgtacgcaacttgcatgtgggtcgtggagcttcttttggtccttagtaactcaaatagcatgttccactatgttcctgagttctatgtggaatcactggtggattgtttccatgcactgcgaaggagcgatcctccttttgtttcccctgcattatttctcatgcaagggttggcctcgtttgtcactttggttgtcaagcacttcgatgatacaaggatagtgaaccctgacttgaaagatcttcttcttcaatcaatatcagttctcgtacagtataaagaattcatgcttgttttcgagaacaatcgggaggctataaataaaatgcctagatcactgttatcagcttttgacaacagatcatggattcctgttacaaacatactttcccggttctgcaaaggctcaggatttgcttcctataagaatggtgaatccgcatcatctgcaacttttcaggttctactgagggagacatgtattcatgaacaagagctgttcttttcctttcttaatcgacttttcaatacactcagctggacaatgaccgagttctctatgtccatccgggagatgcaagataaaaaccaggttgctgatttgcagcagaggaagtgcagtgtaatttttgatatctcatgtagccttgcgagaatcttggaattctgtacccgagagattccttgtgcttttctcatgggaccagatatgaatttgcggaggttgactgaattggttgtctttattctcaaccacatcatatcagtagctgatgcagagttctttgacatgacactaagacggccagggcagcatcaagagaaaacaaatcgtactatgatcttggctcctcttgtgggcattatcctcagtcttatggaatgtagcagcacatcagaacgaagggagctaaatgatgtgattgcagtgttcgccagcatggattgccctgccacaatccattttgggctgcagtacctactgagctacaactggagcaatgttcttcgaggggattcatcccttgcaaagctagcgcagcttaaagagttctcccattacttccgacgcattacagcgtccgtggatggtgaagaagaagaccatagcctaaacgcgggcgatgaagacgacgaccacacttgttgcatttgctacaactgtgattccgatgcaacattccagccatgccatcaccggtcctgctttggctgcataagcaggcatctcctgaacaaccagaggtgtttcttctgcaatgcagtggtaacatcggttactagatagccgattcgcgagcgatgcgctgctctactcattgcctccttcggtatcatgatccgaaggaagatggtgccactgatttgtcttaatctattttgcttgacctgagggctggggcgctggcgtcccagagatctttccattgcttttccaggaagaacgcgttacctttgtgcacgagggtcagaagcggttcttcgttttccttgctgtatatgtaaaggccaggtaatagtagaaaggattcaataacattgccgcagaaggaggtttctgtacacggtgggaagccagtaccaccgaaaggaatttcatggaatcgcaatttttgtagggtgtagggggagattccacgactgtaaatatgatgagatatgaaacagaaaagggggtggcagatcaacatcgaccttctgtaattagccagaataaaagaactagatgctttatattgagcagagctctcgtctttttgatcctccccacggtgtagtatcaagaatgaataaatcttctgtttcttgtctggttgtagcatgccagcatctgtaagttgtaacaattcagtgaatttatttaccttcagcaaaaagggtaaaaaggttgcctcttcaa

SEQ ID NO: 115 - DNA, 1435 bp, Zea mays
gccacacgctcgctgcgcctgcgtgcgtgtgctcgcctcccaccctccccgcactagctctgcactttccctggcagtcgtcccttgttcctgacttcctgcctgagcgcatccggccaccttctatccgcccgccagtccccgccggcctccgcggatcatctgcctgggatcaagatccgtcgaggccgaggcacccgcgcgccaaagatcgtttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcaccagcagatgcagatgtggagcagcattccccacttaagctccgtggccatggcggcgcgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctgagcctcctacagccatctcaggaagcaagcggcggcggcggcggcggcgtcatgtcgcgcagcagagaggaacggcgggacgggtagccaactgacagacaacgcacttgaatcggggtgtgtggcggcggcgattgtcctgtaaataccaagaattccgtccctttactggctcgttcatccagaactaatgctggtagctgccctgtgttgagcggcagctctgcttgttctagaagcttctgagaacatgtgtgggctatgttttccatgagattgtaagatgtgaggtggagccgctagaacacttagcgtgcgttttactgacagtgtggagtgctgctccttagttggaatagaaaaatgcaatttgatggctgtgctgctgtcttgatctgtt

SEQ ID NO: 116 - DNA, 1848 bp, Zea mays
cccaaacccttgccgctgccgccgcagatggaagtctgcgacgagctgcggtcatttgaggccacaggcgtctaccgcctcaatggcacctgcaccagcgccggagccacttacctcgacccggtccgcctcctcaacgcgtcctaccagcgcttccgcatcgtcccttctgcgtactactcccgaagcttcggcccccagcatcaggaaggcgagccagagatcgagcggcccgagaaaaggaggaaacgcaagcgtaatcagaagccgaagcccagggagctcaatccaatggaacggatcgctgaagcccggcaccaggaagcgaagcctttactattgaacgcacatgaatcactcgttaaggctaaacatctactggagtacatttccaagacaatcaaaggcaatgagcacacacttgatgcgggtagtggttctgagaataatttcgttgagcttgggacctcatggcgagcacctttctatgagatcactatttgcttccggaacccccatgttctgggcaatgaggaaggtttctttcatgcccaaaagacatcatttcctctatttaatagcttaatcagtgttgaagggactgacgaagctgaaggagaattccgtaataggcgttatattttaccaagaggaagttgcttcttgatggctgatttcaaacgagttagagatctcattccttgtagtccaaatcaagggtataatcttatagttgttgacccaccatgggagaatggatgtgttcggcagaaagaagtgtatcctacacttcccaacaaaaatttcttatatcttccagtgcaacaacttgcccatccaaccggagcgcttcttgttttgtggattacaaatagggagaaactgcgggcatttgttgagaaaaaactgcttccttcttggggagtggaagattccaccgtgttttattggcttaaggtgaaacctgatggctctctaattggtgatttagacttgttccatcacaggccctatgagtgcctcctccttggctacataaatgttaatgcaaatgctaagaaagggtcaaatttcaagttgttagaaagaagccaagtaatcatgagtgtccctggtgctcactcaaggaaacctccccttgagaaattactttcagaatatattccaggtcctaaaccttcaagatgcatcgagcttttcgccagagagttgtttcccagatggacctcttggggaaatgagccgcttcatttccaggataccatgtacttctcggagaaatagttcgatagccaagagcaggatataagtatgtggattctgatgcaactgccacgtgccacctaaggcaagtggttttgcaatagcattgtaccttgtgtttttcggcctttcttcaggtgatgaaaacgccccatctccagacgagtttgccgtctgctattgctgagtgctgacctactgtgtgacttctcgcttcccagcacttgattggtatcaagtcctttttttggccaaaagctggaggtttggcgaatcctatttatagggtgacctgtggggcagacatctcatattatttcttgcactacgcagttccctgcattgcagtgttcagtgtgcttctgggaatctcaatcaagttgtaacgggcagtcagagagatggaaagaatttgtacacagctagattcgttgggctcatctgcatcctggttactttccctagaacaattcggaaagttcctgtaaagttaggacagaggtttccatttccctgagcggctgagcagaactggttcgaagacaatggatgcaggccgtatccagtgccgattcttttggtgat

SEQ ID NO: 117 - DNA, 551 bp, Zea mays
tgtgattctggataggggcgctggcaccgattggctccggatatcgcagcgtggcggtcgctcagttcagtccgccatggaaggtgcagccggccaaatgctcgtcccgatcctcggcatcgttgccgtggccgccgtgaccttctacaccgtcagcttcatggagatgcgagacaaatccttcgaggagctcgacgagaagtactcggacttcgacgagtcaggcgggcggcagcggcggtctcgccgcagggccgagcgcgacaggaagaagtccaaatgattggccacgccgccatttgtgtccctgctggtttgagaggggactgacgggggatgaagacgcagctgctacttacaaatttttgggtttcaagtcatgggtgagtgtgagtgtgtgtggttatgaacatctgcctatttcctagctattagccactgaagcagctaaaacgatggatttatttaaaagatcgactccgtaatacattatgtaccctctgttgtgcttcaattctgtcatcgggacttataaaacaaattttcccatg

SEQ ID NO: 118 - DNA, 2565 bp, Zea mays
ctggaaaacagcgtgccgggccggccagcctttcccatccgcgcgcgcccgggaataggggccgcccgcaccatcgacgccggccaattcacccgccgtcgtcaagtgctggcgccggcggactggctccctggcaccggcgccgccgccccggacatggccggagcgccgtcgtcgctagcgcgcctcctcctcctcctcctgctagctgccggatgcctcctcccgctggtcgctgacgccgcgcggctcacgctgtccctcgcgcccgccgccgacgcgctcctcaggctcaaggccggcattaaggacgacggcggcgcgctcggcagctggtcccccgacacgagcccctgcgccgacggcgggcccaactggaagggcgtcctgtgcaacaaggacggcgtgcacggcctgcagctcgaggggatgggcctctccggcacgctcgacctgcgcgccctcaccagcctgcccggccccggcctccgcacgctgagcttcatgaacaacgagttcgccggcccgttgcccaacgtcaaagagctcagcggcctccgcgctgtctttctgtccgagaacaagttctccggtgtcatccccgccgacgcgttcgccgggatgggctcgctcaagaaggtggtcctgtccaataacgacttcactggccccatcccggcgtcgctcgccgacgcgcccaggctcctggagctgcgcctcaacgacaacaagtttcagggcaagatcccggacctgaaacaggaggagttgacggaagtcaacctcgcaaacaatgagctcgagggggagatcccggcgagcctcaaatctatgacatcggacatgtttgccggcaacaagaagctttgcggcccgccgctcggtgccaaatgcgaggcccccccgacgccgtcaccaaaggcgcatccgcaggcctccgtcaaagaaggcaccacgccgtcacaagcagcagcagacaccgtggcatccacgggcgcgtcgtcagcagacgacccgaagcaagacgaaggccaggagcccgtcgagggctccatttcgttcggcgtctccgccgcgttgcttggcacgcttttgatcgccggcgtggcgttcatcgcgctgcggaggcggagggggtacaaaaccaagaacttcggcccgaccgcgtcgtcgtctcgcccctcggggccgccaagggtcgagccgcacccgccggcggcaaaggcgcccgccgccgccgggggcgtggcgcacggcggcggcgcggcgcggaaggcggagcaggggcgactgacgttcgtgcgcgacgaccgcggccggttcttcgagctgcaggacctgctcaaggcgacggcggaggtgcttggcgccgccaacctcggcgtgtgctaccgcgccacgctcacgacgggccagtccgtcgtcgtgaagcggttcaaggagatgaaccgggtgggcagggaggacttcgaggagcacatgcggcggctgggccgtctcagccaccccaacctcctcccgctcgtcgcctactactaccgcaaggaggagaagctgctcatccacgactacgtccccaaccggagcttggcgaacctcctccatggcggcggcgagagcggcgggatgaagaaggcggcggtgcactgggcagcgcggctgaagatcgtgaagggcgtggcgcgggcgctcagctacctgtacgacgagctgtgcatgctcacggtgccgcacggccacctcaagtcgtccaacatcctgctcgacgcccaccacgggccgctgctgacggactacgcgctggtgccggtgatgaaccagtcgcacgccgcgcagctcatggtggccttcaagtccccggagcggaagcagttcggccgctcgtccaagaagagcgacgtctggtgcctcggcctgctcatcctcgagatactcactggaaggccgccgacctacgacccgcccaaggcggcggcgccctcaggcgagctgtcgtcgtcccagcagaagccggggccggcggcgggcaacaccgacctggtgaccgtcgtggggtcgacgccggagggcgagtggctgaacaccgtggtggaccgggacctgcggggcgaggaggaggaggacaaggaggagatggtgaagctgatcagggtcggcatggcgtgctgcgagagcaacgtggacaaccggtgggagctcaagaccgccatcgagaggatcgaggagctcaaggcgaaggagcgccccgacgaggagcaagcgacggtgatcgacgaggactacagcgatgttgccctcaactgatcatcgacacgaaccggccgggaatcgatcgatagggagggttgtgcgcaagctgatgatatgagcccaaaatgtgatgacctgcatgcatgccgagaccctaaacatggactagtactgtgtattcttatatacctttgctggttgttaattgccggtggtaggtttttggagagaaaagaagctacttatatataatcacacagatcttagtttgcttttctcagtgaacagaaatctattacaaagcatctggtggac

SEQ ID NO: 119 - DNA, 1304 bp, Zea mays
cccgagtaggctataccacctcccatgcgctctcacacaccccgctggccggctcacgcagaatagcactgcaggcctcagcctccctgtgcgctgtgcctccccaaaccccggcaccaaaaagggcctccgcgactgcgaccgatggctgccgccgaggccattgccaggggcgcgctgtcccgctcccgcgtggtggcgaggggactcgtgcacgcggcgcaggtggttggcctggccgtgttcctccgcgccttcgccgagttcccctggactgccgccgcggccccgcccatcctccgcgccgccgcttccttcctcgccccaccgcgcctctacttcctcgccgccaacgtcatcgtggtcgccctcgccacgctcttccgccgcgacgcggcctcatcctcgccgccgggctccagcggcggcgacgcgcagcacccgttcctcgcgttccttggcccggcgctgccgccgatcaccgaggcggaggagccctccgggcaggaggcgccgccggaggtggtgttcgaggacaaggaggcggtgcacgtgaggacgttgcgcgcccagcccccgcggcggagcatgtcggagaagacgggcggcggcggcggcggcggcgcagcgggcagtgcggcgtcgccggagctgcggcgagccaagtcggagaacggcaggcggcggcaacggcggtcgtcgtcgtcggcggcggcggcggcggtggcggagctgggggtggacgacggagaggcgttccggctggcggtcgaggcgttcatcgcgaagcagcagacctggttccaccgcgaggagtccctggtcgcccgtgccgacgccggtggggaagacggcccggcgatcgccggcgccgcggtggcggtgcagtgagcgagtgatcgagcaaaacgcaaccagtgaaccaaccctgcttgctgctgtgctgcaataacagtgtgattactgattggtgcgcgcgaaaggatcgggagaagagaacagggggccaacagccaactcggcgaaccaaaccaaggctgcttcttgctgcttttgttaatggaaaaaaaaggttttgcgttttggccgccgctcgtctttcctcctccaccgtacgtccgtatctgaagtttccgagggcattcttcatttcaacttgtgtcggctcttctcgtctgaacgccgagagcggcgacggcaggatgtatatgaagtctccgactccgtgtgcattttccttcggtgtagtgtatcagagcacctccaacagcttgtctcccaatactattaactatggatcatct

SEQ ID NO: 120 - DNA, 2033 bp, Oryza sativa
aatccaatccccaaaatctcaaaattccattgcttcccgtatttggcgttgctccactgattcgattggcgtcaccttcatcaatcgatcgctgcagactgcagttggttccctcctctcctgccaacgaccacgagccctagtttaggccgcccccaaatctactgccatccccgactagtatcccatttctcttgattttaagggatcctgagggggatgcttcctctactctgctgcagcaacgcttgacaaggctatcacatccaatccaatggtgcactgctgaccaacttcagtgtcgggatatccatgtctgaccatcaatttgccggccaaccagatgtgcagtgcctagtttgcacaaggccgtttactttggatgctcaggtgactgatacctttgaagctttagccatatgcagggactgcaaggccacagtacttaacgatgtcgaaagagatgaaataaccagcacttctcatcacacaagacggagaaggcagagatccaggactgcaagtattgattccctggaggacgcattctcgcaggagttctctcagctgatcgacttagcaagaagacaaggtcgtgaaacggatattgattcttcgtcagtcctgccgcaacatgcgtcgtacaatgcgacaccaagccactctcaaagatggcatgcttcagatgacgagagcgacggccttaattatgttgattctgtgtttggtgaaattgaatcaaccatcagttttggtgactatggtgcggattcagacacctccatagaggaacatagtgtatcggcaaggaggaggatttccattcaacttgacaatggaagttacatgaacacagataccgatattgatcccatgaatgctaggctggatcagtgggattcagatgaccaggaagatgtggaagagtctggttttgatgaaacaataaacaccatgacccagcaccagcagcaatcacatgatattcagctaagtggattgagtgaggacgaatctgaagatggtgtatggaattggagcgtggctgtacgtcaaagagcaaacgtgacaaacttgctagaggacatggaagggccagaaatgaggacaacttttgtcgggaatccagatgattatgttgatgcaaggcagttcgagatgctccttgagcaatttgctgaggacaacagttccagaagaggagctccaccagctgctacatcctttattgaaaatctcccctctgtgattatctccacaagtcatcagataaatgatgatgtgatctgtccggtctgcaaagatccaattcctaccagagctagagcaaaacagctaccatgcatgcatctttatcattcatcgtgcatcttgccatggtttagttctagaaatacatgtcctgtctgccgatatgagcttcctacagatgatgcagagtatgaaaggtccaagcaagccacaaccaatgtaagagacattcaggttgtggaagaaaattctgatgaacaagaggtccaggtaactcgtcagatggctgttggtgctatcgaagagactaatacaagtgaacacaatgttcgtgttgatgagcaaccaagcagtgcacgcaggcgcagtggatggctttttattgctgctgctccagtcgtaagccttatcggtttcgctctagttttatgctttacaaatcctgctaggagtggtagaaggcaactgtactgtagatccccaagtgccactgaagtacatgtgggtaccaaaaagagttggtggtctatgttctagaatgttccggcggtacatctgataacaaaatgactatatatggtggtgcgtgattgtttctttagaatagttttattttaaaattttcaaatgttgtagttgctgcagtgaccggtcggagtgttgtaaaagaattcacatgcctagtttcttctgctactttgctcagtcaagaaaagtgtgtattgatacttgctatttgtttaacatatatgtgccattggatatcctatgcttccttgatt

SEQ ID NO: 121 - DNA, 2493 bp, Oryza sativa
atcgagtgctacggtacaggagcatacttccatgctcccaaacgtatcctgtgcgttgggttttaaatcaagggctcaaagtgagtaggtagtcgatactctctcgtcaatggagatgggcagcctcagccgccggacgccgccgcccgagataaaccgaccaaaataggagtagaagaagaacagcaaaaaaggaaaaaaaatgttgcaggtggaggaggcgctggcggccgtgctgtccgcggcggcggcgagcgcggcggcgcgcgccgccgaggccgtgccgctgcacgacgcgctcgggctcgtcctcgcggaggacgtccgcgcgcccgaccccctccctcccttccgcgcctccatcaaggatgggtacgccgtcgtggcctccgacgggcccggggagtacccggtgattacggagtcgagggccggcgacgacgccctcggcgtggtcgtcacccccggcacggtggcgtatgtcacgaccggagggccgattccggatggtgctgacgccgtcgtgcaagtggaggacacggagcagctcgccggcgcgccggatgggtcgaagagggttaggatattggtgcggccaactcaggggcaggatatacgcaatgtgggatgtgacatacaaaaggattcggtagtgctgaagtctagtgagcacataggtcctgcagaaattgggttacttgcaaccgtgggagtgactactgtcaaggtatatcgtcgaccaaccattgctgtattttctacaggggatgaattagtggagccagccacagcatctctcagtcgtggtcagattcgtgattccaaccgggctatgttaattgctgctgctattcagcacaagtgcaaggtagttgacttgggtattgcaaaagacactgaggaaagtcttaaggagcatatggatgcagctctaagttctgatgctgatatcattcttacttctggtggtgtttccatgggcgatagggatcttgtcaaaccttgtttggcaagcatggggaaaattcactttgaaaagattcggatgaaaccagggaaaccattaacatttgctgagatcgtaacagaagattcatcaaaaccatctaaaaaggttcttgcatttgggttgcctggaaacccagtgagttgtgttgtttgcttcaatctctttgttgttcctgcaatacgttcactctctggctggtcaaatcctcatctaccaagagtgcacgcacgtctactgcatcctttaagaggagacccacatcgtcaagagttccatcgtgcagtgatcagatgggtgcctgatgatggatctggtagacctggatatgttgctgaaagcacgggccaacaagctagtagccgcctcctaagtatgaaatctgcgaatgctttactggaagtaccattagtggggcagatgttggaggctggaacatctatgcaagctatacttatttctgatatgaccagttcaccttttgacaagctacccactgcttcaaatccgttgccatctcatttatttccttctgcaaaaagtgtttccacagatttgtctcaggttccagcctcacagaatactgaagttaaagtagcaattctgacagtgagcgacactgtttcattgggtgcaggccctgacaggagtgggccaagggcaatatctgtagtgaattcttcatcagagaaattgggtggagcgactgttgttgctactgctgttgttccagacgatgtggaaaaaatcaagaacattttggtgaagtggagtgacattgatcgtgtcagcctcatcttgacactaggtggtactggtttcacacctagagatgtcacaccagaggcaacaaaatctgtcatagagaaagaagcacctggcctcacatatgtcatgcttcaggaaagtttgaaggtgacaccattcgcaatgctatctagagccactgcggggatcagaggatcaacacttatcatcaacatgcccgggaacccgaacgccgttgcggagtgcatggaggcgcttcttccagcactgaaacacgccctgaagcagataaagggtgataagagggagaagcacccgcgccatgtccctcacgctgaagctgcgcctgtggaccagtgggatcggagtttccgagccgcgtcgtccggcaggggatgctcgtgcgagccatgatcggggccgatgagaatttggtcctcgcgggctatcggcgttcacttcgtcagcttgtcagttccttcgttagcccagccgcgttcagctcggagctaagcagtgacgattttggttctgctcactgttttgttttcacttcacccgaaccttacgaacaccagtgtgacaaataaagtggttacagtatatttgatcttgtaacttcggcccgtttagttaccaaaaactttttgcaaaagcattacattgaatttttgaacacaagcattaaatatagataaaaagaaaaattaattgcagat

SEQ ID NO: 122 - DNA, 6902 bp, Oryza sativa
aaatcgccgggggaaaaaaaataaaaaagagaggaggcggtggaggctgcggcagagtaacagactcggcgcctccctcctctcgctgtggatctgcggcggcgagccggcggcgaagcaagcagcgcggcgcggatcctcgggcggcgaggttgttcgcacaatctcgctcatccgtcgcggcgattccatgagaggttgagagctttgcactgaagaagtgggggatattctgatctgctcagctaaagggggttgcagctaaacatggcggcggcattagcatggcggttcaatggaaccaatggaggcgcagatctggaacacaaagttcaagagtcagagccaccaactcctgtctcagtgatgagaatggtcaagaaccgtgccaatgtggaggatgaggagacactttcaagtgttgctcaatgtattgagcagttaaggcaaggttcttcatccacccaagagaaagagaactccctgaagcagttattggatcttcttgaaacaagagacaccacatttggagctgttggatcacatgcacaggctgtccctatacttgtttctctccttagatctggttcatctggtgttaagatgctggctgctactgtcctggggtctctttgcaaggaagaggagctaagggtgaaggttctgcttggtggttgcatccctcccttgcttgctcttctcaggtccaagtcagctgaaagccaaactgcagctgccaaaactatttatgctgtttctcaaggtggtataagagaccatgttggatcaaagattttctcaacagaaaatgttgttcctgtactgtgggagcagctcaaagttagcctcaagaatgagagtttagtggatggcctgctaactggagcattgaagaatttatcaaaaaacactgatgggttttggtcagctactgtgcaatgtggtggagttgatatacttataaagctggttgcttctggacaagcaaataccctagcaaatgcatgcaatcttcttggggctttgatgatggaagactcatctgtttgttctaaagttctatcgggagaaacaacaaaacaactcctaaagttacttggtcctggtaatgaaacttacattagagctgaagctgctggtgctctcaaatccctttctgcacagagtaaagaagcccggcgccagatagctaattctaatggaattcctgctcttataaatgctactattgctccatcaaaagagttcatgcaaggtgaatctgctcaggcattgcaagaaaatgctatgtgtgcattggcaaatatatctggtggtttatcttatgtaatatcaagccttggtgaaagtctagaatcatgctcttcacctgcacagattgctgacactgttggtgcattagcctcagccttgatgatatatgacactaattcagaatctatcagtgcttcagaccccctagtcgttgagaaaacactgatgaaacaatttaagcctaaggcaccattccttgtacaggaacgtgtgattgaagctttggccagcttgtacagtaatccagttctctgcaggacacttgcagattctgatgcaaaacgcttgcttgttggtttgataaccatggcaggtactgaggttcaagatgacctcaccaaatcactttttgctctctgcaagaaggattgtgatctatggcaagctctgcaaggtcgtgaaggtgttcagctcttgatttctttacttggtctttcctcagaacagcagcaggaatgtgctgttgctttgcttgcgcttctgtcaaaggagaatgatgagagcaaatgggctatcacagctgctggtggcattcctcctcttgttcagattttagaaactgggtctcccaaagctaaagaagattcagcaaccatccttggcaatttgtgcaaccacagtgaagacatacgggcatgtgttgaaagtgctgatgctgtgcctgctttactatggcttctgaaaaatggaagtgacaatggaaaggagatagcatctaaaacactgaatcatctcattcacaaatcagatacaggaactattagtcagttgtctgctcttttaactagtgaacaacctgaatcaaaagtttatgttctggatgctttgaaaagcttgctttctgtggcaccccttaatgatattctgcatgaaggaagtgctgcaaatgatgcagttgagactatgatcaaaattctcaactcacctaaagaagaaactcaggctaaatcagcatctgctcttgctggactgtttcattgtcgcaaggacttgcgagaaactcatattgcagtgaagacactttggtcagtcatgaagctgattgatgtgcagacagataaaatactaatggcggcctcatcctgccttgctgccatttttctgtcaatcaagcaaaataaggatgttgctgcaattgggcgggatgcattagctccacttgtctcacttgcaaattctacagttctagaagtagcagaacaagcgaccagagctttggcaaacctttttcttgatcatgaattatctctgcaagtatcttttgaagaaattatcttccccataacacatgtgcttagagagggatctattgatggaagaactcatgcagcagcagcaatagctcgccttttacagtgccggccaattaaccaacctctttcagatactattaaccgatcaggtgctgtccttgctctagctgggcttttggaagctgctaatggtgaagctgctgcaacatcagaagttgttgatgcgctggtgctattatcaaaaccaaaggtgtcaagtgggcataccaaagctccatggacagttcttgcagaaaatccccacaccatacttcctcttgtgtcatgtgtagcggatgcagcaccttcattgcaagacaaggccatagaagttttatcgaggctctgttctgatcaacatgatattgtgggtggtttggtttcagaaatcccaggctgcatatcatcagttgcacggcgagtcattgggtccaacatgcttaaagttaaagttggtggatgtgctcttcttgtttgcgcagcgaaagagcattgtcagaagcagatagagattctcagtgactcaagcttgtacattcaactaatccattctctagtcagtatgattcatatgacaaacttgccttctgaaaatgggagtggtgaaaacatatcagacattaaaatttctagacactccaaagaaaataacaacagcgatgaaactgtgtgccgcactgctgtaatctcaggtaacatgattccgctatggctgcttgctgtttttgcacgccatgacagcaaaacaagggctgaaattctagaagctggagcagtcgaaatgcttatggagaagatttctcaaaatgcattcctatatgtgggtgaagaagatagcaccgcatgggtctgtgccttacttcttgctttgctatttcaagaaagagagataaatcgatctaatgcagcattgcactcaattcctgtgctctcaaacttgttgaggtcagatgaacaagcatacaggtactttgctgcacaagctttggcaagtctggtttgcaacggtagcagaggaactcttcttgctgttgctaattctggggcggccactggacttatttctttgcttggatgtgctgaggttgatatagctgatcttttggaattatcagaggagttcatgttggttcctaatcctgatcaaattacactggaaaggctttttagagttgatgatatcagggttggcgcaacttccagaaaatctattcctcttcttgttgacctactcaaacccattccagaaagacctggtgctcctttcttggcgttgggtcttctgacacaattagctattgattgccccccaaacatgatgctaatggctgaagctggaatcctagaggcacttaccaaatacttgtcacttagcccacaagatgcaacagaagaagctacaactgatttgttaggcattctttttagttgcgcagaaataaggcacaatgaagcagcacttggtactgttaaccaacttgtggcagtccttcgtctaggaggaagaaattcacgctacagtgctgcgaaggcattagagagcttatttattgcagaccatgtcaggaacagtgagtcagctcgccaggctattcaaccacttgtagaaattctgagtactggcatggagagggagcagcatgcagctacatcagcacttgttaggctgctttctgacaatccatcaagagcacttacggttgcagatgttgagatgaatgcagtggatgtcctgtgccggattctttcttcggattcttcagctgagttgaaaggagatgctgctgaactatgctgtgtgctatttgcaaatacaaggatccgctctacatcagctgcagcccggtgtgtggagcctttggttgctttactcgtttgtgaagctaacccagcccagctttctgtagtccgtgcactggacaggcttctagatgatgagcaactagcagaattagttgcggcccatggggcagtcattcctcttgttggccttttgtttggcaaaaactacacgctccatgaggcagttgctagagctttggtaaaacttggaaaggataggccaggttgcaaattggaaatggtcaaggctggtgtaattgagagcattctagatattctgcatgatgctccagatttcctttgcattgctttggcagaaatgcttcggattttgacaaacaatgctagcatagctaaaggtccatcggcagccaaagtagtccagccccttttctctttactatccaaggcagatattggtcctgaggggcagtacagcactttgcaggttcttgtgaatattttagagcatcctgaatgccgtgctgattacaatttgacaccccggcaaactattgagccagtcatttctttactgaattcctctccgcctgctgtccaacaattagctgcagaactcctatcacatcttattctagaagagaacctccagaaggacacaataacggagttggccatccctcctctaattcaagttctttcatcgggtttgccaaacttgcagcaaagggctataaaagctcttgctaaccttgcattagcttggccaaatacgattgcaaaggagggtggtgtttttgagctgtccaaggtgttgttgcaatctgaccctcctttgcctcatgttgtatgggaatctgctgcatctgtcttgtctagcatattgcagtacagtactgagtttttccttgaggtgcctgttgcagtactagtgcagttactcagatcaggaacagaaagtactgtcgttggtgcactgaatgcattgcttgtattggagagtgatgattcgacaagtgcggaggcaatggctgagagtggtgctgtggaagctttgctggatctcttgaggagtcatcagtgtgaggaagctgctgccagactcattgaagcacttctgaacaatgtaagaataagggaggcgaaggctgctaaaaatgctattgcacctttgtccatgtaccttctggatcctcagacacaatctcaacaaggaaggttgcttgctgctcttgctcttggagatcttttccaaaatgagggtcttgctcgttctactgatgctgttgccgcatgccgtgctctagtaaatcttcttgaagaccagccaactgaagagatgaaagtggtagccatttgtgccttgcagaatctagtgatgtatagccgagcaaataagagggcagttgcagaatcgggtggcgtccaggttctgctggatcttatcagttcaagcaatcctgatacctctgttcaggcagctatgtttgttaaacttctattcaataaccacactatccaagagtatgccactagtgaaacagtcagagttataactgcttcaattgagaaggacatatgggcatctgggagtgctaatgaggagtatcttaaggctcttaacgctctacttagtaacttccctcgcttaagggtcactgaacctgctaccttatgcattcctcatcttgtaacatctctcaagactggttctgaggcaacccaggaagctgcactggactcactgtatcttcttagacaagcatggggagcttgtgcagcagaaatatttaaagctcagtcagttgctgcctcagaggctattccgctacttcagtacttgatacagtctggcccacctcggttccaagaaaaggcagaattgcttcttcagtgcttgcctggtactttgacagttactataaagcgtggcaacaatctaaggcaatcagttggaaatcctagcgcattttgcaagcttactcttggaaataatccgccaaggctgacaaagattgtctcaactggtgcaacacctgaatgggatgaagcctttgcgtgggcgtttgacagccctccaaaggggcagaagcttcatatctcctgcaaaaacaatagcaaattcggaaagaaatcatttggtaaggtgacaatccagatcgatcgggttgtcatgctgggctccgttgctggcgaatacaccttgctaccagagagtaaaagcggtcctaataggaacctggaaattgaattccaatggtcaaacaaatgacaagtatctacatagttaggttatctgtgtaagttaaaatccataagaagttgagagagtgttcttgttttccatactctgctataaacgttaccatatttgtgcatcagtgtaaatagcctgcagagaaatttgtcgttttgttgtacctttctgtgagataaaagagaacagatgagtcatattttgtactgattgtaatgaattgattcatttttttc

SEQ ID NO: 123 - DNA, 2865 bp, Oryza sativa
agccaggctgccgcccgtccgtccgcccccgcgcaccacgcggcgtctcgtcctcctctcatcggaccaccaaatttgcagctcgcctccacctccacctccacctccacctcctccgcctccgcctccgcctccaaaccctagcgcctcgccgcccaccgacccccgcgcttctcctccatccatgcgcccccgtctcgtcgccgccgccgccgccgccgatcatggctgcctctagggtttcccgggcccagccatggtgatctcatccccgccaacgaaccactcttctgcatcgctttgtacgattcgcccgagcctggatcccgccttcattgacgcgcccgctgtccgggaacaccatgatgtcgaggtttatgcaaatagggaagagcagaaaactagttcatgatgtattggttaactcgaaacccaatagtttcactgcacataacattggatccaactttgcgttcggtttggcacatacaggcagggcctgtttgcacgggaaggttccgcatggaccgggcacgtcatccatgcttggaagagcaaaggagagtttataccggaatccagctgcaagaaacttttcagttctctcaacatgtagccagaatgcatttcatggtcaacttgcttggaagcaactcatgacaatcggttctcatgtaccaaaggcatctccgattttaagtagggttgcttgtgccattagcttggctgccactagatctaatttagttccttacctctttgctttcgttgctggggagataatgctagctcagaagaccagtgcagacggagagtacttaccaattcgtgatagtctttacacgcgtgctcaagatggtcgtatctatgtcacctccttgatattttcagcagtagagctggtcatcataatcttcagatcaatatatttggcattgttgttcactccaagtatactcatggccccatttgcagatactcttggcagtaagtacaggaaaacatggctccgtcttgtgcatcgtaccctggagaaagcaggtcctgcatttattaaatggggccaatgggctgctactcgccctgatttatttgaaagtgacctctgtgctgaattgtcaaaactacacacaaaagcacctgctcacagctttgcttataccaagaagactgttgagaaagcttttggtcgaaagctatctgatctttttgagaattttgaagaagagcctgttgcttctggaagtgttgctcaagtgcaccgagctggtttgagattccggtatcctggccagcatataaagcgtgtaacagttgctgtaaaagtaagacatcctggcgtaggagaatcaatacggagggatttcactatcattaatgcagtagctaaaatttctagatatattcctacattgaattggttgcggctggatgagagtgtgcaacagtttgctgtctttatgatgtctcaagttgaccttgcaagggaagctgctcatttgagccggtttatctacaacttccgaaggtggaaggatgtgtcttttccaaaacctctttacccacttgttcatcctgctgtattggttgaaacttatgagcaaggtgagagtgttgcacactatgtcgatgacctcgatggacatgatcgaattaaaagcgcccttgcacatattggcactcatgctctcctgaaaatgcttctggttgataactttgttcatgcggatatgcaccctggaaatattttggtccgtgttatacaaccaaggaattcaaataacacccttttgaagtctaggccacatgtagtattccttgatgtaggaatgactgctgaactttcaagtaatgatcgtgtgaatttactggaatttttcaaggctgttgcacgccgagatggtcgtacagctgcagaacgtacactgaggttatcaaaacagcaaaactgcccaaatccaaaagccttcattgaggaagttgaacggtcgttttccttttggggaacctctgaaggtgatgctgtccacccagctgagtgtatgcaccagttgcttgagcaagtacggcgccataaagtaaacattgatgggaacgtttgtactgttatggtcactacattagttcttgagggctggcagcgcaagttggatccagattacaatgttatgaaaacattacaaactttactttttaaggaagactgggccaagtctcttcagtacacaatcgaagggcttatggcaccttagggatgcattggaatccactaaaaaattttgaccccttttttgcgcagttgatgagatattggaggatgctccttcgcaccagtacatctagtttctttttcctgtttacttttaaattccacagttttgtacccatcttggccagtgctgcttaaacggccatgtctaattaataattgcagcattttttcaagctaccagagaagtgtgctctggacccacaataccctgggattatctgcttatgcactctgcaggccaaaggatgcgttctcctccatgaaatttctgttaatagctcttagaagatgtagcaaaaggccttcgctgatgatctttttgtaactcgagaggtgtcagtgaacaagaggttttttattgtatacacagatacagctaactgttccaaaaaaaacctacgtcatgcctgacaaaattcatggattgcccatataactgagtgctttcgcatttgtttggaatgcagaagacttaactgtacaaatgtttgctggtaagcaggcatagagtttatttccaggttgcttctgcgtttcaaattcctgtcttatgttgatacaaaatactagccaaattcctccttttatacgtc

SEQ ID NO: 124 - DNA, 3614 bp, Zea mays
cagtactacgcaggaaggaagagagagaaccatttgaagcttcgaggtcgtcacgcacagatttaagtgagcccaaacccgcggagtctcatccgttcatcccaccggttcgttcgtcttcctgcatcagccctgagcgtttaattgcgccgccgcctccttgtccttcgcccaagtctcgccgagcaatgcggcctctcgcgctgctcgttctcgcccacctcgccgccctcgcggcggcggcggaggccaagggcggcgtggcgggggcggggctgggcgacgacgtgctggggctgatcgtgttcaaggccgacgtgtcggaccccgacggccgcctcgcgacgtggagcgaggacgacgagcggccctgcgcctgggacggcgtcacctgcgacgcgcgcaccggccgcgtctccgcgctctccctcgccggcttcggcctctccggcaagctcggccggggcctcctccgcctcgaggcgctccagtcgctctccctcgcccgcaacaacctctccggcgacgtccccgccgacctcgcccgcctcccggcgctccagacgctggacctcagcgccaacgcattcgccggcgccgtcccggaggggctcttcggccggtgccgctccctccgcgacgtctcgctcgccaacaacgccttctccggcggcatcccgcgggacgtcgccgcgtgcgccacgctcgcgtcgctcaacctctcctccaaccgcctggacggcgcgctgcccagcgacatttggtccctcaacgcgctgcgcacgctggacatctcgggcaatgccgtcaccggcgacctcccgatcggtgtcagcaggatgtttaaccttcgggagcttaatctgcgaggcaaccgtctcactggtagcctcccggacgacattggggactgcccgctgctcaggtcagtggatcttgggtccaactcgctgtccggcaacttacctgagtccctgaggaggctctccacctgcacataccttgatttgagctcaaatgagttcactgggagtgtcccgacatggtttggagaaatgacaagcctggaaatgctggatttgtcggggaacaggttgtctggcgagatccctgggtctattggtgagttgatgtcactgagggagctgaggttgtcagggaatgggttcaccggagccttacctgaatcaattggtggatgcaagagcctgatgcatgttgatgtcagctggaattctcttacgggtgcactgcctacctgggttctcagttccagtgtgcaatgggtgtcggtgtcgcagaacacattgagcggggacctaaaagtgcctgcaaatgcttcttcagtgcttcaaggagtggacttgtcaaacaatgccttctctggagttataccatcggaaatctcgaagctgcagaacttgcagtcattgaacatgtcatggaactcaatgtatggaagtattccggccagcattttggagatgaagtcactggaggttcttgattttactgccaaccggctaaatgggtgcattccagcttcaaaaggaggggagtcattgaaggagttgaggctggggaagaacttcctgactggcaacatcccagctcagattggcaattgctctgccctcgcatcactggatctttctcataacagtttaacaggagtgattccggaagcactatctaaccttaccaatctcgagattgtggatctttctcagaacaagcttactggtgttctaccaaagcagctttctaatctcccccacctcttgcaattcaatgtttcacataaccagctctctggggatctccctcccggtagcttctttgacaccatccccctatcttgtgtgtcggataatcctggcctttgtggcgcgaagctcaattcatcttgtcctggtgtgctaccaaaaccaatcgtgctgaacccaaacacttcttccgatccaatatcaccaaccgagcttgtgcctgatggtggtcgccatcataagaaaaccatactcagcatctcggcccttgttgcaattggtgctgctgttctaattgctgttggtgtcattaccatcactgttcttaaccttcgagtgcgtgcccctggatctcattctggtgctgtcctggaactctcagatggatatctcagccagtcgccaacaaccgacatgaacgcagggaagcttgtcatgtttggaggaggaaatccggagttcagtgccagcacccatgctcttctgaacaaggattgcgagcttgggcgtggtggttttggcactgtctacaagaccactcttcgagatggacaacctgttgccatcaagaagctcactgtgtcaagcttggttaaatctcaagttgaatttgagagagaagtgaagatgctgggtaagctacgccatcgcaacctagttgcgctaaagggatattactggacgccgtcgcttcagcttctcatttatgagtttgtctccgggggcaacctgcacaaacaattgcatgagtcatccaccacaaactgcctgccatggaaggagaggtttgacatagtcctcggtatagcgagaagccttgctcatctccacaggcatgatattatccactacaatctgaaatcaagcaacatcctgctcgacggatcaggcgaggcaaaggtaggagattatgggctagcgaagctgcttccaatgctggaccgctacgtcttaagtagcaaggtgcagagcgcgcttggatacatggctccagagtttgcgtgcaggaccgtgaagatcacggagaaatgcgatgtgtacgggttcggcgtccttatcctcgagatcctgacagggaggacgcccgtggagtacatggaggacgacgtggtcgtgctctgcgatgtggtgagggcggctctggacgaaggcaaggtggaagagtgcgtcgacgagaggctctgcggcaagtttccgctggaggaggccgttccgatcatgaagctgggtctggtctgcacttcccaggttccgtctaacaggccagacatgggtgaggtggtgaacatactggagctgatcagatgcccccaggacagcccggagactgaactgggttaacctcctctactacctacactggatcccggactgtttgttggtttcacttttgagatccttctttgcttggtaactgaccggacgatgaaaggtgaagcaagcgagttctactctatccagtgtgccgtcgccgaagtgtctagctagtcttctgatggttagggagttattatggaacgcctacagtagtttggtcgcctcccggggtgttgatgtgtttgacttagatcctcaccagtaaggccaagatgtatggtgtggatcctctcacatcaatcctggtggcctgtaatttcaatttattttttttagctatgcaatgtggtgcaacttgccctttttctagaccatgttatgaaagcttgccacattttggatccttgctgtctaaccacccatttaattaacttggaaatgtgtaccactaaaccgagtactgctgggcggtactcaccatggcaagtgccagtaccagccagtcaagagagtgttgtgtttatatttgtc

SEQ ID NO: 125 - DNA, 1699 bp, Zea mays
cacacacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgccggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcctacttcgcccggccttcaggtttggacgccgccagggaggagcccgccgaggcctctgcctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttgggg

SEQ ID NO: 126 - DNA, 3427 bp, Hordeum vulgare
aatcggtgtggtgctctcccgtccccgcggcaagaacggcggctggacaagaaaaaaaaaccaaaaaaaaaaaagagagagagaagaagaacgcagagcaccacaccgatttccgcccaacctatcgatcgaagccccgggattccaatccggaagaaatccctcgagaaaatcggagtaagcctcgatcctcctccctccggatcccacagcgccgctccggcgcgacgtcgaaaccctagtggggatggcggaggtgtccgcggcggcggcgccggtgccggagggcgtcctgcacaggaggatagagttccaccccgccaggaggccgcacgccgcggtggccgtcgggggaggcgggttccagatggagaccctcaacccggatgccgccgatggggcggcggcggcggcggggggtgcggccaggggcgaggcggaggcgcggaggccggagaaggccgaggctctgggcttggatccggagctcaccgtcgccaggatctacctcgggagaatcggtgctggtctgcaaaatcttgggaacacttgctacctcaactcggttctgcaatgcttgacgtacaccgagccgttcgcagcctacttgcagagtggaaggcacgagtcttcatgccgtactgctggattttgtgcactgtgtgctcttcagaaccatgttaagactgcgctacagtcaactggaaaaatagtgactccatcacaaattgtgaagaacttgcgctgcatttctcgtagcttccgtaattcgaggcaggaagatgctcatgagttaatggttaacttgcttgaatcaatgcataaatgctgtttaccttctggagtaccgagtgagtctgcaagtgctcatgagaagagcttagttcacaaaatatttggtggccgcctaagaagtcaggtgaaatgcacaaggtgctcgcattgttccaacacatttgatcctttcttggatctcagtcttgatattggcaaggccacaactttggtgagagcacttcagaattttaccgaggatgaactacttgatggcggtcaaaagcagtatcagtgcgagcgctgcaggcagaaagttgtagcaaagaaaaggttcacaattgatagggctccaaatgttttgacagttcatctgaagcgctttagccctttccgtccccgtgaaaagattgacaaaaaagtggattttcaacctgttctagacttgaaaccatttatgagtgattctaaaggcgcaaattacaaatacagtctttatggtgtcttggttcatgctggttggagcactcaatctggtcattattattgctttgttcggacttccagcgggatgtggcacaatcttgatgataatcaggtacgccaagttcgtgagccagacgtactgaaacagaaagcctatatgttattttatgtacgtgacagaattgggaacacattggggtgcaaagacaacatcactcctaatctgcctgtaaacaaagtgattcctgggaagatttcatctatcaatggtgcaatccgaagtggtgtaatggaagcaaaatcgagtggtctgacatctccttatgcaaataagaagttgcagagtacaagcaacgcccattctagcgttagcaatatgactttagtagaccattgttcaacaaatgatggcaaagctgaaactgctgcagcccctcaaaacagtgtcctgcctgccgcacagaaagcccttggacctcaaaatgatggtgttacattgtcaactaagtcaaagcaagttgcttcaagtaatcataaagagacatcttcatcaggtcaaccggcgagcagcaatcagacaatggctaagatgtcattgcaggaaccaaaggctggtggtgcatttgccaagctgggaaacaatacttctattgtctcatctatggtcagtggtcctgctggactgtcagagacagataaacaaacttcttgcgctcaaacatgttccaagccaagcttgaacttggttggcacgattaccgggtttaccacacaaactttccaaactaaggatgctgttgtttcaaatggtgtgatccctagcaccagcggtggaggtccagtttccagtgagaaaatgaaggacttaacaggatctctcaagcaagatgaccacacggtgaaggctttgacgacgagcaaggagaaaaccctactaccaggacttgagcaagttgatgtcggaaaacagatctcctcgcaagtttccacaaaagtggttccaggcgattcatgtaatggcagaatgactaaaagggtggactggaagtcaaagaaacttgtgagatatccagtaattaagttgtggcttcggccaagacaattgccactaaagcaacaaaagaagaagcataagagaaccaaaaagcacgctatagtcaaggacacgaccagtgttgattgttctggtgacaacagcagtgagcagcagacatcaacatcagcaactgtgccgcccaaaactgcagaatctacatctcgtaagcggaaacattcccatgctagtgtaagttctgaaaatgacaccaaagcattcaaagatagccagcaggttgttggagcaagtagtgctggtgctggtgatcataacatggacaccaggaacagtaagagtggaacttctgctagcacagggcttccaaagttgggctcaagctcttctgcaaatcaagcacattcaagaaacaacggagatgcaaagaggcaagtcgttattcacacagaggacttgagggcggaagttactgttccatgctgggatgatgttgccgtgccaaacaccgagactatagagtacagaagttcagggaagaagagcattggatatgtgctggatgagtgggatgaggagtacgaccgtggaaaggcaaagaaggtcagaaaagcgaaggaagacgaggacgacgacggcacgaaccccttccaggctgaggcaaaccacgtatcagcgcgaaaggagaaacaaagaccttggagcaagccggccagaccacgtcgctaggcgagctgaagagacgccgccccaagaagactcggtagaaagaaaagaaagaaaatgttgtatcgcctgtttttccaagacgccttcctttctcgccttgtttgttcccttttccgccttgttgttcgactcgacgtctcaagtagaaccgcactctttgatcgatcaggacctgcatttaattgtgagagattctttgtagcgtagtagccgtgggacatgccgccgtttttgtcgtagcatttttttggttcttgttactccagcagcacagctatggattatcatgaataatatgggttagccatcctttctgcagcggtttcagttgctggtacgtcgcaatgcaagtcgtatttctggtatatatatatatggtagaaatgc

SEQ ID NO: 127 - DNA, 1227 bp, Hordeum vulgare
aattttttttgaaggaaactcggtgacacggcggctcgccccggtttccccattccggtgggcgccggccggaatcccccgccccagcgcagacccgggggacctcccctccgtcgcgtccactataagcaacgcaccgacgccccccgacaacgagccatgaccccgccgtcgcccccatcatgccgccgctcctcctgctcctcctcgccgccctcgccccggtcctctcccacgccgccgccggaggttcctacgacccggcgcgcgtcgcccagatctcctggcgtccaagggcgttcctctacagcggcttcctctcgcacgccgagtgcgaccacctcgtcgagctggccaaggggaggctggagaagtcgatggtggcggacaacgactccgggaagagtgtcatgagcgaggtgcgcacaagctccggcaccttcttgtccaagcgcgaggatgaaattatctctggaattgaaaagcgtgtagctgtttggacatttctccctgaagaaaatgctgagtcaatgcaggttctgcattatgaagttggacagaagtatgacgcccacttcgattattttagtgacaaaaagaacgtgaagcgtggtggtcatcgagttgctactgttcttatgtacctgactgatgtgaagaagggtggagagactgtgttcccagttgctgagggaagagatttacagcacaaggatgaaacgtggaccgagtgcgcaagacatggcctggcagtgaagccaagaaaaggcgacgcgctcctgttcttcagtctccacgttaacgcgacgacagatccgagcagtcttcatgcgagctgcccagtagtcgagggcgagaagtggtctgccacaaaatggatccacgtccggtcattcgacaatcctccagatgttatgacggacgcaccgtgttctgatgccaatgagcaatgccctagatgggctgctcttggggagtgttacaagaacgcaaaatacatggtgggcacgaaggacacactcgggtcttgccgcaaaagttgcggggtctgcgatgcttgaaccaccccaccaatcttaactgaatttgcatggttactgagacgtagattaccaaaccaagtaggttcttagtagcatggcatgagatgtttactcttcttgtcatgtagtttgacctcagattatcttgatatataaagcagaaaagaaattgacctgtattcag

SEQ ID NO: 128 - DNA, 1747 bp, Hordeum vulgare
gctcgctcaaaatctttatcgacctttgataccaagcaagtacagggagcatcatccgtccgaggctcctagtcgatcgcgcaccaaccaaatggagaccccgaccgtcgtgctgctgcccgtctggtccgccggccacctcatgtccatgctcgacgccggcaagcggctgcttgcccgcagcggcggcgggctgtcgctcacggtgctcgtcatgcaggcgccggcggcgaacgacagggccgaggtcgccgcccacatacaaagggaggaggcgtccggcctggacatccgcttccagcacctccccgccgtcgagcccccgacggactgcctgggcatcgaggagttcgtctcccggttcgtgcagctccacgcggcccacgtgaaggcagccatctccggcttggcatgccccgtggccgcgctcgtcgtcgacttcttctgcacaacgatgctcgacgtgtcccgggagctagtcgtgccggcctacgtctacatcacagccgacgccgccttctacgcgctcctcctgcgcttgccggcgctccacgaggaggtcgccgtcgagttcgaggagatggaaggcatggtcggcgtgcctggcctgccgccggtgccgccgtcgtccctcccggttccggtgatggataagaagaaccccaactacacgtggttcgtgtaccacggcaggcgtatcacggaggccaagggcgtcatcattaacacggtcaccgagctggagcagagcgttcttgcagccatcggcgacggccggtgcacgcccggaattcctgccccgacggtctatccagtaggccccgtgctctccttgacgccgccagcggaggagacacacgaatgcgtgcggtggctggacgcgcagcctccggcgtccgtggtgctcctctgtttcggcagtatggggttctccacggcgcctcaggcgcacgagatagcccacggactggagcgcagcgggcagcgcttcctgtgggttctgcgcggcccgccggcagccggtgcgggacccggacagccctcggacgcggacctcggggagctgctcccggaggggttcttggagaggacaaaggagaagggcatggtgtggccgaccaaggctccgcagaaggagatcctggcgcacgcctctgtggggggcttcgtgacgcacggcgggtggaactcgaccctggagagcctgtggttcggcgtgccgatggtgccatggccgctgtacgcggagcagcacctgaacgcgttcacgctggtggcctacatgggcgtggccgtggccatggaggtggacaggaagaggaacaacttcgtcgccgcgtcggagctggagcgggccgtgaaggtgctcatggagcgcgactccgaggaggggaagagggcgagggagaaggccgcggagatgaaggcagcgtgcaggaaggccgtcgaggagggcgggtcctcctactctgccctggggagtctctccgaggagataatcaatggagcgaattagtaattcgagaatgccagggcgttgtggttgcaggctgcagttcttgttcttcctgctgatcattccgggttttgtgccggcatcgcgagcaatccgcatgcggtctctagacctaataaaactccatgctactacaaactaatccgtggttggatagtgaagagtgtggtatcccatgtcagaattcaagtcctagacttgacattggtacttctattttcctgaatttat

SEQ ID NO: 129 - DNA, 1623 bp, Hordeum vulgare
caaaatttgtgcttgttcagtaaaaatggcggctgctactccgacgcccacgctggtgctcgtgccggagtggggcgccgggcacctcatgtccatgctcgagtcctgcaagcgcatcctcctctgcggcggcggccgcgccttctccatcacgctgctcgtcatgcgcccgcccaccgccgaggccacctcccaggtcgaggagcacgtccgccgcgaggccgcctccggcctcgacatccgcttccaccgcctccccgccgtcgacctcccgtccgacgccgccggagtcgaggagttcatcgcgcgctacatccagctccacgcgccccacgtccgggacgccgtcgcggggatgtcgtgccccgtcgccgcgctcgtgctcgacctcttcgcggcgcccatggtcgacgtggcccgcgagctgcgcgtgccgtcctacgtcttcatgtcctccaccggcgccatgctcgcgctcatgctccacctgcccgtgctccaccacgtggtcaccgtggagttcgacgaggtggaggacggggaggtgcacgtgcccgggctgccgccgataccgcccgagtccatgccgtgcccggtggtggacaagaagagccccaactacacctggttcgtgcgcctcggcgacagcttcatggacgccacggggatcatcgccaacaccgcggacgggctcgagccggggcccctcgcggccgtcgccgacggccgcgccgtgccaggccgccccgcgccgccggtgtaccccgtcggccccgtgctctcgcttggcagcagcaagaaggattccccggagccaccgcaccagtgcgtcgcctggctggacgcgcagccgccggcgtcggtggtgttcctctgcttcgggagcatgggctggttcgagccggcgcaggtggcggagatcaccgcggcgctggagcggtgcggccaccgcttcctgtgggtcctgcgcggcccgccttcctcccagtccggcgccggcgcgccggacgggtcggagcacccgacggacgcggacctggacgagctgctgccggaggggttcctgcggcggacggagggcaaggggctggtgtggccgacgtgggcgccgcagaaggagatcctggcgcacccggccgtgggggggttcgtgactcacggcgggtggaactcggtgctggagagcctgtggcacggcataccgatggcgccgtggccactctacgcggagcagcacctcaacgcgttcgagctcgtcgccgacatgggcgtcgccgtgccgctcaaggtggaccggaggcggggcaacttcgtggaggcggcggagctggagcgggcagtgaggtgcctgatgggcgaggaggggaggacggccagggagaaggccgccgggatgcgggacgtctgccgcaaggccgtcgacaagggcggctcctccgacgctgcgttgcagaggctctcggaggcgctccaccacggcgcggtggccccgaccatatgaaaccgtgtaccgccgtccgccggcacacttataaatggagtgtatatttttctcacacgcaaaatgatgatagtactaaataaagttgaagtgggtggttggaacaccacagcacaacatta

SEQ ID NO: 130 - DNA, 665 bp, Hordeum vulgare
aagcttctgaaatccaatgccagacgttgtccttaaaggtgtgattggagatgatgaatatggttgtcctcctaggagcaacggtagtgcaccatttgagcacatctcatttagggagttagcagcaagaggaaccagcaaaatggatatgacatcaattacatgctgtgaggagaacaatattcctgttgtcatctttaacatgttagagcctggtaacatgtccagagctatttgtggcgaccaagtaggtacgttagttgaccagtcaggaaggatgacataaatcacaagggcgattagctttgttgtagcatcaggacactcgtattctctcacggcagcatgcatcttcgttggttgcatggatctttgtggatgggagagagggtaatgttcctcggagagaagcgattagggtcgggtgcttgttgtgttgtgcgacatctgttgtagcggctctgccatgagaagttgtttgtttgtagtatctgtctgtaatgtgatcgttagactagttgaagagccttgtataaagtggtatttatgcctgcgtgtggcattaggtcaggccatcagaatgttgtattgtactagttgtaacttgtaacgctgttgttggagctgtagtgttgtacataaggcatttttcttcaaaaaaaaaa

SEQ ID NO: 131 - DNA, 1711 bp, Hordeum vulgare
aacctgtgagcacgcctccagccatgttatgttatatgagtaacgccatcaggagttcatggccacacgcacaacacgacttgtgagtgagagctgaagcaagctcgatcgctaggaaggaaggaagtcatggagatagcggggccgctggcgccgggggagaggccgcacgccgtgatgatcccattcccggcgcagggccacgtcacgccgatgctgaagctggccaagctactccacgccaggggcttccacgtcaccttcgtcaacaacgagttcaaccaccgccgcctgctgcgctcccagtccgccgacacgctacgcggcctgcccgcgttccggttcgccgccatcgccgacggccttccgccgtcggaccgtgaggccacgcaggacatccccgcgctgtgctactctaccatgaccacatgcctcccacggttcaaggaactcgtcttcaagctcaacgaggaggccgaggcctccggcggcgcgctgccaccggtgacctgcgtggtggccgatagcatcatgagttttggccttcgcgccgcgcgggagctcggcctccgttgcgccacgctctggaccggcagcgcgtgcggtttcatgggctacaaccattacaaggatctactccaccgtgggatcttccctctcaaagaagaggcgcagttgagcaatggatacttggacacgaccatcgactggataccggggatgcccaaggacatgcggctacgtgacctccccacattcttgcacaccacggacccggatgacatcatgttcaacttcttcgtccatgagacggccgccatgtcgcaggcctcggcggtgatcatcaacacctgggacgagctcgacgcgcccctactggatgccatgtccaagctcctgccgcccatctacacagtggggccgctccatctcacggtgcgcaacaacgtcccggaggagagccccctcgccggcatcgggtccaacctatggaaggagcaggacgcgcccctccggtggctcgacggccggccaccacgctccgtggtgtatgtaaattttgggagcatcgcggtgatgtccaaggagcatatgctggagttcgcgtggggactggccaacaccggctacgccttcctgtggaacgtgcggtctgacctcgtcaagggcgacgatgaggccgcacttccaccggaattctccacggcgacggaggggcggagcatgctgtcgacctggtgcccgcaggagaaggtgctggagcaggaggccgttggggtcttcctcacgcactccgggtggaactcgtcgctggagggcatatgcggcggcgttccgatggtgtgttggcccttcttcgcggatcagcagaccaactgtcgttacaagtgcacggagtggggcatcgggatggagatcggggacgatgtgaagaggaccgaggtggaggccctcatacgggaggccatggagggagacaaggggcgagagatgagacgacgcgtgctggagctctgggagagcgccgtggcctctgcacgtcctggcggaaggtccatgcgcaatgttgatcggctcatccacgaggtgttgctagcctgaaacaagcaaattaagatggtaaaaataaaggatataaggcagaccttcgctgaaaagggatgtttgttggcagttttagttgcgacccaagattaaatgaggcaatttc

SEQ ID NO: 132 - DNA, 2878 bp, Hordeum vulgare
agatagcaagatagtccggttgcgcatggtggcctgtgcatgattaacccggcagcgctgacgcatatgtatagttggggaatttagttgaaaaaaattcgagatatttggctgttcgtgcctagaacagaacaggggagggggggttggcgagaatgtctagtgggctcaagaacaacaagaagaagggccacgagtgggatttgaacgactggagatgggacggcagcctcttcctggccgcgccgtcgtcaaacgcggatgcgccgtcggggtgcggcagcagggagctcgggcgggctgaggaagggggcagttttggtgctgctgacaagagcagcaggaggaggaggaggagagtttccacggtggataaccccgatgagcttccacatgaaaggattgctgttcggagaggacagatcggcgaagaagagagacctgcgaatgcaacagcaggtgcatcttccagctccgctccatcttgcctagtcgacggctgccacgcggatctccgcgacggtagggactaccataggaggcacaaggtgtgtgaggtgcacaccaagtcgactcttgttcgtataaaaaacatagagcatcggttttgccagcagtgcagcaggtttcaccttgttcaagaatttgatgaagggaagaagagctgccgctcacgtctagaaaaacataatgggaggaggaggaaagcccaggcccaggctgtgagttcctcgagtgaaaatcagtccttaaccaataccttactcctcttactgagacaactcgctggacaagattctgctgctagctcgtctgagcaaatcaatggtccgaatttcttggtcaatcttctgaagaaccttgctgctgttgctggcacacaggcatgtcaagatatgctaaaggatgcaacatcatcaaatgctggtaactatgttggtaatcaaagtggaccaccagttcctgcagaagagcctcctatgaaaagacgtgcgcggaattttgatctgaatgacacttatgtcgaggaagatgagagccgaacagataaaattgtctttaagctctttggtaaacagccaaatgattttcctgctgatctacgcacacaggtcctaaactggctgtcacattatccaagtgacatggagagctatattaggcctggttgtgtaattctaactatttaccttcgtcttcctaactggatgtggcataagcttaatgtcgatccagctccttggatagaaaatcttattagcatatccactcatggtttctgggagacaggatggttgtatgctagggtgcaggaccgcctgacattaagctgcaatggcaggcttacgttggtgtgtccatggctacctgtaataggtgacaagcatcagatactgtgtgtaactcccattgcggcttcttgtaagtcgacggcaaacttctcagtgagaggcttcaacatagctcaaccaaccacaaaattactttgtatatttggtgggaaatatttggtccaagaagcaacacaaaaactacacgatgatactgcggttcagcaagggcctcaatgtctggccttttcttgctccttccctagtacaagtggaagggggttcatagaggttgaagattatgatcagagcagcatttcatttcccttcgttgtcgctgaagaatctatatgttgtgagattcgaatgttggaggaaaaactgaatatatttgcatttgctaatgtcttggaaggaagagaagatctgatggcttctcgcagccaagccttgaagtttctacatgaaatagggtggcttcttcaacggagccactcacgagctacatcatccaaggctccacaacaacatcgtgttgtgggttttcttgctgcaagatttagatggctcctgtcctttgcggtcgatcaggaatggtgcggcgtcgtaaagatgctgctggacaccttgttccagggcaatattgacgtcccctcaccagttgagtttgtcctgggagagagtttagtgttcaaggctgtcaacaagcggtccaagcccttggttgactgcctattgagatacacaacgaattctgcgccagtgggcggtggagcagtggctacaccagctcggttcgtattcacgcctgacatgactggtccatcagatattacacctctccatagtgcagctaccatcagtaatgctgctgctgttttggatgctctaactgatgatcctcaacagctagggatcaaagcctggaagaatgcccgcgatgcgaccgggtacactccagaggattacgctcggaggagagggcacacatcctacatccagatggtccagaacaaaattaacagggggttacctgcagcccatgtgtctgtttccatgaccaccactggtatcaccgaagagcatgcagatgcaggtcgtccgaaatcaactgatcagaccatatttgatgtcgagaaaagcctaccgggatgcagacaatgtgtccagctccagcacattgcctaccggccctgcccaaacaggttcttgtcgaacaggcctgcggtgctatccttggtcgccattgccgctgtctgcgtctgcgtaggtttgataatgcagagcccgccggtcgtccgcggtatgccgggtccttttctctggaatcgcctccgttggggacccacttgaagcgcccaatcagctgcagattctgctagtctgtacactcgagagtgaggatgcttgtgatagaccaaagtgcaatctctgtacattatatgagttgtggagtgcccaactctgcttaggtagcagtagttctattggatattcgagcttttcattgttgtactgtgagtcagagaaacaatcacaaaggtggt

SEQ ID NO: 133 - DNA, 1818 bp, Hordeum vulgare
cagctgtcacacacccccactactgctctcacccaaacccgacccaaattgacataactccgcggcggccggcgcgatgcccgccgcggcattcgcctccgcgctcgcgtctcctcctcctccatgggccccacgaccgtcccctcggcacgctagcctccgcctgcccccgccaaggagcagcggcggcggaggggacaagcccaccacgtcgtgggtcagccccgactggctcacgtcgctgtcccgctcggtgctcggccggggaaacgacgactcggggatccccgtcgcctccgccaagctcgacgacgtgcaggacctcctcgggggcgcgctcttcctcccgctcttcaagtggttccgcgaggaagggcccgtctaccgcctcgccgcggggccgcgcgacttcgtcatcgtcagcgaccccgccgtggccaagcacgtcctccgcgggtacggcacgcggtacgagaaggggctcgtcgccgaggtctccgagttcctctttggctctgggttcgccatcgccgagggagcgctctggacggtgagacgtagagcagttgtaccatctctacacaaaagatttctctcagtaatggttgataaagtgttttgtaaatgtgctgagagattggtggaaaagctcgagacatatgctttgagcggtgaacctgttaatatggaagcgagattttctcaaatgacactagatgtgattggtttgtctttgttcaactacaactttgattccctcacatcagatagtcctgttattgatgctgtttacaccgcactgaaagaagcagaggctcgttctacagatcttttaccatactggcagattgatttgctgtgcaagattgttcctagacagatcaaagcagaaaaggcagttaacacaataaggaatactgttgaagagctaattataaaatgcaaggcaatcgtagatgctgaaaatgaacagattgagggtgaagaatatgtaaatgaggcagatcctagcatcctgcgttttttacttgctagccgtgaagaggtcagcagtttgcagttacgtgatgatctattgtcaatgttagttgctggtcacgaaacaacaggctctgtactgacatggactatttatcttctcagtaaggatccagtagcactaaggagagcccaagatgaggtagatcgtgttctacaaggtagactcccaagatatgaagatgtaaaagagctgaagtacttgatgcgctgtatcaatgagtccatgcggctatacccacatcctcctgtgctgatacggcgtgcactagttgatgatgtgcttcctggaaactacaaggttaagactggtcaagatattatgatttctgtgtacaatattcacagatcacctgaggtatgggacagagcagatgaattcattccagacagatttgatttggagggtcccattccaaatgagtcaaacaccgatttcaggtttatccctttcagtggaggtcctcgaaaatgtgttggagatcagtttgctcttttagaagcaattgtggcacttgcaattgtcatacaaaagatggacgttcagcttgtggcagatcaaaaaatcagcatgaccactggggccaccatccatacaaccaatggactgtacatgaatgtaagtctgcgtaaagttgagcaagaagctgacttagcactgagtccatcaggctaggcaaaagcaaagtaaagcagagcagggcgagattagtacaggcagcggcaacagaattgtcaataccaggttccagctatcatggctaataggtgcggaaactg

SEQ ID NO: 134 - DNA, 2338 bp, Hordeum vulgare
cggcacgaggggtcgcccatggtggtcgtcttccccccgactccccgccccagccaaatcccgacccccgccgcggcgccgatcccccggcgcccccggtcctcctaatccccggatcacccccccacccagctggattcagctcgatgtggccggccgcggcgtggtagcggatccccgcgcgagcgagctagggttagggtttcgaggggtttgcgctagggtttggtccgcgatgggccggtcccgcggggtgcccaattccggcgacgacgataccaaccacaggtcgaagcggaggagggtcgcctcgaccggggatgcgtccgactcgctctccgccgcgtgcgggggagccggcgacgggaagaaggcgctctaccactgcaactactgcaacaaggacctgtccgggaagatccggttcaagtgctccaagtgccccgactttgacctctgcgtcgagtgcttctccgttggagctgaggtccagccgcatcggagcaaccacccctacagggtcatggacaacctatcttttcctctcatttgtccagattggaatgcggatgaggaaatccttcttctagagggaattgaaatgtatggtctgggaaactgggctgaagttgcggagcatgttggtaccaagagcaaggcacagtgcattgagcattatactactgcatatatgaactcaccttgttatccccttccggacatgtctcatgttaatggcaagaataggaaggaacttcttgccatggctaaagtacagggtgagagtaaaaaaggaattccactgttatcaggggatttgacacctaaggcagagtcaccgttttctccctccagggtcaagatggaagatgcgcttggagaaggcccagccagtcgatcaccttcgcacatacctggcggcgcaaacaagaaagcttcaactgctggtcattttaaagataattccaatctatctaaagtcgaagatggtcatatggatagaagtattggtgtgaaaaaacccagatattctgcagatgaagggccttctttaactgaattgagtgggtacaatgcaaagagacatgagtttgacccagagtatgataatgatgctgaacaagccctcgcagagatggaatttaaagaaactgatacggaaactgatcgtgaactgaagctacgtgtgctgcgtatttacttgtcaaggcttgatgaaaggaaaaggagaaaagagttcatattggaaagaaatttactatatcctaatcctttggagaaggatctaacaaatgaagacaaggaagtttatcatcgatacaaggttttcatgcgtttcctttccaaggaggaacatgaagcacttgttaggagtgttattgaagagcgaaaaatccgtaggaggattcaagagcttcaggaatgtcgttcagctgggtgtcgtacgctggctgaagccaagatacacatagagcaaaagaggagaaaggagtatgaggcgaatgccctgaaagctaaggaaagtggccagcttatttcaaatagtaaatcaggacacaaaacaaaccggcctatgaaagttgagactgatgggagtttggatcttaagaaaggtagtgccattttggatgctggtggtagggattctccaaaaagcacaggaccaacaagcgctaagcaatgggatgattgggacattgttggtcttcctggggcagagctattaagcgtcagcgaaaaacttctgtgctgtcagaacagattgctacccagtcattatctgagaatgcaggaggtgttgatgcaggagatgttcaagggcaacatcgtcaagaaggaagatgcccatgtattgtttaaagttgaccctgccaaagtcgatacggtttacgatatggtgacaaaaaagctgggtaacaacgaggaggctccgatggtttagctatgcaatttgggctctgcctgctctaggcttggcccagaaccaaatcttggtttctcagcacgacggaggcccaggtgagaaaggaggctatacttacatgacttggctgtagcagtgttacattgagatttgtgtcagatttctgaaggaagtgcaataaggcattcgagccaaattgtaaaattacccggcagcgggaatgtgtagcgtgagttgttgccattgctgtttgatttttaaagaggagatagacgccattgctgttgaaagtgtactgtgatgatgatgatgtgatagtgcctttgttgtaggtttaggggactgagaatgatgtaccatgtatgtaaacatttgtccattttatttatgataatgcggattcatgtgcaacca

SEQ ID NO: 135 - DNA, 1662 bp, Hordeum vulgare
atatcccctttcgcagcctcgtcattactactaaaacaaatctgttactcccaattcctctgcttcccacagccacgtcctagaatgaaagaggcaaaccaaggagccggcgacagagagtcgcggcgcacagtcgtcatgtaccctgcgcccggcgcgggccatttgatccccacggtggagtttgccaggctgctcgtgtcgcatggcctcgcggtcatcgtcgttcagcgtggccttccggccggcaacgccaccgttcccgcctcctccctgtacggcaacggcgacgcttcagccagcccctttctctctttccactacatcccggagccgccactcccgcacgggatgccggagggcgaccatgtgggcaaggttttcgagctcagccgcgcctccaaccccgagctccgtgatttcctccgcgccaccgccccggcggccctcctgctcgacttcttctgctacagcgccgccgatgtcgcggcagagatcggcatcccgacgtatttcttcttcctgggttgcacggccagccttgcggtactgctccacctgcccgtcatccacgggcaaaacgctgtgaacttgggtgacctcggcggcgagcccgtgaaggtgccgggcgtcactcccataccggcgcacgacctccccgctgctttcctcgaccggagcagcgtgagctacaagcatttcctcgccgtgtcccaacagctgggccagtcgcatggcgttatcgtcaacagccgccgctccctggagccgcgcgccaccgatgccgtcgccgccggcctctgcgcgcccccggggcgcacgacaccgcctttgttctgcatcggcccggtggtgaagtccgaggaggtggctgagaagcaaggcgaagagtgccttgcgtggctagacacgcagccggaggccagcgtggtgttcctctacttcggcagtatgggccggttcagcgccgagcagatcaaggagatggcggcggggctggagatgagcgggcagcggttcctctgggtcgtacgcagcccggcgggcggcaacggcaacggcaacgagcatcccggcgagccggagctggacgtgctcctcccggatggcttcctggacaggaccaaggacagagggctggtggtcatgtcgtgggcgccgcagcgggaggtgctcgcccacggatcggtgggcgggttcgtgacccactgcgggtggaactcggtgctggaggcggtcatggcgggcgtgccgatgctggggtggccgctgtacgcggagcagcggatgaacaaagtgttgttggtggagggaatgcagctaggcgtggcggtggaacgaggcgaggatggcttcgtgacggcagaggagatcgagaggaaggtgacttggctgatgggttctgatggcgggagggagcttcgggagcgtactctggcggccatgagaggggcaagggaggccctgagcgacggtggggattccagggcggcactgctgcagctcgtgcaaaggctgagcgcccccgatgtgacggaggagagtgtttgccagctgtagcttgtgcaaccgtgaatgaacaggctctttttcttttcgaatcaatgattacgaaaaactgtctttatatatgacaaaacctaataaagcgacagatttgct

SEQ ID NO: 136 - DNA, 1989 bp, Hordeum vulgare
taagggaacaaaagctggtaccgggccccccctcgagtgagcagcgagccctagctacctggactggactggagtaggcagtgagcagcgagccctagctacctggactggacattggagtaggacagagtaggtacttagttacaccatgacaatggtagcgctggggctctgctcctccttcttctctgtgatggtgatgctggccgtaatgtacgtggtccggaggctgggctccaagtggacgtgctcatccgcacccggggcgctccctccggggccgtgcccgtggccggtggtaggtagccttccggagctcaagttatttaacaagctgccggcgttccggtggatccatcaggtgatggagaagatgaacaccgacatcgcctgcttccgcctcggcggcgtccacgtcatcccgatcacgtgccctcgtatcgccagggaggtgctcaagaagcaggacgagatcttcgcgtcccgcccggagacgttcgcgtcgtgcgtggccagcggaggctacgtggaggcggcgctggcgccgttcggcgtgcagtccaccaagatgcggcgggtgctcacctccgacatcatctccccgtcccgtcacaagtggctccacgacaagcgcgtcgaggaggccgacaacatctcgtggtacatgtacaacctcaccggcggtgaggagggcggcaacgtggacgtaaggcacctctcgcggcactactgcggcaacgtcatacgccggctcctctttggcacgcgctacttcggggaagccggccacggcggcggccccgggaagctggagatggagcacatggacgcctccttcgccgcgcaggggatcctctactccttctgcgtcagcgactacctgccgtcgctgctggggctggacctggacggccacgaaaagattgtcaaggacgctaacgcggtgctggacagactgcatgacggggtcatcgacgagcggtggaagcagtggaaggccggcgagaggggagaggtgcaggacttcctcgacgtgctcatcacacgtagagaccctagattgaccatggaggaggtgaaggcgcaggctaagctcatcaacctggcggcggtggacaacccatccaacgccgcagagtgggcgctggcggagatggtgaagaatccggagctgctggggcgggcggcggaggagctggaccgggtggtggggagggagcggcaggtgcaggagtcggacatcccccaactcaactacgtcaaggcctgcatccgggaggcgttcagactgcaccccatcgcccccttcaacgtgccgcacgtcgccctcgccgacaccgtcgtcgccggctaccgcgtgcccaagggcagccacgtcctcctcagccgcctcggcctcggccggaacccggccatctggaacgacccgctccgcttcaaccccgaccgccatctggaaggagcaggcggcaacctggagctcaccgagaacgagctgcgcttcatctccttcagtacaggccgccgcggctgcgtcgcccccatgctcggcacggccatgaccgtcatgcttttcggcaggctcctccatggcttcacctggtctaagccggcggagatgccggatattcagctcaccgagtcccacaacgacctctccatggctaagccgctggtgctgcacgccaagccacgcctgccgctgcacctctaccgcccgtgaattcgatcgtcgatctccctcaagttactactccactccctagtagtgtagttaataataaccggacctgctactgctcatgtccatgctcctgtccggccggaacaatattgatccattaataagtttgttgtcatctttcccttcacacacactagaccactttgattccgagtaataataatattatttagggagaattatccttttgcccaaaattgtgtctgttttgccctcagttgtgaatcgtgctcagttttgtccct

SEQ ID NO: 137 - DNA, 2102 bp, Hordeum vulgare
tgaaggagtagaaaaaaaaaactcaaagtgcacttgactttccagctgcgaacaacaatccgtcctttcatttgcgccccctagtagtgttcttcccattcggcctaaacgcgagaacgagggaaaaagtacgtgcacgtacgtcgacatggctccatccgaggagtgcggctggctgctgtacgtttctcttgcagccaaatgctgcgccaacggcgacggcgagccttaccgcgtggtaagctttgttgcagttctgctcgccgccttcgtcgtcacgtcgctcctgcactggtcgtctcaaggtggtgcggcgtgggggaggtattggtggacgaggaagggtctgggcattggcgaggcccgtgtcccggggccacggggcttccccgtgatcggcagcatggggctcatgaccggcctcgcgcaccgtaagctggcggtggcggcgtcaggaaacgtcaggcgccggcggctcatggcgttctccatgggggagactcgggtggtggtgaccgcggaccctgacgtagccagagagctgctggctagccctgcgttcgctgaccggccggtcaaggagtccgcctacgggcttatgttccatcgcgccatcgggttcgccccctacggcgcctactggcgcacgctccgccgcgtgtcgtcctcgcacctcttctcgccgcggcaggtggccgcctccgccgcgcagcgcgcagtgatcgcgcgccagatggtggacgccatgaggcccgtcggcagcgctggcatcaaacacgtcgaggcgcggcggttcctgaaacgcgcgtcgctgcacaacgtgatgtggtccgttttcggtcggaggtacgagctggacgaggtggagagagaggaggccgcggagctcaagagcctggtggatcaaggctacgacctgctcggccagctcaattggtccgaccatctcccgtggctcgcgcgcttcgacctgcagaagatccggtccaagtgctccgccctcgtcccccgcgtgaaccggtttgtcggcaggatcatcgacgagcaccgtgccgcccggaacgacgccgacgccgacgccgtagtagacttcaccgacgttctgctctccctacaaggcagcgacaagctctccgacgccgatatgaccgccgttctctgggagatgatctttcgtggcaccgacaccgtggcagtggtaatcgaatgggtgctggcccggctggtgctgcaccagggcgtgcaggcgagggtccacgaggagctggaccgggtggtcgggccgaaccgggcggtgaccgagtcggacgccgcctcgctcgtctttctgcaggccgtggtcaaggaggtcctgcgccttcacccaccggacccactgctgtcgtgggcgcggcttgccacatcggacgtccacgtaggtgggttacttgtccccgcggggaccacagcgatggtcaacatgtgggccataacccacgacccagccgtgtgggccaagccgggggagttcaagccagaacggttcctcgccgggccattgtccgccgacttctccgtaacgggttccgatctcaggctcgcgccgttcgggtccggcaggcggagctgccccggcaagtcactcgcgatggccaccgtcggattctgggttgccacgctgctgcacgagttcgagtggacgccgccgccgccgtcgtctgccgggccaggtggcgtggacatgtctgaggtgctgaggctgtcgtgtgagatggcagctccgctagaggcgaggctaaggccgaggcgtactgtgtgattacgtgcttgcttggggcagccatgtgagcagttggcctcttcttcccttctgtactactatcagtatcagtgcgtgtagtgtagtggtaatgtagtgtctcgcttttggaaatgtgcccgctactacaataggtccggtcctcgtatgtgtaccgctgtcgtttactgttcttaactgggtagacgtttacttacgtagttatcaactactgccgggaggtgagtgtcacaaatttcttgtgcttcctgtttgctgcctagagatgtactatttctactatgtaaaaatatttctttatcct

SEQ ID NO: 138 - DNA, 2006 bp, Hordeum vulgare
atagccacgcactaggcctctccatctcgtcgagcacttcattaatcgcacccatgtccatgcaacaacaacagcaacaaccgacgagtgccaaccttctcggcgccatgcctgcgtcctctatgatcagcatcgccttcacggccgccgtggctaccgcggtcttattcgtcgccgtcgctgtggcgaggtacaaccggaagtacagggggctgaggctcccgcccggcccgcccgtgtggcccatcgtcggcaacctcttccaggtcgccttctctgggaagctcttcatccactacatccgcgacctgcggcgtgagtacgggcccatcctgacgctgcggatgggggtgcgcacgctcgtcgtcatcagcagcgccgagctcgtgcacgaggcgctcgtcgagaaggggccggagttcgccagccgccccgccgagaacaccacgcgcaacatcttctcctccaacaagttcaccgtcaattccgccgtgtacggcgccgagtggcggtcgttgcgtcggaacatggtgtccgggatgctgagcacgtcgcgtctccgggagttccgcccggcgaggcttcgagccatggaccggttcgtggcacgcatgcgcgccgacgccgtggcctccaccgacgaggcctccgtgtgggtgctccgcaacgcgcgcttcgcggtgttctgcatcctgctcgacatgaccttcggcctgctagacctggacgaggagcacatcgtacacatcgacgccgtcctgaagcgcgtgctgctcgccgtcggcgtgcgcatggatgactacctcccgttcctccgccccttcttctggcggaagcagcgcctggcgctcgccgttcgccgcgagcagatcgacacgctcctcccgctcatcgaccgccgccgcgccatcctccgtgacatgcagcgctcgccgccagatcccaacgtcgccgcgcccttctcgtacctcgactcgctgctcgacctgcacatcgagggccgcgaaggcgcagacgatgagctggtcacgctctgcgcggagctgatcaacggcggcaccgacacaacggccactgccattgagtgggccatggcgcgcatcgtggacaacccgtccatccaggcccggctccacgaggagatcatgcagcaagtcggcgacgcccggccaatcgacgacaaggacatcgagaccatgccgtacctccaggccttcgtcaaggagctcctccgaaagcacccgcccacgtacttttcgctcacccacgccgccgtcaagcctgggagcaagctcgccggctacgacgtgcccacggacgcgaacctggacatcttcctcccgaccatctcggaggaccccaagctgtgggaccgtccgacggagttcgacccggacaggttcctaaccggcggcgagaccgcggacatgacggggtccgcgggcatcaggatgataccgttcggggcggggcggcggatctgcccgggcttggccatggggacgacgcacatcgcgctgatggtggcgcggatgctgcaggagttcgagtggcgcgcgcacccgtcgcagccggcggtggacttcaaggataaggtggagttcacggtggtgatgaaccagccgctgctggccacggtgaagcctcggaagatgtcgctctgatgcacgtgcatgcatgcatgtggatcgggggtggccggcagtcgtactcgtacgtctctcgatcgtacctacgtacgtccaatgcatgcatcgcaatcactcgggccgttagatcagcacgtaaagccacatgtgccagtaccatgcctaccgattccagcattatgaaaaagtgtcctagtgtgctatagatatatataccttctgtagtcgtgtatctacgtgcacggtatacagacttgtattatgtgtgcgaagtatagcacatcaacatatgcagcacgcgagtttgtatgattttgaattgaagaacttatttctattttcatggatgctcctacc

SEQ ID NO: 139 - DNA, 1801 bp, Zea mays
caaacacgcccttggagaccttcccctgccgcggcgaggacaccgcttgctttcacggccgacgacctaatccccttccctcccattggcagccgtcgccatgctgcgcgtccgaaatcggctcctccctctgctcggcgccgcctccccgcttccctcccccatccacatccacctccgcgtgtgccgcctcctctccacctccacctctacggccaccgtccccgcacccttctcccttgagaactacctcgtcgccgcctgcggcttcgcacccgcccaagctcgcttggtgtccaagaaggcgttcaacgagttgtccagggaatccaagagatcatcggaggagcactcctgcagacgcctcatctccgcctccaacccagatgccatcctcgcgctgctctccggcgccggcctctcccgcgccgacatcgccgccgtcgtctttgcggacccgctgatcctccgcgcttccgtgagtaaaatcgcaccccgccttgtcgctctccgcgaccgcgtcggcctgtctactccccagatcgctcgcttcctcctggtcggctcacgcgctctccgccggtgcgacgtcgttcccaaggttgagttcttcttgtccttcttgggctcctttgatcgggtactggcggtcgcaaaggcaaacttgggcatcttcaacgcgaaccttgagaaggtaataaagcccaacatagacttgtttcgtcaacgcggcgttcgaaacgtccctaagatctgtctccaccgcccacggacgctttcctttaacctcgaacgcgtgaaggaatttttgctgcgggcagaagaacttggggtgcctgccgcgtcgcccttgttcatgcaagcagtgggagtcgtcaccagttttccccctgagaaggttgctgccaaacttgacttctttaagaggactcttggttgttctgagtctgaggtttcgaatgcagtgtccaagatgccacaaatactagcattgtctgaggcgactcttcttcgcaagatcgagttcctggtcaatgagggggcgatagagccacagtatattatgcaaaggcctatcctgctcgcattcagcttggagaagcggctagtgccccggtatcgtgtcatcaaagtgctgcagggaaagggattgctgaatagcaacatgagcctttcctcattagcttctcttgcagaagaaaccttcaagtccaagttcgtcgactgccacaaggactgtgttcctggccttgcagatgcttatgctgcagcttgtgctagtattgtgccctcgacagtgtaagttaagccgtttcaaaaacaaaaacagtgtaagttaagcttctcattttgtgttttaggtggatgctcattggctgctgtccactctgcaattttgatttctgaagtatataaccactcatgatcactgattggtcatatccaaggtttaagttatggacttgtggttattgatgaaaggagctgtgtttggcttgttctggatgcttaatgcacgttttgttggtttcatcttctgcctagcacatggcctaagattatccttaacttcgttgtcttccgtggatcagtctttgatgtagagcagtatctgtaagggaatgagatgctgacagaatctaagtcttaaaactttttattactaccattttgtttactttttttttgttttaagtaggaattatcttggaactatttctacttttgtgcctttgcatgatagtagcaggcatagtgctatttataaagtttagcaactgatatggcagggttacggatc

SEQ ID NO: 140 - DNA, 2027 bp, Zea mays
ctggacaaatatactcgaacttcacccctgcacattgccattcctacctgttgccacatctagtggttcggcctttccatctgccgttcgcccagcgtgttctccctctagtgcggcaactgggcgaccgccgccgccgctctactccgggtgcccaggcgttcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctggtatcacaaattcctaatagcactgccctttatgaacctcttgagataaatgaaaaagaagggtcaaaatcaaactcggatgataaaactgttgagaagctaggttcaacaagtactgaatttgattgtgatttgcttgatagttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctttgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaataggttgtggcgtggctggcagggcctgggacgacactatcagacagaatcaaagttgcgaatagacagctgaaacaaatgcctcgacaggcttattgaggaataagtattgagattatagtgctgaaataatcgctgaattgtgatgtttacatttgtggaaacatacggtcgctggatccgtatactcgttgtatagtacatagccacagatatattaaatccgaactgcttggttctactgtc

SEQ ID NO: 141 - DNA, 1698 bp, Zea mays
ccacaccaggtgcggcttaaacccttatcgccaccagtggccgcgtcctcttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcagcccaccagggccaccacctccctaccgaggaggcaaccccaacgtaccgccatattcgggtggtggcaatcctggctaccctggtggcagccctggctaccagggtcaaggaggcaactcgaacttccagtgaacatgaccacgagtactaagttggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgagtgatgtacgtggaattctgaaactatggatcagctcttgtgtgcacttgctgaaccagatacccagcagtaagcttttgtttgttcgttttgagtggttggttaaccacatacttgttacagtcgattctgataaacttccatgtaatacttttgctgcattgtccgtgagacctcagcggcccggc

SEQ ID NO: 142 - DNA, 2438 bp, Zea mays
caccttcatccacgcgagggcccccttgacccaccaatccaccattgctcgctataagactccgtggtgccgcacggctccgccgccggcgaggcctcatctcggtttactataagagtataagtacgtctccgcaacaagctaatcttttttttgccccctccttccacgtccccaccctgccgtcgtcgctactcgcatagagattcgcgcggccgtgtcttgctcgcgcctgcccccttccttccttgtcgtgccagcgcccagatctctcgctcgccggcgctcgggccagatctgggtgggggctcggaggcggagccgggcgcaggtttggtttgacccaaggggcgaggaggagagggaagaagaccccggacgccatggagctggcggttggcggcgggatgcggcggtcggcgtcgcacacctcgctgtcggagtcggatgactttgagctcacgcggctgctcagtaagccgcggatcaacgtcgagcgccagcgctccttcgacgaccactctctcagcgacgtctcgcactccggcggatacggcaggggtggcttcgacggcatgtactcgcctgggggcggcctgcgctccctcgtcggcacgccggcctcctccgcgctgcactccttcgagccccaccctatcgtcggcgacgcctgggaggcgctccgccgctccctcgtcttctttcgcggccagccccttggcaccgttgccgccgtcgaccacgcgtccgaggaagtcctcaactacgaccaagtgtttgtgagggatttcgtgccgagtgcactggcgtttctgatgaatggcgagccagatattgtcaagaacttccttctcaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggagggttgcacctgtggattctgggttctggtggattatactcctccgggcctacacaaaaagtactggcgatttgacgctggcagagacaccggagtgccagaaagggatgaggctcatactcagcctgtgcttatctgaggggtttgataccttcccgacattgttgtgtgctgatggttgctgtatgatagatcgcagaatgggtgtatatggctaccctattgagattcaagcccttttctttatggcactaaggtgtgctcttcaaatgcttaagcatgataatgaagggaaggaatttgtagagaagattgctacccgccttcacgctttaagttatcacatgcgaagttatttttggctcgatttccaacagctaaatgacatttatcgttacaagacagaagaatattcccacacagctgtcaacaaattcaatgttattcccgattcaattccggactggttatttgactttatgccttgtcagggtggttttttcgttggtaatgttagtcctgccaggatggacttccgatggtttgcacttggaaacatgatcgctatactttcttctctcgcaacacctgagcaatctaacgctataatggatcttattgaggagcgctgggaagagcttatcggtgaaatgcctctgaagatatgttatcctgctattgagaaccatgaatggcgaattgtgactggctgtgatccaaaaaatactagatggagttatcacaatggaggatcgtggccagtgcttctgtggctgctgactgcagcctgcatcaaaactggacggccgcagattgcaagaagagcaatcgacctagcagagaggaggctgttgaaggatggctggccggagtactatgatgggaagcttggtcggtatgttggcaagcaggcgaggaaattccagacttggtccatcacggggtatttggtcgccaagatgctgttggaagatccttcacatcttggcatgatcgccctggaagaggacaaggcgatgttgaagcctgttttgaagcggtccgcgtcatggacaaattgagatggtgacgaaaatttttagggaggcgaagtcagctgaaaacacgaattcctgtggtagcgtctccttgtctgctgaccccttcatttgacttccaaaccaggatggtttgtgtctacttggttgtacaatatctcagctcgtttcctgagttgaaaaaaagaagcaactgcagaaatgggcattttatttttttctctctctttctcaatctctgtaagaagacactctgattcttgcttaggtcataccctataaataatggatccttttggttaggctcaactttgttgtaccagtggactatacagatgagtaagctgattccagcttccctgtgaagcataagtgctatttctaacgaatgaataagct

SEQ ID NO: 143 - DNA, 1136 bp, Zea mays
cccatcgatcccatgccctgttgccgcgcccgcacctccttccccatccgcgcccgccgcggctcctccggcagctccgccacgcgcccaaccgcaacctgcccgcacggccaccgctgcctggtagtatctatcaaatcagccacctgtcctctttttcttcaaatcaagtccgtttccctttcctttctaccctctccctcgtctccggcgggcggtggcctcacctccctctccccgtcgccctgatggctccctccacagctctcgctccggtggccttccgctccgccttctcgacgccgctcgcgtcgaaacctacccgtaatagaatgaacatagagggcgctttctgtttgccgtgttccacaaggaagagagcaagttatagacctttccgagtgtacagtttatttggagggaagaaggataaagatgagaatggtgatgaggcgccatcgaaagcaggaatttttggaaatatgcaaaatctctatgaaactgttaagaaggcccaaatggttgtccaagttgaggctgtccgggtgcaaaaggagcttgcagcgactgagattgatggttattgtgaaggcgaactaatcaaggttacactttctggaaaccagcaacctattagagttgaaatcacagaagctgcgatggagttgggtgctgaaaaactttccgggttggtcaacgatgcttacaaggatgcacaccaacggagcgtccaggccatgaaagagaggatggctgacttggcgcagagcctgggaatgcctgcgggcctcggcgatggtctcaagtgatgccgcaattcgggaaagctttccaataatcctttttcctcaattttgtatgctagccgtgtgagtagtaagcataacccctccgcgacctctcataagaagtgtacttgtgagcacttgttttctttcagctttagctgccatttgctgttctgcgcacgcagatatttgcacattaacttcacgtctggtctacaaagttgcaagatgcgggccatgatcttttgggcatttttccaacaagttgttgggctggcccagttgtagcccttcgaagatgagacaaccaagcccatatatataacacacaccgaaagccttcagaat

SEQ ID NO: 144 - DNA, 1531 bp, Zea mays
gtagctttctggcatcgctactaccagacagagaggacaggggaggtcagactcagaaacgctcgctcacgacggcagcagccatggcagcatcgtgcggcggccgcgtggtggtcttcccgttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcggggggccgcgtccgctgcgtcctcaccgacgtcagctgggacgccgtgctgtcggcggcccgcggcctcggcgtgcccgcgctcggcgtcatgacggccagcgccgccacgttccgcgtctacatggcgtaccgcaccttggtcgacaagggatacctgccggtgagagaggagcgcaaggacgacgcggtcgccgagctacccccgtaccgcgtgaaggacctgctgcggcacgagacgtgcgacctggaggagttcgcggacctgctgggccgcgtggtcgcggcggcgcggctgtcctcggggctcatcttccacacgttccccttcatcgaggccggcacgctgggcgagatccgggacgacatgtcggtgccggtgtacgccgtggcgccgctcaacaagctggtgccggcggccacggccagcctgcacggcgaggtgcaggcggaccggggctgcctgcgctggctggacgcgcagcgggcgcgctccgtgctgtacgtgagcttcgggagcatggcggccatggacccgcacgagttcgtggagctggcgtgggggctggccgacgccggccgccccttcgtgtgggtggtccggcccaacctcatccgcggcttcgagtcgggcgcgctgcccgacggcgtggaggaccgggtgcgcggccgcggcgtcgtcgtcagctgggcgccgcaggaggaggtgctcgcgcacccggccgtgggcggcttcttcacccactgcggctggaactccaccgtggaggccgtgtcggagggcgtgcccatgatctgccacccgcgccacggggaccagtacggcaacgcgaggtacgtgtgccacgtctggaaggtgggcacggaggtcgccggggaccagctggagagaggggagatcaaggccgccatcgacaggctcatgggcggcagcgaggaaggggagggcatcaggaagaggatgaacgagctcaagatcgctgcggacaagggcatcgatgaatctgctgggtcggatttaactaatttggttcatctcataaactcctactgatcgatccttgtattgggtaccatgttccggatgatgagttggaataaatcaaaacttgtgttccagtc

SEQ ID NO: 145 - DNA, 1847 bp, Zea mays
ccaattctagcaaggcagctcagcagcttttgtagcgagcttcttggagccttgaaatgagtagtagtggtagcctagccaccaccagtagcaagtaggcactataagcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcaccgccatcgacgacggtctcccgctctttgaagcggacgccacccaggacatccccgcgctctgccactccaccttgaccacctgcctgccccggtttaaggatctcatcgccaggattaacgccgaggctgaggccgagggacaacccaccgtgacatgcgtcgtcggcgacagcaccatgaccttcgcgctccgcgccgcgcgagagctcggcctccgctgcgctacactctggaccgccagcgcctgcggcttcatcggctacttccactaccgccacctcgtcgagcgtggtatggtccccctcaagaacgaggagcagctcacggacgggtacctagacaccatcgtcgactggatcccgggcgcgcccaaggacctgcggctccgggacttcccgagcttcgtgcgcaccacggatccgaacgacgtcatgctcaacttcttcatccacgagacggagggcatgtcgcaggcgtcggcggtggtcatcaacaccttcgacgagctcgacgcgacgctgctcgctgccatggcgaagctcctgccgcccatctacaccgtgggcccgctccagctgacggtgcggaacaacgtgcaggcgaacagtcctgtcgctgctattgggtccaacctgtggaaggagcaggaggcgccgctccggtggctcaacggccgtgcgccgcgctccgttgtgtatgtcaacttcgggagcatcacggtgatgtccaacgagcagctggtcgagttcgcgtgggggctggccaacaccggctactacttcctatggaacgtacgcccggacctcgtcaagagtggcgactccgccgggctgccgccagagttctcagctgcgacagagggacgaagcatgctgtctacgtggtgcccgcaggcagctgtgctggagcatgatgccgtgggggtgttcctgacgcactccgggtggaactccacgctggagagtatttgcggcggcgttcccatgctgtgctggcccttcttcgccgagcagcagaccaactgccgatacaagtgcaccgagtggggcatcggaaaagagatcggtgacgatgtacagcggggcgaggtagagtcgctcatacgggaggccatggagggggagaaagggcaagagatgctccggcgcgtgactgaactcagggacagcgccgtggccgctgcagggcctgacggacggtctatgcgcaacgtagacaggctcatcgaagaggtgctcctagcctagattgagcactggtgaacatcatagcagtcatgtgtcttcgcgtctggcactccaatcgattcaaatcctttgtgttttgatgtcaagcgtttactttcggtacccataaaagtattttttcgtacaaggtggtgattacacgcaaagcacattgttataagttcagtttgtaagatctatgggtaaaaccaagcgttttgtataattaaggaccgtttgagagggctacgactccttta

SEQ ID NO: 146 - DNA, 2232 bp, Zea mays
gccaaatccccaactcttccaaccgctcctccgcttagcgtgcagatctaacgatcgctccgatcccaagcacaacaacttctccaattccaatcaccagccgatcagatttatgcagtcttactgccgcgagcgccagtcatgccgcgcggcagcagcttggaccagagcttgagcgacgacgagggctcggcaggtgttggggcggtttgggttcggcgtcgctggcaatgtccgggatgtccgactccgctgggggtgtgcgcgcgggcgcggagctgatggtgcagcagttccacctcaaggtgctccacgccgtcctcgccgtgcgcacgccgcgcccgcacgccttcgcggcgccagcggcggcgtcgttcaggcggagggacaggtggttccatctcccgctccacgacccgccgccgccgcccgaggcggctgaccgcctggacgagctggtccccggggagccgctggtggtggacgtcctcctgagccccgccggtagtgtgggagcccgaggggaggtggtggagaggtggactgtggcgtgcgagccctggccggacgccgcgggcggcgaggaggttgccgtgaaccgggcgtacaagcactgcttcacgctgctcaggtccgtctacgccgtgctccgcgtcctcccggcgtaccgcatcttccgcctcctctgcgccaatccctcctacaactacgagatgggccaccgcgtcgacaccttcgccgagcccttctcgcgcccccaggaggccgccatgcgttcccaacgctttgttcccgtcgaaacccagctcggccgcctcgtcgtttccgtccagtaccttcccagcctcgccgccttcaacctcgagatcacctccctttcgccctccaagataatcccagactacgtcggcagcccagccgctgagcccatgcgcgccttcccggcctcgcttacagaagccacgggctccggcttcccaccatctaatcagcagcagcgcccgcacagctgggcttcgcctgtgttctggtcgcacacgccggcacaccaggccaggttctcgccgcctccagtgttttacgcgtcaccgacgccatcgcctccccactttccaccccgtctcatgaggtgggagtctgcaccaatgcccataccacaggtgagcgagaggaggagccctgcacaccgccagaatatgctaccaccaccttcgacgagaagaggagacatgagggcagcaggtgctctacagtctccatctgagagtggccggttgattgggaggatggaggaacttcggatagctgatccatatgtgacctcgtcacccagacataagggcaaggacactaaagatggatctggcagattctctgcactctcctcatgcgattcaccacggcaagatgatctggatgatgtggattaccatttcgacgttgatgatgttgatactccagtctcccaacctcggagaattgatgggaaggaaacaggtgatcaggttggttcatcatcccataaatctcaagacgcacaagtaggttctctagtcaacctgctgagaaatgccagcccgctgcgaaatcctagcaattcatcacagatatcaagggccgagtccagcgaagtagcctcagcaagctcggtcacgtcccgcaggacatctgacgcccttgaggagctccagtccttcaaggagataagggagcgactgctgttccggagcagcgcaaaacatcaagagccaccaggaaaaccataaggccattctttgttttgtttctcttaacgtgatcgctgatagactcccaaccgggaaaccatatgcacagcgaactatagttgctgtgttcatgtatatacgagtgctaaagttgatgcttttgattgaagagaaggcaccggcttccatttatttcagcggaacaatcactcgtcgttctcaagagtgatggagtgatgccgctgttgatactcttttgtatatgggaagcgaaaccgatacacgtaggtgggagcgagggagcctgtgaattgtgatggatgaaagcaggtctcattgtgtgcgtgtgtttgtaaattatgtaactgctggaaatcaaatgttcattagacgtcaacctttgaagagttgctcgcacttcgcaagactagttttatttgctcttgctatttgatctggtaatttgtggattggcgacctgcaggctgcagttgtaaaaataact

SEQ ID NO: 147 - DNA, 1133 bp, Zea mays
cttcgcggtgagccgcgacggctccctaacgtaaacgccggcggcgcgcgcggaaagctgcacggcagcacgggcgcggcctcgtctccgcgcctgggctgcaagggcggcggctcggcgcggtgggaggcggggggcggccatccggtcaggtccagcccaggactccaggtgaccaggtcggcaggtccgcgctccgcaacggttctggcgttctgcggctgagtacagacgacagaggaattggggatttacattagcgatttacaaggcaacttggaagacaagcagggtttcatcccgcaatgtcagctcccaacagcgatagcaacatgcagcagctagtccctatagcaccaccaggaaaggcttctggtggtgacagtgagaaggggctggttgtggtggatcttgcaggtaagagatcaggaggtgtaaaactacgagaggatgaggaagacctggaggtgaagctcaggcgcatcatggagaatgtccctgtgcgtgtcagtaacacatcagggtcctctgctggctctggctctggtgatttccaccagtatcggcaaatgaggaggagagagcaggaccggctagctcgaatggatgctgactaccagaagagaaagaagatggctgagttcgaactgcggagggaggagaggatgaaagcagctgaggagcggacagccaagaagcgcctgaaacggcaaaagaagaagcagcgtaagaaagagaagagagctaaaacgggtaataacggtggtgatgaacctaacagagtggagtcttctgatgacgatcacggttcggatgacgatgatgagtccaagcaatgacacgtcagttgcatctgaagatgatttcggacactggttgtctgggcattgaactaacgtctgtatggccgttgtaacaggttacaggccgaatctggtgctctatctgtaagaggacgtgatattttgagcagagaatgatagcactagataatttcatgttagtgttcatcattaaggtcttattcgtttacacaaattcagctctacattagcatggattgatgtgaggtatggatttatctaatctaaacctagattaaatctatgatgtgattccataccttgtaaccg

SEQ ID NO: 148 - DNA, 1837 bp, Zea mays
accaaaagtgctgtgccaccagcccaccactgacaaaccggacccacgacgtgctgatacccatccatccaccaacaactccccgctccggtgtccggtcgccgtcgcgactcacgcaacctcctcggctcgctagccgctacgctactatctacgtcgccacgacatctcccataagatggtagccgcagccgcagccgcagctgcagccacagccacagccacagccacagccacagccgccgcgctcctcgcccccggtctaaagctctgcgcgggccgcgcgcgcgtctcctctccctccggcctcccaccccgccgcgtcactgccatggcctccgcccccaactcctccttccgcccagaggaggcgcgctaccctcccgccctcgagctcccgatcccgcggctctccaagttcaaggtggcgctgtgccagctctcggtgacggcggacaagagtcgcaacatcgcgcacgcgcgagcggccatcgagaaggcagcctccgacggcgccaagctcgtggttctccccgagatatggaatggcccttactcaaatgacagctttccagagtacgccgaggacattgaagctggcggagatgcagccccttcattttcaatgctgtcagaggttgctcgcagtttacaaatcactcttgttggtgggtccatagctgaacgttctggcaacaacttatacaatacatgctgtgtctttggttcagatggccagctgaagggtaaacatagaaagatccatcttttcgacattgacattccaggaaagatcactttcaaggaatcaaagactcttactgctgggcagagccctactgttgtagacacagatgttgggcgcattggtattggtatatgctatgacatccgtttccaggaactagcaatgttatatgctgcaagaggtgctcatttgttgtgctatcctggtgcattcaacatgactactggaccactgcattgggagttgctgcaaagggcgagggctgcagacaatcagctgtttgttgcaacatgcgctccagctcgagataccagtgcaggctatgttgcttggggacactccactcttgttggacctttcggagaggtgattgctacaacggagcatgaggaggcgaccataatagcagatattgactactcactgattgagcagaggaggcaatttcttcctctgcaacaccagcggcgtggcgatctctatcagctggtagatgtccagagactgggttctcagtagcgagcctggatgcggctgtgtgcccgctctgcaggcttgctcgtactacttcggctctgcaggcttgctcgtactacttcgttcatgagatgcatgtctatgggttctagagatcgaccaacatgatgagtgaaggcggagaggacgcaataaggcgactgtagttgtaccttcagtggtgtctccagttgccaaataaattggttactttaacgtctgaagaaaacctccctccatgggacgaagataaaacggaggactgcgacttccctttgggcccgactagtttgaagtttgtactagcttcgggggtgtctgggagtcaagttttttttcacagttttggtagaatactgtagtattctcgaatactacggtattatatacaaaatgttgtttggcaatctagataaaatctatgtttttaaaactgaagtattgcaaataccttagggcatgtttggaaatgcggttttgaaatactgtagttttgagataccatagtttataattgtacatgacataaatactacggtattgctttaccacagtaaaactacagtattgctc

SEQ ID NO: 149 - DNA, 2677 bp, Zea mays
ctgccctgctcagctcatcagaacacagaaggcaggccacagcccgcaggtaggtagtccaccgaaacaaaacaccaccccgtctctcctcttcccagcggtttcctgatccccccacctcgttcgccgaggccgcagcgagcccgcccgtcctccgtccccgcgggagattgtgcgaccgcagagtttggatgctcctgcctatgcaagcaagatgtcaaccaccagagatattgtttagtgctgggcaagttatgcaattttggatcataaattacacagggacaagataattatggaccgcgcagacacatcaggctttgtcagtggtggttgctttggtactacactcctgctgatattcttccattttgtctattctacgatccatgtctgaaagaccctcaggaaccctgcagctgtctgggcagaaatatcatcaggcccctgttctttgagatctctggtgttttatctcattttgttttccaccattgttatattgtctcaactgtgatggataacggcttcatggacatccctcatccgcctctggtgaatgacccctttgtgttagtgggatgcccagcgccagcctccacgatggagaacatgggccaaagcacaatctgtatggatggcctgaacccagcaatggttagttgcagccatgttaatggaaacacacatataatgaacggcttaacagcaagagatgatggcagcaggttactccttggtttgggcccaacaccgaatttttattctgcagtgtccacgggctcaaaacaagctcagagattgtctggccagagttcaacttccattgattcagggatgctgaagcttggccttcagacggatgacagggaagcaattcaatatctgcaacaagcaccgaatggagcactccattctttagatattgttgacgaggcttcaacatctgctgctgtaaggaacatgggtggttacatgccatccctactctttgctccctgctccaattctattgccaatgagacacaagtagaaaaccaagattctctagacctcacgcacagcaccagcaacagtcagcaccttcaacatgacctccagctcagccccgaaccttctgcaacgaccgagtcatcatttggtatgagttctgatgttgtcactgcaacaactacatcagagcgtagccattcccgacatcctaagaaatgcaggtttaagggatgttccaaaggtgcaagaggagcatcaggattgtgtattgctcacggaggtgggcagagatgtcataaacctggatgccataaaggtgccgagagcagctccgcgtactgcaaagcccacggtggcggtcgtcggtgtgaggagcttggttgtaccaaaagcgcggaaggaaaaacagattattgcatcgctcatggtggaggctgccgctgccaacatcctggctgtcctaaagctgcccggggtaagtctgggcggtgcatcaagcacggtggtgggaagaggtgctcggttaaaggttgcatcaggagcgctgaggggaaggctgggctgtgcatttctcatggcggcggccgacggtgccagtatcctgattgcggcaagggggctcagggcagcacattgtactgcaaggggcatggtggcggcaagaggtgcatctttgatggttgcagcaaaggcgcagagggtagcacacctctgtgcaaagcacacggtggtgggaaacgatgcatgtttgaaggaggcggcgtctgtgcaaaaagcgtgcacggggctactgaatactgcgtggtgcatggaggagggaagcgctgttccgtgcccggctgcaccaaaagtgcccgtggccgcactgactgctgtgtgaagcacggtggcggcaagcggtgcaaggttgacagctgtggcaagagcgcccaggggagcacgcacttctgcaaagcccatggcggagggaagcggtgcacatggagcacaggctgcgaaaagttctcccgtggcaagagtggcttctgtgcagcacatggtaccttgatggccaggcagcgagaagaagaggtggtgaagaatgtagggagcatgattggaccaggtctcttcagcggcattgtggcgtcatctgccaccgcagcaagcagcatgacgaacgagcactcggcctctggtgtcagcaccgcttccgactgtgacggcacggtgaggagccaatcaatgattcctccgctggtgctggttcctcgctctatgatgccttcatggtcgactgagcctgtagatggaggcagagagggaggtcatgttgttcctgaggggagggtccatggtggtggcctactgtcacttctcggtggcagcttcagggacgccgacgtggaaaagctttgaagattttgtcagtttgtttgtacataaacaggccgcgttcccgcctatagaattgttattgtgccttttcttgtctagataaacatttcaaccttcatgtaccggttaaatcaatactggtttagtccattgtaaagtggtgactgtcaattgtcgtgaacacttttagcttgttggttcggttcggttgtagtctgtctgtttgtgcgtattcttaagaaactcgtctggactttctattgcaaattgtcgaatgtcaattttctgaaatctggaatttttcagc

SEQ ID NO: 150 - DNA, 1945 bp, Zea mays
ctctctgccagctccagcttcttccaccgcggggccacacccacaccacaccacgacctccgcgacgctcgcggccgtgtttctctcgcctcgctccctcggatcgcccgttcgcccccgcccatcgctcgctcatcagaaggagggcctagccttccgcagcagcgctcgtcagactccgccgcccgcaattccccccttgccccggcttttaatgggctttccctcccaccgaaatggccggcgatccctgcacccgcgccgccggtgaccgccccacctcctccgtcgccttcttctccgccgggggcgggctcggcctcggcccctccagcctgctgctccacctgctcctcctccactccctcttatagcctccagcctcccctcgcctcccgccaccccctatggccgccgttttcttccaccacgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccggacgacccgccctcgggggccaggttcatcggcatgatctccgcgctcgacatcgctgccttcgtcgcctccgcgggggtcggggatcgctccatgcgcgccgtcgtcggcgaggtcgtgcagcccaatcctgcgctgctcagggagatcgatccgggtaccaggttgatcgatgctctggaactgatgaggcatggagtgaagcgctttcttgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattcagaagatccctcaagacccatgcgccgttgctgtagtggagacgatgccagatggaactcgtagcatactaggagacatctctacttacaagctgtggaaatgtgactatgtttcagctgcatgggcactggcaaacctgtcagctgggcagtttgtcatcggtgccgacgagaatgggtcaacacccatctcagtcttcccagagcctcccatcagcccatcgtcaccggtggaggagatcagtcctgggcgctcgccaagggcgaagaagttcagcagcaggagcatcgggtttctgaacaacacccagatgtcagcgtggcggacacggagcatgtaccaccggggcaggagcaccccactgatgtgcaagaccacaagcaccctcgcggccgtcatggcgcagatgttgtcccatcgggccacacacgtctgggtgacggacgcagagtcggaggaggacggcgtcgtcgtcggcgtggtgggctacaccgagatcttcaatgccgccaccaggagcacctgcccaagtccgacagcatcttgatgcaccacatcgtgctgtacagtatactgctgttggttgatccgttggtgccccggtgcacgctgttgcactgaactgtacaatgtactttgctcatttgttggtttgtctggagagtttttagtcttttagatattcttggtctgcatggagcaggacttggtggtatattgttgcattcgttgtggacggtacgaataagaattcgggtttgcctcggagtctagtccattttgcatgctcgcctgcagcagtgcagctgtcgatgtactctatgactgtatatggaaatggaatgttctctgtttcctttc

SEQ ID NO: 151 - DNA, 1350 bp, Zea mays
gctaacactcctgtatccgagctactactcctagtcctagtacaggctacagaggcagagcgagcaaaactgcctgtacatagcaaccatcaacgacgaccgatccaagtagtgagcattagtggatctactacgtacatatatagaaggaaacagctgcagctctctctctcgctgtttcctgcgtgatctgcttgtgtagctactagctagctagcggagcggaaccacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcgcagcgggcgcagggagcagcagcccgagctcgtcgtcgttctcgacggtgacgcaccacccggccgcggcgctgcaggtggggcagttcggggtggagccggaggaggccgccgacctcgcctacatgaccgagtacgcctacaacagctacatgaacatgatggacctcgcgcccgcctacttcggtggagtcgtctacgactacgaccacttcaactgatccacgagcatgcaggaggaggaggagggaagctacaagacgaaggaaggattgactggcctatcagctaggtactattttcgtgttaatggatggatggaccgatttgcagggcgcgcgtagcagtagtagcaatcaaggtcactagtatagtctgtcagtacgacgacgtcgatcagtcaatgtctcctgacgataattattaagtcgatctattcagtagtaacttgttaagccatgtagattagtagcagctggtaatctttgtaaatgtgtgtggattatcatgcaagtgcgcgcttatcatgatcgaaccagtggtctctgcgatgtaatattggggggaacgggggttaatcggaatcagaaaatgcatgcttgtagatgctttatttgg

SEQ ID NO: 152 - DNA, 1507 bp, Zea mays
agcagtctcgatggccgccgccgactcctccccgctccacatcgtcattttcccttggctcgcgttcggccacttgatccccggcctcgagttcgccgagcgcctcgcagagcacggccagcgcgtgtctttcgtctccacccagggcatcctccgcaggctccgcccggtcgcgcccgcgttggcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgcaaggtggactgggtgctcctcgacaacttccacgcgtccatggcggacgtcgccagcgagcacaaggttccctgcatactgaacatgccctactccgcggcgacgacagaggatttcggcattccagacccgtcggttctaccaatgttccggccatttgtggagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgttgtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatgctgagtgcactcaggcagcatacttggcaatggcattggcgttacacaagtgatccgctggactccagctaatagtacgatgtatcttattttgctgcaatatgtaactttatcattgtttggttgtaaaaatatttgaatttgtttctcgtgaattgcatgaaagttattcatatctatcattacaaaagctgactcgaaat

SEQ ID NO: 153 - DNA, 1813 bp, Zea mays
atagggagaggagcagattcggtgagcacacacatcctctaagtgctatctaatctacaatctaccaccagacactgtcgtcagtcgtccctcatcaaccgcgcgcgcgcgacttcaagcatcagactaccataatcatggctccgccgccggcaatgcagagcccaggagagctaaacgacggcgcctacgacgcgccgcacatcctattcatcccgagcgccggcataggacacctgacccccgtcttccgcgtcatcgccggcttctcgagccggggcatcgacgtctccgtcgtgaccgtgctgcccaccgtgtctgccgccgagactgactacttcaacggcctcttcgcggactaccccgccgtccgccgcgtcgacatgcacctattgccgctggacgcctccgaattcacgagagaggacccgttcttcctccggtgggaggccctgcgccgctccgtccacctcctccgccccatcatcactaacgccgcgccgcgcatcacggccatcatcaccgacatcaccctgacctcctgcgtcatccccatcgccaaggagctggacgtcccgtgccacgtcctcttccccacagccgccaccatgctctcgctcaacgcctactaccccgtctatctcgagaagctcaagggtggaccggagccgggcgtgatcggcgacgccgtcgacatccccggcgtgttccgcgtcccgcgctccgccctcccgccggcgctcctcgacgtgaacaagctcttcacgaagcagttcatcgacaacggcagagcgatcgtcaaagccgacggcgtcctcgtcaacacgttcgacgccgtggagccggcaccgctggcagccctgagaggcggcaagatcgtccccgggtacccgccggtgtacaccatcggcccactcaagtcgcacgccacgaaagcgggcgacaagccaggtgacgcgttgcttgacgaatggctaggtaagcagcgagcgcgatctgtggtgtacgtggcgttcggcaaccgcagcgctgccaggctggaccagatccgggagatcgccgccgggctggaggacagtggctatcctttcctgtgggtgctcaagaccacgaaggtggaccgggaggacgacgccgagctggcggaggtgcttggagacggataccttgagcgcgtgaaagggcgcggcatcgtgaccaaggggtgggtggagcaggaggagctgctgaaacacccggctgtgggcatgttcgtgagccacggcgggtggaactcggcgctggaggcgtcgtccgccggcgtgccgctgctggtgtggccgcagctcggcgaccaccgcgtgaacgcgatggcggcagtgagggcaggcatcggggcgtgggcggagcactggagctgggacggggaggacacgctggtgaccaggcaggagatcgccgacaaggtgaaggaggttatggccgacgggaagttgagggcgagcgtggcggtggcccgcgaggaggccgcaaaggccgtcgcggagggcggcacgagttaccgtaacatgcatgacttcatcgccaagcttaagggaggagcttgaggcttgaggagatgatgttacgaacgcaacaatcatgcactgcacgtccattcccaccattccgacgagtgaagtgactgctgttacactcagccgtaccactttggttctgggttttcatttcatgttcatgtgtcttctactactatatacaagcatattcagtgtcttatgtgaactaaagatgatttgaaatggagtcaaataatatatatgtaattagagta

SEQ ID NO: 154 - DNA, 1985 bp, Zea mays
atcgttagaggctcagagtcagaggctcagagcccggcccaggccggagaccactgtccactgcgtctgtctctgtcccgagctcccgatccatccatctgcatcgtgggaacaagaagaacaatgggtatagtacgagtcgcggacgatgtggaggccaggttggtggtcggggcaggtggcggcggcggggccgccaccaccacgacggagccgcttctccgccactgccacggcggccgcaaggaggaggacgaccaggggtctaagatccgggacagcccggaagcggagggggcgtccgactgcgggaggacggacggaggctcgctgcggatggtccttgtctccaccgccgtcgccgtctgcggctccttcgagttcggcacctgcgtcggctactctgcgccgacgcagtcagggattgtagaggaagtcgggctatctatctccgagtttgcaatttttggatctgtactgacaatcggagcaatggttggtgccgttactagtgggcgcttggctgattttctcggacgaaaaatgaccatgcggatatcagctactatttgtatcttcggttggctctccatacatctggccaagagcgctatcatgctctactttgggagaaccttactgggtttcagcactggagttctttcttatgtggtgcctgtgttcatagctgaaatagcgccaaagaatctccgcgggggtctcgcaacgtcaaaccagctcttgatctgttccggaagctcagctacctacatcataggagccctggttgcatggcgcaatttggtacttgttggtttagtgccttgtgtcctcttgctagctgggcttttcttcattccagagtcgccaagatggctggccaatgtcggaagggaaaaggaattccacgcctcattgcaaaagctgcgtggagaggatgctgacgtatcagaagaggcaattgagatcaaagagtatattgaatcactctatagccttccaaaggccaggcttcgagacttatttctgagcaaaaatatatatgcagtcattgtgggcgttggcttgatggtttttcagcaactcggagggataaatggtgttggcttctatgcaagttatatcttcagttctgctggattttctggaaaacttggaaccatcttgattggcattattcagattccaatcacattgtttggggccatactcatggataggagtggaagaagggttctcctgatggtctctgcatctggaacatttttgggctgcttcctcacaggagtatcattctatctgaaggcacaaggactgttctcagaatgggttcccacactggctctttccggcatactggtttacatcggggcatactcaattggaatgggtcctgtcccttgggttgtcatgtctgagatattctcaatcaacatgaaagcaactggtgggagcttggtgacccttgttagctggctgggctccttcgcgatttcttactcgttcagcttccttatggactggagctctgcaggtaccttcttcatgttctcttcagccagcttgatcactgtactcttcgtggcgaagctggtccctgaaaccaaaggaaggacactagaggagatccaggactcactaaacaccagaagatagtaatgaatttacttcacactacagaataattaattccaagatggaaaaaatgggaatttacaggacacagcagaataattccaagatggaaaacgaatgtaccgtcagacctctgctcatcgatagagatgtatacaagaaacaatatatataattctcacgtcctcccgcttcccctccctttctctcccgcgccacctccgtgtaatacgtagtgtactgtgtactctatgtaggttaaggaatgctgcagattcagattacgcattatgtaccgtgcccctccagattgtttgagcatgagcagcgacagaaccgacattatgttt

SEQ ID NO: 155 - DNA, 1838 bp, Zea mays
acaaagcctgatacgtaactactaggccgatcggccatccacagacccgtcttaactctacctgcctgccactatactatcagcctgtgcgagcgagaaatggacagagccgccaagcctcacttcgcgctcatcccattcacaggaaccatcagccacgtgatccccatggcagacctcggctgcctcctcgcggcccacggagccgaggtcaccatcatcactacgcccgtcaatgcagcgatagcacagagccgtgtcgaccgcgcacagtcacacggtgccacgactacgatcacggttaccgcagtcccgttcccggccgcggacgccggcctgcccgagggctgcgagaggatggacctgctccggtcccaggccgaggtgcctcgcttcttcgtggccaacaaaggcttcggtgaggcagtgtcgcggcactgcctcggcgaagcgctgcgccgtccgagctgcgtcgtctccggggcgtgccagacgtggacgctgggcctggcgcgccagcttgaagttccctgctacgtcttccacggtttcggcgccttcgctctgctctgcatcgagcacctgtacaggcacaggccgcaggaggctgccgcgttggctgacgacgagctgttcgacgtcccagcgctgccgccgcctttccggctcaggctgtcgcgtaggcagctcccgccgcatttcatgccgaccacttccgtcgccgggaaggcgctgcaggggatccgggatttcgacgtggccgcggacggcttcgtggtgcacaccttcgaggagctggagagcggctcgacggcgctactcgcggaggcgacgggcaaaaaggtgatcgccgttgggcccgtctcgctgtgctgcgcgccaagcctggatcctcggctcgtgtcgaacgatgatgcgaggcgatgcatggcgtggctggacgccaaggcgcccaagtccgtggtgtacgtgagcttcggcagtttcgggcgcatgccacccgctcagctcatgcagctcggcatggcgcttgtcgcatgccgctcacctgtgctctggctcgtcaagggcgccgactccctgcccgacgacgtcaaggattggctaagagagaataccgacgcagacggcgtcgcaggcagcaagtgtctggtggtgcgcgggtgggcgccccaggtggccatcctggcccatccggccattggcggcttcgtgacgcactgtggatggggctccatcatggaggctgttgcagccggtgtgcccatggcaacctggccctttttcgcagagcaatttatcaacgagcagctcatcgtgcacgtgcttggcgttggggtgtccgtcggtgtgacgaagccaacagaaaatgttttgaatgctactactgacgccgccggtggcagccaaggggaggctgatgccgaggtggggatggaacaggtgaagaaagccatggatacgctgatggatcaagggcctaaaggggaggagaggaggaggaaggcccatgagctgaaactgaaggcgaagagtgctttggagaagggaggatcatcctacactaatctggataatttgatcctgtcttttctttgaatgtcaccatgtcttacttttgcgtcccagcatacatgttttgtttgcctctgagtgtcatactatggagatttatttactctttatttattattactatggtcatttgtttctgtcgagtaaagttattgtattctagatcaaccggtgctcctcgatgagcatgtaattttaagtgatatacggaatatgggttcgtggataaatttaaggacaaataaattaaaggtttttcttat

SEQ ID NO: 156 - DNA, 2146 bp, Zea mays
cttgacatgcaggcctcacgtgtcattccccaccgctcatatctccctctccgcctcggccgcttcccctccccgctccactcttccccgcgcgcctgtcccgttggccgcgaatggttctcgcgcgagtcctcccgctgcccgccccgtcgtccgcgccccaccgccgcttactcctgccgactcaggcggcgccggccccggcgcgtgtgctcaccgtgcgggccgtcgcctgccgcgcagcgaacgccatggcggccgttgctctggacccgcccgcggtcgctccgagccccgcagaggtcgcagccgtgggcgtcggggaggagctgccggaagggtacgatcagatgatgccgaccgtggagccgtcgcggaggcggcgcgccgggctgctgctgcatcctacttcgttgcggggcccgcacggcatcggcgacctcggggacgaggcgcttgctttcctgcattggctccgcgacgccggctgcacgctctggcaggttctaccacttgttcctccaggtaggacggctggggaggatgggtctccttattctggacaggatgccaactgtggcaatacccttttgctatcccttgaggagcttgtaaaagatggtctactgatgtcagatgaacttcctgatcctgtggatacagagtatgttgaatttgacactgttgcaaatctgaaagaaccacttattgcaaaggcagcagagaggctcctactaagccatggagagctcagaacacaatatgactgcttcaaaaaaaatccaaatatatcaggttggcttgaagatgcagctctttttgctgctattgacaaaagcatcaatgcattctcttggtacgagtggcctgaacctctgaaaaatcgccatcttggagccttggaagagatatatgaaaaacagaaggattttatagagacatttatggctcagcagttcttatttcaaaggcaatggcagcggattcgtaaatatgcacaaaagctgggtatcagcatcatgggtgacatgcctatatatgttggctaccatagcgcagatgtttgggcgaacaggaaatcatttttgctggacaaaaacggtttccccactttcgttagtggcgttccacctgatgcatttagtgaaacgggtcaactatggaacagtccattgtacgactggaaagctatggaagcagattgtttttcatggtggataaagaggattaaacgtgcccttgatttgtatgatgaattccgtattgaccatttccgggggcttgcgggtttttgggcagtcccttctgatgcaaaagtagcactggttggaagctggagggctggaccaaggaatagcttttttgacacgctcttcaaagctgttggtagaatagatataatagcagaagatctgggggtaattactgaagatgtcgttcagctaaggaaatccattggggcccctgggatggcagttctccagtttgctttcggaggtggttctgacaaccctcatttgccacacaaccatgaaatggatcaagttgtgtacactggaacacatgataacgatacagttcttggctggtggcaaaatttaccagaggaagaaaagaaaattgtgatcaagtatctaccagaagccgagaatattgacataacatggacactgattacggctgccctctcttccgtcgcgaggacttccgtggtaaccatgcaggacattcttggccttgacagttctgctagaatgaatactccagctacccagaaaggaaactggaggtggaggataccgagctctgttggcttcgacagcctcagccctgaagcagcaaagctgaaggagctgcttgcgctgtacaatcgacagtgaagtccgctattgccatcgaagttccttcaataaaataggcaacaaaatgtgagcggtttggttgccaagttctatggtacgcggccccgcacagaggttgtgttctggttggctggaaacttgcgtgcactgcaagttaagacttgaacatgaagcactattgtatgtgtgtgtattctcatttttttattaaccatttttttggtcgggtctatacaagtgttttccccccattgctttgcagcaaagcattaccaatttggatc

SEQ ID NO: 157 - DNA, 2077 bp, Zea mays
ggtcggactctgctcgatcgaccgccactgcgatcgcagctctcctcatgccgatcagcgccatgcgaccgtcgccatcttccgtagcgtcgtcgggggacacggcggcgccgcgcatgtacttcatcccgttcccgacgccagggcacgcgctgccgatgtcggacctcgcccgccttttcgcgtcccgcggcgccgacaccacgcttgtcctcacgcgcggcaacgccgccaggctcggtggccccgtcgcccgcgcggccgccactggcctccgcatccgtatcgtcgcgctcactctgcccgcagaggccgccgggctcgcgggtggccacgagagcgccgacgaccttcccaaccgcgagctcgctgggcctttcgcggtcgccgttgaccttctcgcgccgctctttgctgatctgctgcgccgccagcctgccgacgccatcgtgttcgacggtgtcctcccgtgggctgccactgcggccccggagctcggcatcccgcggtacgcgttcaccggcacggggtgcttcgcgctctcggtgcagcgtgctctgctgctccacagcccgcaaaatggcgtggcgtcggacaccgagccgttcctcgtgccgggcctccccgacgcggtgcggctcaccaggtcgaggctcgccgaggcgacgctcccgggcgcgcactcgcgcgagttcttgagccgcatgttcgacgccgagcgcgtcacggccgggtgggtcgtcaactcgttcgcggacctcgagcagaggtacatcgaacactacgagaaggacacggggaagccggtgttcgccgtcgggccggtctgccttgtcaacggcgacggcgacgacgccctggagcgcggccgcggcggggactccagtacggccgccgaggccgcgcgcgtgctgaggtggctgaacacgaaacccgcacggtcggtggtctacgtctgcttcggcagcctcaccaggttcccgcgtgagcaggtggcggagctcggcatgggcctcgccgactccggcgcgaacttcgtgtgggtcgtcggggacaaggacgcgccgcagctcccggacatcgacggcgcggcgcccggccgcgggctggtggtcagggggtgggccccgcaggtggcggtgctgcggcacgcggcggtgggcgcgttcgtgacgcactgcgggtggggcggggtgaccgaagcggcggcggcgggcgtcccggtgctggcgtggccggtgttcgcagagcagttctacaacgaggcgctggtggtggggctcgcgggcacgggcgtctccatgggcgcggagagggggtacgtgtggggaggcgaggcgctgggcggggtggtggtgggcagggcggcagtggcggagcgggtgcgcagcgccatggcggacgaggagctgcgggggagggctggacgggttggcgagcgcgcgcggcgcgcggtggaggcgggagggtcatcgtacgaggccgtgggcgcgctgctggaggatgtgctgcggcctcaacgccaggtccaggatctggatgccgtccgggagacgaggcgggatgctgagatttttaattaaactagtaattgggcttgtgcgtttgcaacgggagataacaaaatttcaaagcaatatatgtacattacgatataacaatacccaaaatagcaattctctttaggcatgtgagaataaataatgtagtatttgttttcatatgccagggtctttaggcatcagaaggaaaacagtgctccctagtcgcgccgtgcgaacaaccagctcatactgtaaatgcaagaaacaagataattgggaagtgaagtatttcatccagtgatcagtgaaataacatttagttagctagacctatttagtacatgtgtaacagtcacatcttataaaatttattctatatgcctgcagcggcgaagatgtagagatcaaagcaaatgggtcaagtatgacttcaacaattaaccagaaagtgccttttatatatgaaaaatggcccatctggacatcccattgtatgatctacttcatgaaacaaaatctgaaactttattggg

SEQ ID NO: 158 - DNA, 1713 bp, Zea mays
aagttgatgaccgccgagccctcgaagtgtccaagaagaacacaactgcgcaagcactccacttcaagctcccaccatcaccggatcaccaccggtggcggactggcggtggggcacacaagacacaaaccgtcccttccgtcagcccgcacatctcacctgcgcacgcgccatgggaaaactgcaggagcgaaaaccgcctgcgtgcaaaaccgcagcgcggccgcgcgtgctgctgctgtgcagcccgtgcatggggcacctcatccccttcgcggagctcgcgcggcgcctcgtggccgaccacggcctctccaccacgctcctcttcgcctcggctacatccccgccctcggagcagtacctcgcggtggccgccgccgtccccgacgccgtcgacctcatcgcgctgccggcaccgccgccagacgcgctgcctcccgccacggccgcgcgcgagcgcgcggagctcgccgtcgcctccaacgtgccacgcgtccgggagatcgcgcgggagctgggcgcggcggcgccgctcgtcgcgctcgtggtggacatggtcggcgcggcggcggcgcgcgacgtggcggcggagctgggcgtcccgttctacgccttcttcacgtccccgtggatgacgctttcgctgctcctccgcctccccgagatcgacgcaacccgcgccggggagcaccgggacgccgcggagccgatccggctccccggctgcgtgccgatccacgcccacgagctgccgacgtccatgctcgccgaccggagcagcagcgcgtacgccgggttcttgtccatggccaagggcgtcgcgggagtcgatggcgtccttgtgaacacgtttcgtgaactggagcccgcggtgggcggcgacggtcgtctgcagctgccggtgtacccggttgggccattggtttggaccaggccggccggcgtggacacggaccacgagtgcatgagctggctggacgggcagccacgtggctccgtggcgtatgtgtcgttcggcagtggcggcacgattacatggcagcagacggctgagctggcgctggggctggagcttagccagtgtaggttcatctgggctatcaagaggccacaccagagctcaacaatcgcggcgttcttcgggactcaaagaggcgatgagcacagccccttggattttttacctgaagggttcatggagaggactagagggatggggttggtggcccagtcttgggcgccacaaacagctatacttggccacccttccattgggtgcttcgtcacgcattgcgggtggaattcggtcctagagagtgtgatcaacggtgttcctatggttgcttggccactctacgccgagcagaacatgaatgctgcgatgatggaggtccaggttggtgtggcattgcgggctaaggtcggagctgatcgatttataaggaaggacgaagttgcgaatgcgattcgacgtgcgattgtaggggaggaggctgaaaggctgaggaagcgatcaagcgagcttagacgccaatcagcgcaagctctgagtaaggatggttgttctactcgtgctctggcacaaattgcaaatgcatggaaacgcgctagcagaaaatgaagaaaactcgacgttatgtttgcagctctatcaattatcgatggtaattttgtgctagatgacgtatttattgaatatgtctatttgtc

SEQ ID NO: 159 - DNA, 1531 bp, Oryza sativa
aacaacaatagcaaaggatccccttcatcatcaaattcccaatttcttcggtcgcgacgccgacgggaagcaaatcgatggacggcggcggcggcatgttgggcgccgtggtgtgcttgctgctggtcttcgccatcttccccctcctcctctggcgccgccgctccgatgccgcccaccgcctcccaccccagccgctccaggacgaacgtgtgctccgcggcggtcccgctcccggtccggcggcgcgccgcatgcgccggaggccgctctccacttcggctgacgcttccaccagccgcgaccgcgatgtcgacgacgctgacagtgacctagaggaggagatccaggatgtccccaggggttccaagaagaaggagaagaaaaggcaagaccgagaggcccagcgtcaggccgaagaagcagcccgggattcgaggaggactaaacaagatcgctatgcagaaatgaggaggaagaaagacgaagagcgtgaggcacaagagagacttatggaagaagaagcaagggcgaggaaagccaaagaggaggaagctgctgccttggaatttgagaaatggaaaggagccttctcagttgatgctgaaggtacaacagagagtgacacacaagatgatggccagggtttgctccacaattttgtagagtacatcaagaaccagaagtgtgttcctctagaggaccttgccgcagagttcaggatgagaacacaggactgtatcaaccggatcattacacttgaaggcatggataggctatctggtgtcatggatgatcgtgggaagttcatatacatatctactgaggagatgaaggctgtcgcagattacatcaggaaacaagggagggtgagcatatcacatttggccagtaactcaaatcaatttattgatttggagccaaagccccagtacaatgaggagagcaatctcgatgagaatgccgcagcaggcaccgagctttgaggagacacttgacctcatctcatcgccctagcataccctccctttatgtgatagattgggtggccttatggcgatgacaaagtttgctaacctgagcgaggactaaggatttgtatgagagttggttctcacatggtaaatatcatgaaggatgagcaagtataaggttggaagaacagagtatgcactctgcttttgcagacttgtgcagcctattttactagtagtactagttcatagcgctcttaggaacctgtgtgtgctctgcaatgcaaaactaattattacatgcttcatgagctgacatattttgttgtataagataactagacgagagcaattaagttgttgatagcttttaccctgaaagagtggagagatcaagacagagcaaggcacatatatatgatggtttgagctctgaaagctttgggacatgtcaccggaaggaagtctcaaggaaacaccaattctcccttcttcccttggtatagagtttctgtttcagatccatgattgtgtagtacaagtgaacttacacggct

SEQ ID NO: 160 - DNA, 1963 bp, Oryza sativa
agaccgccccggaatttcacgcgcaccctcccactccacactctcctcccaaaaatttcccccccctaaaaccctagcttagctccccccgcgcgcccatggcctccgacgccaagcccgactccccgcccgccggcgtcgaccccccgccgcccaaggaggaggcgaaggcggagaaggagggggagggggaggagccgcagtcgggggggcggaagcgcgggcggcggaagaagggggaggcggagaaggagaaggagaagcccccgcccgccacccccaccatcgagaggccctccagggagaggaagaccgtcgagcgctactccgagctcgccccccgcgtcacccccgccaagaagtcccccgccattctccagggctctggatcgaagctgaaggacattcccaacattcaattcaaactatcaaaaagaaaggcagacgagaacctgcaaagtcttcatgttttaatgtatggaagaaaatcaaatgtccatttcttgaagagaaacatatcccaattttctggttttgtttggactgacaatcaggaaaaacaaaggaccaggataaaggaaaagcttgacaaatttaacaaggagaagttgctggatttttgtgaaatccttgatatacatgtttccagagcagccacaaagaaggaggaagtctctgccaaattactggaatttttggagtccccttgcatcactagagatgttgttctcactgatgataagaaagggaagaaacgtggaaggagatctaaaggaaatggccaggcgactgctgaaggcgcttctgatgggaagaaaaggagaaagagtcgaaagcaatcaactgaagctgctaaagagaatgacgatgaagacgatgagggtcctgctgattctgaggatgcatcaatgggtgaggaagatgatgaggattctgaagcaaaagataatgctgggagtgatgaagaacctgatgagcctccagcaaagaaaaaggcaacagatgataaacaaacaaaaaaggcaaaagaaaaggatgcgactgccaagaaggcttctacaagacctgcaaaaggtgtgtctaagccttctcaagacactgaagaagatgatgagccagaagttgagttagaaagcaaaaaggttgtcaaaaaagtctcaaagagttcaaaggagagtgatgttactgtagataaaaccaccaagaaggcttctaaatccaaaaaggatgaaggaaaagatggccagaacaataattctggtgcattgaacaataaggcacgcaagaaggatgctgccaagacaaccaataaaaataaaggaaaaggaaaaggcagcacagaggctggggcagccccaaccactgaagagctgcatgctgttgttagtgacatattgaaggaagttgacttcaatacggcgacattggcagatattcttcggcaattaggtactcattttaagatggacctcatggataggaaatcagaggtgaaacacattattgaggaagtaataaatagtatgtctgatgatgaggaaggtgaggaagacaatgctgaagatgacaaagacaaaaatgctaaggaggaaaattcaaaggaagatgctgatggtgacgagaagtaattcagcggaccacatgtgatggtcgcttgtgttagtgttatggatgcaggactttctagcccaacattgccgtttgggctgtgttgggtctgtacaatgagggcaccgcaacaatgaactggtgacctgggggtagtacaaggttgttaacaatttgatagccacacacacctagttgttgtgcttgactttggtgtgacttgtagtctagttgctggtcatgtacaatagctgtgctgttataactttgcttaggtagctagcctgactgtaatatgcagaataattctttgcctgttccttccatttatccatgtaaaacagtgaatttggaa

SEQ ID NO: 161 - DNA, 1142 bp, Oryza sativa
acacgcagtcggcgccgcgatgataaaaggcgagagaaatttacccacgagtcgctcgcgcggtgactgacacaccgtggcgatgacacacgccgaaaggaaagcttggccgcggcgcgggggcattttcgggaggagacacgaccacgaccccacgaggggatcgaaaagttgcggagcttttatttaaccggccggtttgtgccactctcgccactgtcctaacctgcacttcgctctctactcctctcgctctcggtcatgggtggtggtgcggcggcgagcagggtgtcgtcggccatggccgtggcggtggcggcggcggcggcgttggtggtgatgtgggcggggacggcgacggcggcggcggccgtgtacgaggtgggcgacaagaccgggtggaccatcatgggcagccccaactacacagcctgggccgcctccaagaagttccatctcggcgacaccgtcgtcttcacgtacaacaagcagttccacaacgtgatggcggtgagcaagtcggactacaagaactgcgacacgagcaagccgatcgccacctggtcgacgggcaacgactcggtggtcctcaacgccacgggccaccactacttcctctgcggcttcccgggccactgcggcatcggccagaaggtggacatccgcgtcgccgcctccggccactcctctgctgccccttccatggcgcccgccccggcctccggctccgaggcacccgtcgcccccggcggcggcggcggcggctcgtccggccacgccgccgccgccgccccgtcgccgcacggcaacgccgccgttggccgctccgtcttcacggccatcgccgtgtccgtgctctccgtcgccgccgctggcctgaagttgatctagttggggggttggggggggggggtggggttaggatggcgcgcgccctgtgaattgtgagcttttgcgtttggagctgtgttcatcttctcttttgcccccctcctttcgtgtcgtaattaattaaactagtatgatcctgtggaattgctgcaatttgaggatctctgccggttgtcacctcatgttttggactttggaattgtgggtttcatctcagattagatcaatcgattgaacaatcgtatgctgct

SEQ ID NO: 162 - DNA, 2206 bp, Oryza sativa
agtgccaccaccatcttcttcttcttcttcttcttcttcctcaagactaccaatccaatctcctcctcgccgccatcgcgatctccgccgccgcccgcctgtcgcggccatggcatccaccaagatcaaggtcgccaaccccattgtcgagatggacggtgatgagatgactcgagtattctggaaatctatcaaggacaagcttatcttcccgttcttggagttggacattaagtactttgatctcggacttccataccgtgatcaaaccgacgataaagtcacagtggaggcagcagaggctaccctcaagtacaatgtggccatcaagtgtgcaaccattacaccagatgaagcaagggttaaagagttcagcctaaaatccatgtggaagagcccaaacggcacaattagaaatatcctaaatggcactgtgttcagagaaccaataatctgcaaaaacatccctcggcttgttccaggatggactaagcccatttgcattggaaggcacgcatttggtgatcagtaccgtgcaacggatgcagttatcaagggacctggcaagcttaaattggtttatgagggaaaagatgaggagattgagctggaggtgttcaacttcactggtgctggaggagtggcacagtctatgtacaacactgacgagtccatccgttcctttgctgaggcctctatggccactgcttatgagaagaaatggccattgtacctcagcaccaaaaacacaattttgaagaaatatgatggcaggttcaaggacatcttccaggaggtatatgaagctcagtggaaatcaaaatttgaggctgctggaatatggtatgagcatcgtctcattgatgacatggttgcctatgcactcaagagtgaaggaggctatgtttgggcttgcaagaactatgatggagatgtgcagagtgatttcttagcacaaggttttggatcattgggtttgatgacatcagttttggtatgtcctgatgggaaaaccattgaagctgaagctgcccatgggactgtcacccgtcattaccgtgttcatcagaaaggtggtgaaactagcacaaacagcattgcctcaatctttgcctggacaagaggacttgcacacagggcaaagctagatgacaatgctaggctactggacttcactcagaagcttgaagctgcctgcattggcgctgtcgagtctgggaagatgaccaaggaccttgctctgcttgttcacggatcttcaaatgtcacgaggagtcattacctgaacactgaagagttcatcgatgctgttgctgacgagctcagatcaaggctggcagccaactaaagctaatcaaatcaagtgattttgctgttattgatgtgatccgatgcacttcgattatacatttctagaaccgcatcattcgacgttacaaatattttttttcttaatgaattttgaatcacttggtaggtggagattacaaataaagtttcagagctattcatgagaaagctccagattcagttatgaacaagagcaattgatacatatgtccaaataatgtgtattcatcaattcagttactaagaaaatagtggttcttttccaatgtacaaacagatgaaatgtgcaggctccaccaagctagctacacacctccagctagccttaaacttcaatataatataaggcatcaagcaagcaaacgaacaaacaaaagaaataataatattgcattagattaactagttcactactagtaaaccctagctatttttgcgttgatgcgacagctcaagtgctcatttctccctccttaaaacatcggaaatggctcttcatgtcgctggagctaaggaccctttcaatctcttcttagtttagcagagagacgaatccataaccctaaaaaaaataggagaaaaaacacgcaaaaaaaagggagaaaaaacaaagcaggtaaatctctcaagtgcaatggcctgatgcagagctatgctgctaagtatgaagaatgctgttgccgtttgcatagtagcagccgttcaccaggccgttcttgacatgtccattttggtatagcttctgttgtttcgtggctccgttgcagtagttgccacgtctgactggcgagctgacaacgccgcaagattgctgaagtaaatggtcaagctgtcctgatgaagctgctattaatcc

SEQ ID NO: 163 - DNA, 1849 bp, Oryza sativa
actagtggtggagagacgaaacacaggacgccgaaattctctcgcccacggattcccctccactcgcactgtcagtctgtcactctctccgccgccggccgccgaatctccggcgccgatggaggcagaccccaatccgatggtggtgctgcacgcctgcctcggcgtgggccacctcatccccatggttgaactcgcgaagctccttctccgccgcggcctcgccgtcgtcatcgccgtgccgaccccgccggcctccaccgccgacttcttctcctcgtccgcccccgcggtcgaccgcatggcggccgccaacccttccatctccttccaccacctcccgccgcccgagtaccccgacccggatcccgacgccttcctgcagatgctcgacacgatgcgtctcaccgtgccacccctcctcgccttcctccgctccctcccctcggtcgcggctctcgtgctcgacctgttctgcgtcgacgcactcgacgccgccacggcggccggcgtcccggcgtacttctactacacctcctccgccggcgacctcgccgcgttcctccacctcccgcaccacttcgccaccacggaaggcagcttgaaggacatgggtaagacgcccctccgctttcccggcgtccctccgatcccggcctccgacatgccgcacaccgtgctcgaccgcgcggaccggacctgcgctacgcggctggggcactacgggcggatcccggaggcgcggggtattctgattaactcctacgaatggctggaggcgaggtccgtgagggcgctcagggaaggcgcctgcatccccgaccgccccacgccgccggtgtactgcatcgggccgttgatggcgaaaggcgaggaggcggcgaacggggaacgccacgcatgcctctcgtggctggacgcgcagccggagaggagcgtcgtgttcctctgcttcggcagcttgggcgccgtctcggtgaagcagctgaaggagatcgctcgtgggctcgagaattccggccaccgtttcctctgggtggtgcgtagcccgccgcaggatccggccaagttcttcctgccgcgtccggagcctgacctgggaatgctgctcccggaggggttcacggagaggacgcgggacaggggaatggtggtgacgtcgtgggcgccgcaggtggaggtgctccggcacgccgcgaccgccgcgttcgtgacgcactgcgggtggaactccgtcctggaggcggcgtcggccggagtgccgatgctgtgctggccgcagtacgccgagcagaggatgaacaaggtgctcttggtggatggcatgcagctcggagtggtgatggacggctacgatgaggagctggtcaaggccgaggaggtggagaagaaggtgaggttggtcatggagttcgaggaagggaaaaaactcagggatagactgacaatggcgaaggaaatggccgcgaaggcgctggcagacggcgggtcgtcgtcgttggcgttcaccgaatttctgaaggatttgaactttggaaacactacaaaggaaaaagcgtagaagacgaacattgagcagtgcaaacgatcaagcacaaaagatgaacattgagttggaatgatttatattgctgctggaatgtgacaaaatcacatatctgcattatttacccgctgtgaactgtgctatttttctgtatttctgatgtgagcagaaggtgtgagagtttcttcaggctgattagctgcttcagcagtcagcacttgtagattacactctggagccgtgcttacatgatggaatagtattatgctctatcacaatatgcaagatcaatgttcctcttct

SEQ ID NO: 164 - DNA, 2542 bp, Oryza sativa
agtttcacttcccccttggtcttggtccgtctccactctctccactccgccgccgccaccgctcgtcgtcgcctccccccccaaatcaaaaatcaaaatcaaaacccccccatctcttcttctagtttcttctagaagccgggacgaacaccgcgtcgtcttcgccttcgccttcgtcgtctcccgctcgcttcctccctcctgggttagactgttaagcttatcctgcatcatggagaatggagacaaggatgagaaaaatgttgctgtcacggaaggatctaccaattctgaagaaaaggatcaagatgaggatttgttgaggagaacagaaatgctgaatgcaaaagaagcaataaattcttcaaatgagaattcaggcaatgattcagaagcacagatccatgtgagagatgattcacaaaaagaattcaatgagaagatgaataaagaaggaagctcagatccaatggaacctacagattcaagccagacagaggaagatatccttgctgaagacaaatctgaagaacctgtttttgatggaactgaggttgctgaaatggaagatttgaggcgttcgtccaatcaatctgtggaacttgattcagatgcccatgggtctgtactcaatgaaagagctactgcaatcaagaattttgttaaggaaaagggtgccattgcagtttcaacatttataaggcgcctttctggcaaaaaggacgaaaatgaattttctgttgaagatgaaaagaatgaaggatcagaaagcatcagtagtggcaatattggctcagatgctgaacctaaatcaaaagaggtgcagcccaaatctgaggagagaactacatggaatccactcaacttgattaaaatcggacgagattttgataccttcatgactggggaagctgggcatgaaaatgtgccagatttgatagagcaaccaacagggaagggaagaattattatatacacaaaactgggttgtgaagattgcaaaatggttcgctcattcatgcgtcagaaaatgctcaagtatgttgagatcaacatcgacatattccccagtagaaagatggaactagaaaataatactgggtcatccacagtaccaaaagtgtatttcaatgacttgctgattggagggttaactgaattgaagaaaatggaggagtctggcattcttgatgacagaactgatgctcttttcaaagatgaaccctcatctgctgctccgttgcctcccttacctggagaagatgatgaatctggtagtgggaagatagatgagttggcaaccattgtcagaaaaatgagagagtcaatcactctgaaggatagattttacaaaatgagaagatttagcagctgctttcttggtagtgaagctgtagatttcttatcagaagatcaatatttagagagagatgaggcggtggaatttggaagaaagcttgcaagcaaatatttctatcgccatgttttagacgaagatgtatttgaagatggaaatcacttgtatcgcttcctggataatgatcccataattatgagccagtgctacaacatccctaagggtatcattgatgttgaaccgaaaccaattgttgaagtggcatcaaggttaagaaagttgtctgaaaccatgtttgaagcttatgtatctgaagatggtaaacatgttgactacagaagcatccagggttgtgaagaatttaaaaggtatgttagaacaactgaggagctccagagggtggaaacccatgagttatcacgggaagaaaagctcgctttcttcataaatctctacaatatgatggctatccatgcattagtgacatgtggtcatcctgctggaccattggacaggagaaagttctttggagattttaagtatgtcattggtggatgtgcttattcaatgtcagctattcaaaatggcatactgcgtggtaaccaaaggccaccatacaaccttgccaagccttttggacagaaagaccaaagatccaaggtggcccttccatatgctgaacctcttgttcactttgctttggtatgtgggaccaaatctggacctgcacttaggtgttactcgccaggaaacatcgataaagaactggtggaagctgcacgtgatttcctaagaaatgtaggaattgttgttgatcctgaagccaaggttgcatctgtaagcaagattttgcgatggtatagcacagactttggtaagaacgagacggaagtgctgaagcatgcggcaaattatctggaaccagcagagtcggagcaattcttggaactacttgcgaacactcaactgaaagtcttgtatcaaccctatgactggagcttaaacatttagctgcagccatggtattcacatagatgtctagttatacttgaatacctgtcacagatactcgtggaagatcacgacttcttttacaccagaattttcccaagagttggtcacagctctggatgctgttttgttgtggcacaaagaaatgagtaccaatccaactctgttcgattc

SEQ ID NO: 165 - DNA, 1251 bp, Oryza sativa
aacaacgctcgtactgtaagcagtttcccaccaattgggcctcgaaagtttccgtgtggcccatcgtccccggcgcggccgcggcccaactccttcgcgtggaggcggcgaccgcttcagcctcaaagtctcgaacccctccgccgccgccgccgcctggctgctcggccgctcctccgcttgctctcccttgcttccgagggctccgccgcacggggtcgtcgcggctagagggtgggctcgccgtcgaggaaggcgggggtgtctggctcatcgagaacagtgccgaggggaatccgggttgcgggggcgatggccatggccgcggcggaggcgcgggtgcggcaggagaaggtgaagaagttcgaggacttcgtcgaccggagactgaagccggaccttgtgaacaccatcgcgcagcgggacaaggtgttccagcagcagaagaccttcttggacttgaaaaggaacatcgaaaatttggagaagaatggagtcaccagtatgcgatccatggtcaatcttggctctgaggtgtacgcccaggcagaagtgccagatacaagacacatttttgtggatattggtctaggtttccatgtggaatttacttggcaggaagctttgcagtttatatctgtaagagaatcaaggttggcaagacagatagatgagtacactcatctcatcgcaagcataaaagcgcagatcaagttggtatgtgaaggtatccgcgaactactcgagctaccagcagagtaaaggtgaaagttggcaatgcaatcgtatgggggtgcttggtagaatgacttgtgcttttgcttttctcacgaaggcatggtcgcccatcttcgaacatgaaagattttacatgtactgttgtgcaaaagatggtttcatacactcatccctgtaataacattcatctaatcagattaactacagtagaatttcgctatgtgaaatcaacgcaaacactgtgaaaacttgttggttgatgcaacttctgatcttccctagattcccaagtcatagtgtacatggcatgccttggaagctcatggcatgttccattttgtcattagattagaacaatgaaaggaagttaggaacatgccattttgcatatagatgtgtcagtcaagacagcagagcaaggaaagtatatattgggctattggcacttcatctggtaaggcataaagcttttgcctttgccgcgaagctgccttattgtcttttccactttcc

SEQ ID NO: 166 - DNA, 1917 bp, Oryza sativa
ggctggtgatgtttgtgttgcacgcacgctaattgaaaaatcacactcaaaacggttgggaggttagcagccatggcaatggaggcggaggctctcctgccggagccggagccggagtcgccgccgctgctcgccgtcgaccacctcggcggcccggcctcccgcggcagctccggccggtggcccgccgcgttcttcctcatcggagcggaggtaggcgagaggttcgcatactcgggcatcatggggaacctggtgatctacctgaccgggccgctccggcagccgacggcggcggcggcggcggcggtgaacgtgtggatgggcacctcgatgctgctgccgctgctcggctcggccgtcgccgactcatggctcggccgctaccgcaccatcgtctgcgcctccctcctctacatcttggggctgggcatgatcactgtctcgtcggttcttgcaccggaagagtcatccgagagctcaaatctagctgctcatgtggctttcttctacttctcactctacgtggtggcgtttgctcagggcggacacaagccttgcgcgcaggcgttgggtgcagaccagttcgacgagaacgaccccggcgagctcgcctccaggagctccttcttcaactggtggttcttcgcctcctacggcggcaacactgtcactgttcccatcttgaattatgtccaggaaagcgtaagctggcagcttggcttcgcaatcccatgcatcgccatggccgtttctcttgccatcttcttgatcgggacaaggagttatcgcttctaccctccgaagagtaagggaaacccattcggagaggtcgccgagtggattcgacgttggatcgcatcgtcctgttcgaaattgcctgacagttctgatgagttgctaccgtcatcatcgtctgagggggatgtcagcaattcaagcagtgaattcgtccctaaagaagctgcagagctggtcaagttgtttccaatatgggcttccagcctgatatatgctgctgtgatggcacagtgcatcactttctttacaaagcaagcaagcacactggacagaagggtaggcagcttagtgctgccagctgcttcaaacggggcattgttcaatgctacaatcatggtcttcctcccaatctatgacagaatctttatcccagtggccagaagatacaccaagaaccctagcggtatcacgacgctgcagaggatcggcgtcgggttggttctctcgatcatcacgatgatcgttgctgcaatggttgagatgaggaggctcaggatagcaagagatttcggccttgtggacaaacctgaagctgttgttcctatgagcttcttgtggattgttccgcagaacattctggctgcaatttctgatatgtttgctgtgattggattgcaagagttcttctacggtgaggcaccggagagtctgcgaagcttttccatggctctgttcttgagcataattggagttgggaacttcatcagtagtttcattgtatatgccattgacagggtgaccagtagctttggagacagctggttctctaacaatccaaacagagggcatgtcgattacttctacttgcttattaccgtgctcaatgctttgtccctggcctgtttcttatactttgctaaaatgtatgaacataggaaaaaggtcatctcagtgcagtgacattgtgtgcagcctacatatttgtagctccactgataaggtcaccttcacaatctgatccagtctcaagaatgtaacatggtaaagctgtatctggtataatgtatgttccagtttcacttccttcattgatacgtcctaactatactttgtaagaaattatgtgacccagctgcaaatgcaaatgaaatgttccttaatttcatgttttgtctc

SEQ ID NO: 167 - DNA, 2007 bp, Oryza sativa
cttccacttgtctgacgggccctcgccttcccttcgcttcctccccatctccgcctccgcctccgccgccgcgccgccgccggcgacgactccgacgagcgacccctccgcgggcaccgggtcgccatgtaccgcgccgcctccggcctcggggccatcaagcggcatggactggatggtcaaatgttgaatgttgcgattaggtgtgctagcacaagtgttgcacagaggtcatcaggtggcttctggacctggctgacaggtgcacggtcaaatgcattacctcctccagattttacacttccaggggtcaccattccacctccgctacctgaccttgtggagcctggcaagacaaaaatcacaacacttgcaaatggtgtaaaaattgcttctgagacaactccaggaccatcttgttcagttggagtatatgttaattgtggttctgtacatgaagcacctgaaacactaggtgccactcagctgttgaagaagatggcctatacaaccactacaaacaggagccatttgcgtgttgtgcgtgaaatcgaggcagtaggtggcaatgtgaaagcatctgctaaccgtgagatgatgagctacagttatgcagccctgaaaacttacatgcctgaaatggttgaggtgcttattgattgtgtacgcaatcctgcttttcttgattgggaagtcaaggaacagataatgaaactgaaggcagagcttgcagaagcttcaagtaaccctgaaacttttcttttggaggctcttcattctactggttattctggtgctttggcaacccctctgattgcctcagaatcctcagttagccgattgaatacgaatgtcctagaatacttcttagctgagaattacactgctccccgaattgttctagctgcaacaggtgttgatcatgatgaattggtatctattgctgaaccacttctgtctgacatgcctggtgtaactggaccagcaaagccaaagtctacctatgttggtggggaatatagaagaactgctgattcatcgaacacagatgttgctttggcatttgaggtccctggtgggtggctcaaagaaaaagaatttgtaacagtatcagttcttcagacccttcttggtggcggtggcacatattcctggggaaggcatggaaaaggcttgcattcaagtctaaatcatctcgcaaatgaattcgaccagattagatcgatagctgctttcaaggatgttcacagtaacactggcatttttggaattcatacatctactgatgcagcattcgttcctaaggctattgacttggcaaccagagagctcacttctcttgccactcctggaaaagttgaccaaactcaacttgaccgtgctaaagcgacagctaaatcagcaatcttgatgaacctggaatcaaaggcatcagcaactgaagacatgggacggcaaatattggcctttggtgaaaggaaacctgttgagcaccttctcaaggctgttgatggtgttactctgaaagacattacagcccttgctgagaaaatcatatcatcaccattgacaatggcatctcatggaaacgttctgaacgtgccaacttatgattcagtcagtggcaagtttcgctcgaaatgagtagtaatgtggtcattgttttcctcctcctggacaagttttaactgttgatagtttttcctcaggccattcattggcagggtttcagagagaaaaataaggagcttcatacaattttgatcatttaactctggatgattgagaataccatattttacctttttctgcaacatttgtccacttgagttggaattttttatgctgttttcatcagttttatgggcctgtaaattttagggccctctttcggtggcggccagggcctgtacaaaataccggtctccttgcaaaatctttgacacgaatgctgaaacacttgaataaatattctatctatactcttgcatgacagtgaaattctgc

SEQ ID NO: 168 - DNA, 1932 bp, Oryza sativa
ggtggtagtagtagaagaagcgtagagcggtcaaggctgcgtcgtcgtcgtcgtcgtcgtcaccggcagcggaggaggaggaggaggagagaaggttcagaggaggaggaggtagcgaggcacgaagtagcagcatctcatctcatctctccctggctggctggggggaaattcgatggagagggacttcctgggcgcgatcgggaaggacgaggagcagcggaggcatgcggaggagaggaaggaatcagattactttggagcaggaggaggagcggcagcggcggcgatggattggtcgttcgcgagcagggccgcgttgatgtcgttcaggtcgtcgtcgtcggcggcggcggcggcggcgagggaggagacgagggagctcgcgttcccacacttctcggcgttagacggcgccaagatgcagcaggcctcgcacgtcctcgcaagacagaaatcgtttggtgccgagagccacggcatcccgcagtacgccgccgccgccgccgtgcacggcgctcaccgtggccagccaccgcatgttctgaatggggctagagtgattccggcctcgtcgccgttcaacccgaacaatccgatgttcagggttcagagctcgcccaacctcccgaatgccgtcggcgccggtggtggcgcgttcaagcagccgcctttcgccatgggcaatgcggttgccggatctacggtcggtgtgtacggaacaagggacatgccgaaggcgaaggcggcgcaattgaccatcttttatgctggttctgtaaatgtattcaacaacgtctcgccggagaaggctcaggaactcatgttcttagctagcagaggatctcttccaagtgcgccgactaccgttgctcgtatgccagaggcacatgtctttcccccagcaaaagtcactgtacctgaggtttcgcctacaaaaccgatgatgcttcagaaaccgcagcttgtttcgtctcccgtgccagccatttccaaacctatctccgttgtgtcacaagctacaagtcttccacggagtgcctcaagctctaatgtcgactccaacgtgacaaaatcttctggtccattggttgttcctcccacaagtttgcctcctccggcccagcctgagacactagccactaccactgctgcagctattatgccgagagctgtccctcaagcgcggaaggcatcccttgcccgattcttggagaagcgaaaggaaagagtgacgaccgtggcgccatacccattggccaagagcccgctagagagcagcgacacaatggggagtgccaatgacaacaagtcatcttgcacggacattgccctctcaagcaaccgcgacgaatcattgtcattaggccagccaaggaccatcagcttctgcgaggagtcccccagtacaaagctacaaatctgatctgggtgattgcccagtgtccatagattcggccattctgattgatgcaaaagacataaagaatcttgtgcattcaagcggggaggagggcttgggaagaggcataatatatagtatgttattgatggtgttcttgttcttgtttatgatgtgttttcacatggttaattcgcttaatgctggtctagctggtgcaaaccccccaactaacaagagagctgccacttgcagactcttgagtattttttgttggccttgcgccattgtattgcagaaagaaatatgccaaaatttagcagtaccaaaattataggcttacaaaaactgtactattcttgtttcttgtatgaacttacaagctgcagaatgcaagaacagatgctgcatactactactttgttcatgttcttttttttttacatcactgagcatgtttgtgcttgcaagatgatcatcttttttctatggtaaacatatcacatggaatcctcatttgtcttcatttc

SEQ ID NO: 169 - DNA, 1793 bp, Oryza sativa
accactcatcccacatcgatcgacgccaaactagctagctactagcaaattgaagccaagatgaagaagaccatggtgctctaccctggcctctctgtcagccacttcctcccgatgatgaagctcgccgacgagctcgtggagcacggatacgccgtcaccgtcgcactcatcgacgacccgctccaaaagcaaatcgccttcacggccaccgtcgaccgcgtcatctcgtccaagccctccatatgcttccacaggctaccacgcgtcgaccaccttcccgccgtcaccaccaacgacggcgaattctacctccccgggtatctggacctcgtgaggcgacacaacgagcccctccatggtttcctctcttcccatttccgcggaggcatacaggccctcgtcgtggatatgatgtccgtcgaagcgctcgacatagctgagaggctcaaggtccctggctacctcttccacccatcgaatgcaagcctttttgccttcttcctccagattccgtccatctgtgcagagagtaaacggagcttcagtgagctaggagacacccctctcgagatccctggcctccctcccatgccggcctcccacttcatcgacaatcggcccgaggagccgcctgagagtgaagtgtacaaggccgtgatggatttggttcgcaggtacactaataaatgctccaatggcttcctcgtgaacactgtcgactcgctggaggcacgggtggtgaacacgctcaggcacgcacgccgtcaaggcggccgggcgttgccgccgttctactgcgtcgggccgttggtcaacaaggccggcgaaaggggagagcgacccgagaggcacgagtgcctcgcatggctcgaccggcaaccggaccgcaccgtcgtgttcctctgctttggtagcaccggcattggcaaccactccacggagcagctcagggagatcgccgtcggcctggagaaatccggccaccgtttcctgtgggtggtgcgcgcccccgtcgtcagcgacgatcccgacaggccggacctcgacgcgctcctcccggcggggttcttggagcgaaccagtggccaaggcgccgtcgtcaagcaatgggcgccgcaggtggacgtgctccatcaccgggccaccggcgcgttcgtgacacactgtggatggaactcggtgttggaggggatcaccgcgggcgtgccaatgctgtgctggccgctccactcggagcagaagatgaacaaggttctcatggtggaggagatgggcatcgccgtggagatggtcgggtggcagcagggccttgtcacggccgaggaggtggaggccaaggtgaggctggtcatggagtccgaggcaggcgtcgagctcagggcgcgcgtcacggcgcacaaggaagccgcggccgtggcttggaccgacgttggctcgtcgcgcgctgcgttcacagagtttttatctaacgcagacagccgacagacatcgtgagttcgtggccgtatcgtgaactccggacatgggtggaggcataagtctaacgggtgaccgttcgagcgcagcccggacacgctagcgcattcggcccagtccacatgcattaggccaatcatgatatgctattccaagaaaaactcaacggcgtcatctattaaaaaacggagggagtataaattttgttgtatatgtaaaatttatatatacttggtacttgctgaatacccataatttaccaaaaataaaaatatattataatattgtctaaaagaaatacagataagattcct

SEQ ID NO: 170 - DNA, 1451 bp, Oryza sativa
accaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggttgaggaggaactggagcgtgccagggtaacaatctcagatagtgacgtggctgcatttctcccaagcaagcggaatgggaagttcctcaagacctttgttggccctgtaaatgtgcgggtggcgagaaaagaagataagctcagagtgaaggacgagtacaacaactacagggatagggctgcctatatgtttctattgttcccatccattctcctcctacttagatggtggatatgggatggatgccttccagccttggcagttcagatgtaccaggcttggctactattcctttacacaagttttgctctgcgggagaatgtgttgattgtaaatggaagtgatattcgtccttggtggatataccaccactatttagcaatgctaatggctctcgttagccttacatgggagataaaaggacagcctgattgttccagcaagcagaggggggtacaacttttcctgcggtgggcaatcatgcaaggaattgcaatgcatctacagaataggtaccagcgtcaaagattgcgcacccggatagctctaggaaaggctaaaagaatggatgttgttgctggagaaacagctggtgtggaagggcagctcttgctactttacccggtccttttcacattacaggttttcgaaggatatgttggagtattacttcttaagacggctttgcacgggcttgcatcggaatggcaggttgtagtttgtgggatcttgctggtggtaatggcagtcggcaactttgtcaacacgatggagactttgatgttaaaattgaggttcaaagcaaaaatgaaaagagcaaagagcaggcaggatctcagtcgccaacaccaaaattgacaaagtgacccataatggtgactccatgcttggaaacagcgaatgctgacacaccatctctcttgtaaatcccttaatccataaactgttttggctgcccatgattttgtgttttggtaattgtttcacattgaagttcatattctacggtcaatgcacgattaaaaacactgttaactttaccacagatgggaacgctaaatttatgtgatttgtatgtgctaacagcgcttgcctaaaattgcagagaacaataatgtattatgtcagtagtcagtagattccgtggctctaattgcagagagctagtaacatgctgaaaatgaacagtccacagctcagacc

SEQ ID NO: 171 - DNA, 3931 bp, Oryza sativa
aaaccacaggccacacacgcctgaactgacggggtgtcatcaaacggactacggagttgacactgtagactcctctcccccgcgtcgccccgatcatggcgtcgtcggcggagccgccgccgaagaagcggaggctcgtcgaggtccatgtcccgtccccggccccgagcccctcctcctcctccgctcccgcgccggcctcgccacggtccccggtcccgccccctccgggcgtgccgccgccgccgccgcctcccccacaaaccctagccgccgccgcctccccgcggccggaggaggccgtacgcaagcgccgcaacagggaggagctgcggggcctcttcgagtgctaccgccgcatccgcctctgcgtggagcgcaaggacgcgcgcctcctgcccgagctcgagcaggtgtacctctcgctcatcgccagctctcgaggttgtacaagcgttcaacgtattttagctgacttgattcctcaatatgcctcatactgccctactgcacttgaggcagctaccaaagtttccatcaacatgtataaatggaacctggccattgtaacaagaggggaagatgtggatggtgtggcataccagactgctagggcttgtattcttggcttaactgacatatgctccacagcatcctgtgaagcacccaaatcatctgttttaacaggaatctgctctgcagtttatattactgtcctcacattcttcatttcaacatttgatgggaaggatatctatcacataggctcaagaaaacttctaaatcttcaggaccctgtggagctgttagacattctaaagcaggattcagggggtgacaaccaacaggcagacgactgtttagttgaactgagagcactttcattgctatgcatatttcttttatttccagagaacatactagatgcctgttttgcgctgattgcttctgcagaagatgtaaacggagaaggattgtactttctaaagcagctaacctgccatctgaacagtggtatcataactgatgctctcgatgttcagggggatggaatctcccagtgtacaggaatggacgtagatcatcctagcaccaaagaatctgttgattccaatctatcttctcatagtgttggtgtttcaggaagttctatgttgcagccaaatgagtgttacatgacaatggccatctctaggcatccatctttgaaaggctggatattattgaggtacaaaaagctgtgtgattcctgtagaactgatgtggtttcagaggtatcatcgtgtttaaatgttttgggctctttaacacaacttgaagacaataaaagtcacatgggcagtgaatcatcagtgctggacaagattgatgaaaattcaggggggtatttgcaacccaataaattggcatgttcatatgaacagagaatgcttttgaaaactgatatcgctgatagatatggagggaaaactgtgcagaataagaatgcacagatggtgcatactgatgaggtgaaaactgagaagttagcagatgtcaaactcgatgtctgcaagcaaggaaatgtaatttctgatgcagggcatcaagctgcaagacttgatatgcacacaccaaaatcaacacatgattctgctgggggagctgcaactctcacttctccggggcagaattttggaaaggcgaagcattcatattcagaaccatctgatctttatggtgctcatttctcgagggatgtgatttcagtttcaaaggaactttggattggttcactgggaaatagtgctgcagagtcactagttagatcgaaatttgaggagtttggccccttagcaaacttcttattttatcccccaaagaattttgccttggttgagtacgggaacataatgcatgctgttcatgcatatggatgtatgcagggttcctctgtttggggtggtggtctccaaataaggtatttagatagacttataggcagcaagggatttgctagtggtatagctgttggtgaaagtcgtcatatttatgttgctaaagttaagaacaaaaaagataaagatgaggtgtttgatgaattaaaggccgcagggttgaagaggccatgtagctttacagatatttccagtgaaaatgctttgcttcttgaatttgagacagcaactgatgcagctgctgcgaaagcccatattaggcgccagcttcatccagatgtctgttcccaggacaagaatacttctggtcatgaactttttgtgcggaacatagacaattcagtccctgacatggagtttatcaatgcattttcacgatttggtgaggtcataaggtggcagttcaataagcttgatgggaactgcttgatagattatagatcacctaatgctgctgccactgcaaaatctcacctgcatggtgcaagatttgggctgaagtcaattagtgttgaatcgagatctgtgcatgataaaactttgtcgccttctgttccaatgctagccccgagtgtttctgacagcagtcaccatgagatcaggaatccaagggtttcagggtataatgcaggcttcacagtaccaacagagcgaccaatttatggtccatcggctcccagagctccacaaggcatccttccatgcccacctgtttctgcacaccgtggtcctgtaataccaccgccacctattcaaacttcttttgtccgtcctgtatatcctggtccaggaagtccgtgggaaaatactaccccaaatccatccttcagtcacgcttctcctcgaatgatgcctggaagtagcttccgtatgaatccacctgctcctcttccttttataccatcttctgttacccctcttacacagtttcctggaggttcagcacagcagtctgagaaaaggccacctccacctccacctccaccaaatgtagcccccccaccatttactcgtcaagatataccacccccaccaccatctccaccaccactacctattactcagccaccttctgtgccaccacccccaaattcccctcctccgcttcaacctgctactgacccttctgactcacaaaagcaacgttctcatcctcgatggcagggctctctttcaaaaagtggtttacattactgttcaatctatgcaagtagaatagagttggatgcttgtagatatgaacatgcagtttctgaaccgacagggtggccttcaagattagatgtgacaaagcgaacggattaccaacatgtgaagacaactttctccaatactccacctagcaaaagagaggtctgtcggctattaccctgttcgaatggtgatcagaaagggttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtcgcgtagacacattccgtaacctcgttgcttccagtttcgtgcacagtaaacaattttgcatgaatgatactaagttcctacagctgcttatgaataatatgcttccagtttcgtgcacagttaacaaattttcatgttttcttttgacgagacaccaatactgtacttattccttttgctgcataactgatatatagttgctacaatatcacagaattgaccggtgatccggaatttttacacgcaaagatcactacagggacatgatctgacgaaccgctccgtgttctcttcgctgcttacttcaccacatcggaatctaggtcgaggacgaaggattggtgacttgcccggcgaagaccaccacgccggtgaggtcctcctt

SEQ ID NO: 172 - DNA, 2554 bp, Oryza sativa
aattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacgttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatcaacttgtcggggcttggattaagcggcacgctaggttatcagctatcgagcttgaaatcagtaaccaaattcgatgtcagcaagaacaatttaaatggtgaaatcccataccagcttccaccaaatgtggttcagttaaatcttcgaggaaatgccttcagcggtggtgttccttattcgatatctcagatgactgatctggaaacgctaaatcttggtaagaatcaattgagcgggcagttgacagatatgttttctcagctgccaaagcttacaacaatggatttgtcattcaatagcttctcaggtaacctgcctccgagttttcaatacctcaagaacctcaaaacactagatgtggagagcaaccaattcagtggtcatataaatgtgctggccaaactttctcttgaggatctgaatgtgaagaacaacaagttcactgggtggatcccaagtaaactgaagagcattgacaatttagagactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtacctacatgaggtctgttcacctccagtgctccacaaaaacataaagtcttcaaatgtcttgcttgatgctgatctcaaccctcacctctcggattgcggcctttcattcttctatgaggacgcaagtgagaacttgggacctgggtacagtgctccagagtgctcaagaccatcagcttacgtgatgaagagcgatgtctacagcttcggagtcatcatgctggagctactaaccggccgaaagccttatgatagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactactta

SEQ ID NO: 173 - DNA, 944 bp, Oryza sativa
gggggcccgatgactagtatcatccgacctcaactcctctgtcctctactacgcatctctctctctcaggggaaaaaaaaatctcctctcggccgagatcgtctccaccgccggcgagccttcgaaaccggagctaaccagcgccaccgccgtcgctcgtcatgatacattttgtgctcctcatcagcagacaagggaaggtgaggctgaccaaatggtacaatccatatcctcagaaggaaagatccaaggttatcaaagaagtaagtacgctcgtcctgacaagaggtccaaagatgtgcaattttgtcgattggcacggatacagagttgtatacaaaaggtatgcaagcctttacttctgcatgtgcattgatgctgctgataatgaactggagactcttcaaatcatccatcattttgttgagatattggaccgatattttggcaatgtctgcgagcttgacctgatattcaacttccacaaggcatactttatattggatgaggttctgattgccggtgagcttcaagaatcgaacaagaaagcagtactacgcctgatcactacacaggacaacttggtggaagcagcaaaggaagaggcaagctcattgaggaacataattgcacaggccaccaagtagagcagcgcatcgtgcctgctacaatgatgattactcattctcaccccagggcatgatattaactataatcaacaggaacttttttttacattaaacttgccataaaaatattttttgaatgctctgtgttttcatttcggcagaaatttgtaccctcctttttcttttatgtgttgttttcttctaattttttctacccttctttttctttggagtatatacttaattttgttctcctcatcatagtgagaaggaataacttatatattattgaaataatttggctaaggaattctt

SEQ ID NO: 174 - DNA, 1622 bp, Oryza sativa
gaaattaccgttcgccgcctcgctgctccccgaatcctcctcctccctcctccgccgaaacggcgccgctcgcctgaagcgaacgcgcggcgcgcgcgcgcgcgtggcggcgtgcggagcgcacaactcgtgcttggcgggcggcgagaaaccctaggggcgataggaaggatggtactggctgtggcggcggcggcggcggcggcgccatgatgaggggcttagggccggctgcggcggcggcgctcggaggccgctcggcggcgaggtggtgcacgtaccggcgcgtcacagtcgccgtatgcctggggaacctcgtcgccgtgctgctcgtggtccgctcgctctactccgcccccggctacttcgcctccgcgcccagacgcgtggcggtgaagtattcggaggagcagattaggctggtcgaggagtccatccggattcgccgcgcagccgtgtccgtcgagctcgtggaagctgtgaaaaagctggagaaggtgttcgctagggaggagaagagacggaaggagttgccgctcgagctgaagcagaaggtttcctatgagattttagagaggatgcgtgatttgggggagaacagcaacacgaccgaacaacgagaagctttagagtcctggcgtttagagaagctgaaagacatcagaagtgcatctgctcagaatttgtcgatgtcagacctctctaatgaggaatcaaggatgttaaaacgagcattggagttaaattggcgaatgctaatggacgacattggcctttggatacctgttagtgtatggcatactgaacatgatgacaagcctgagaatgaaccagaagaagaagagataatagcaggtccacctttacccccagaatgcaatgctcaagtacataccgattacggtggtgctgctgttcgatggggcttaacacatcataaagaaagtgcagctgattgctgtcaagcttgtcttgatcaggctaaaagggccagaccaggggcattaaagtgcaatatatgggtttactgtccatcagagtatggatgctactcgccagataaatatgaacacaaacatcaagagtgctggttgaaacaggctgatcaccctaaattgaacttcaaagacaggtattctgagtcgtacagggatgctcatccatctgctcccgttgttgtgccatggatgtcaggtgtcatcactgtatgagctgcctacaggctatctagtatctactgcctgcaggagacaggaactccgttcggatgtgcaacgccacatcaaatttggtacagttccacgaactcatataccaattttcaaaattcttcttggcttttgtagtctttagattagtctagacggttagctagagttcatgtgagatagctggtgtattttttggatggacggttggtggcgaactctttttcgaagaagaaaaagtagaaaaagtagaaaaagagtacaaatgattcaagttgaaatcattgtgtttgcctgcccggtacttatgttacagctgtgttgatgcgctgggtgatggtggtgacaaattttggcactccactactccaatagtccaatttgatttgaatagtgttttaaagggtgtgcatc

SEQ ID NO: 175 - DNA, 1314 bp, Oryza sativa
tcgtaagcagaagaagcgcgctgtccactgtccacacccgcacacgccgcttcccaccacggcggcgctaaaccctttcgaaagaatccccaaatctcccacgctccaaagcccgaaaccctagctcctgttcacatggcgccagggctccagcgcttcaccgacatcgccggggacggcgggccccgcctcgacgccgcctccggcgaggagctcctccgcatggaccgcgccgcctccgtcgccctcggccgccgcgcgccggagcccccgggtaccctgttcgtcaccaccaggagggtgatttggcttagcgagacggagaagggccaaggctatgcggtggacttcctcgccatcacgctccatgctgtgtcgcgcgacctggaggcgtacccctccccttgcatctacacgcagattgacgcagaagatggctctgatgaggaggctggtggatcagatttcgaagcaaatggtgatctgcagctagcaaaagtctctgagatgcgcattatactttcagaccctggtcaacttgatgcacttttcgatgtcttctgccattgtgctgaactgaaccctgatcctaatgctgtgcgcaatgaagagaatggctggtccggtggtgaaaatatggctgagggtgggtggattcatggtgatgaagacatgattgatggaaatgatcttgaagcccacatgttctttacgaacttgataggccaaaatggtctacatgaccttggtcgttctgtacgtgagcttcaaattgatgaccagcgtttcgaggatgctgaggaagaagacgagatccaagaaaatggacattagaagcagaatgttcattttacttgttccgttccttgaggggactatgtcattggttcgtctgtagattaccactgatgctgcttggttcgcaatacttgcttcttctacttcctttccctctttcttgttctataggatcaacatctctagggagcatcgatggtaacttttgtgagaaaaaggtcttgctgctggtcaagaatgtaacttgtagagcatgatggtgaatcgagtgaaattagttcgatacttttgatctgacagataggaggggaaatcgggaaaagaaatatgttctcttttcccttgtatatcatggcactgttgtgttatcatttaggatttaaagatttaaatgccaaactggatggaattgggacatatttctacctttccctatctttacaatctgaaaacaccgaacgacacccatgtcaattgtcatgtgaagtcgttgcttattagttgtcccgaattatt

SEQ ID NO: 176 - DNA, 1656 bp, Oryza sativa
accggcccaaccgctcccaaattccctctgcacagcacttccatatgcggaaaaagggaagaccccctcgcgcagaaacgaaagcggaggcgtccccggattccagaagcttctagtagcacagtagtagcagccgccgccctcgacgcgcgtctgctcggggtgctcgcgggaggggagatcgaggcgagggagctcgggggatcgatcgacgggagaccgttggagcagcagagcgcaatgccgcgtgggaggcggtagggatggcggcggcggcggcggcggaggcgggagtatggcgaggggcgtagcgcgcgcggcgtcgttcggtggccgcgccgcgaccgcgaggtggtgctcgtaccggcgcatcacggtagccgtctgcctcgggaacctcgtcgccgcgctcctcgtgctccgctccctcacctccctcgcccccacaccgcccaaacgtgaggaagtggtggagtatacggaggagcagattaggaaggcggaggagtcgatccggattcgccgcgaggcggagcccgtcgagcttgtcgaggcggtgaagaatctgcggaagattttcaggcgggaggagaagaggcggaaggagttgccactggagttgaagcagaaggtctcgtatgagattgtgcagctcctgctcgatttgggggataacagcagtttcgctcagcaacgagaagcagtggaatcatggcgtttcgagaagttaaaagatataaaaagtgcatctattcagaactcaacaaagttagacctctccaacgaggaagcaagaaccttaaagcgagcactacagttcaactggcatgtgctgctggaagacattggtctttggataccatcagaagtctcacacactgaacatgatgacaaacctgagaatgaaccagaagaagaagagataatagctggtccacctttgccctcacaatgcaatgctgagctacatactgattacgatggtgctgctgttagatggggcttaacacaccccaaagaatctgctgccgattgctgtcaagcatgtctagaccaggctaagaatgccaggccaggtgaactaaggtgtaatatatgggtttattgcccatcagagtttggatgtttctctccagataaatatgagcataaacatcaggagtgctggttgaaacaggctgaccaccctaaactcaacttcaaagacaagtattccgagtcatacagagattctcatcccactgcccctgtcgttgtgccctggatgtcaggtgtcatcagcgcatgagctgttagtccccagaggctcatctgagattgggagatttgtaccgatgaaaaacttaaccaaagcaacttcatataccgattcttcctcgttttttttttcttttgccatgatacgtttctctttctcttgtcttgggtatatacgaatatgatgtaaaccttagattagtcgttctgatagcaaaaggttcatttgagggaggcttattttgtggccaagggaatgtgagtagactgattaaatacaatggttccatcaagagaaatgatggtgctcttgcacattttccgctccaattcttttgtctctgatcacgaactttcctaaagcaccattcggattactaatccaaaacggacttaatc

SEQ ID NO: 177 - DNA, 2571 bp, Oryza sativa
atctgaattaggtgtagtagtagtagaagaagaagaagagagattaattaagtggcaggctgccagcgatggtgatgttgtttccatcgccggcgacggcggcgctgctggtgctggtggtgctgctgctgcagctgcagctttggtcggcggaagcgcaggtggcggtgggctcagggccgccggcgggctgcccggacaggtgcggcaacgtgagcgtgccgttcccgtttggcatccgcaccggctgctccctcgagggattcggcctcacctgcaacaccacgagcaatcccccgcggctgatgatcggcaacagcaccctgcaagtcgtcagcatctcgctggccaactccacgctgcgcgccgtcgacatcgccggcgccgtgaacatcacgtacgacgtcgtcagcggaaccaccggcaacggcacgtggggcggcgtcgccgcgacctcaaccaacccgtacgtcgtctccggggaactcaaccagctcctcgtcacggcgtgcaacattcaggtaacccttgtcggcagcggcggcaacgtcatcaccggctgctcttccttctgctccatcaacgacaagtacacgggtggcgtgttcagaagccccggcaacaagtgcgcgggcatcagttgctgccagacgcccatctccatcggccgcccgtcctacagcgtgaaagtgacgatcatggataacgagtacagaggtgaggtgcccgaagcgatccgcatcgccgagctaggatggttcgacggcctcgccgccaacctgctcaagaagcctgcagcgaatgacacctcgctccggacgccggtcccggtggtgctggagtgggcggtggcatccaccggcctggatgtcacgctcgacgccgggctgaacaaccaggctgccaataactggtcctgccccacgcccggcgaggcaagaaggagcgcgtgcataagcaacaacagctactgccacaacgtcaccgacaactaccgaagcggttacgtctgccgttgtgacgacgggtacgacgggaacccgtacgtcgccggcggatgccaggacatcaacgaatgcgagcggccaaaggagcacggctgcttcggcgagtgcaccaacacgccgggagccttcttgtgcagatgcccgcacggtgcccgtggtaactacagcattccaaatggctgcaccaaatccaatctaggtttaactattggagttggaattggtagtggtgccggcctttttatcctggcacttggtgctgtctttttaacacgtaagattaaacaacggagagcaagaacactaagacagaagttcttcaaacagaaccgtggccatttgttgcaacaattggtatctcaaaaggccgacattgctgaaaggatgatcatccccttggcagaactagaaaaggccacaaataactttgacaattcgcgtgagcttggaggaggaggacatggcaccgtatacaaaggtattctctcagaccttcatgtcgtcgcaatcaagaaatcaaatgtgacagtccaaagggagattgatgagttcataaacgaggtagccattctatcacaaatcaaccaccgcaatgtggtgaaactttttggatgttgtcttgagaccgaagtgccattgttggtttatgaattcatatcaaatggtacgctttatcaccatcttcatgttgaaggaccaacatcattgccatgggaagataggctcagaattgctactgaaacagctagatcccttgcttaccttcactctgctgtgtcattccctataatccacagggatatcaagtcccataatatcctattggatggctcactaacgacaaaagtctcagactttggagcttcaaggtgtatcccagctgaacaaaatggggttacaactgctattcaaggaacactaggatacctagatcccatgtactactacacaggacgtctcacggagaagagtgatatttatagctttggagttgttttaatggagttgcttactaggaaaaaaccacactcatatagatcggctgaggatgagagccttgttgcacatttcactaccctacatgcacatggcaacttgggtgacatatttgatgcgcaggttatggaggaggggaaaaaggaagttaatgaagtagccgtattagctgtggcatgtgtcaagttaaaagcagaagagcgaccgactatgagacaggtggaaatgacactcgagagcattcgatcatcatcactgcagcaagaagtattgcatagtgttagcacaaagaaatctaaggagcttcatgtctcatggagccatgcaataagtgagggtacaagcttagattcaactaggcaatatagtctcgaagaagagaacttgttatcatcaaggtatcctcgatagcgattttttaatttttcttgtgtgagtttggatcgatatagaaagcttatgttgtcctcgatgtacaaggtctccctagtttttttttctctccatgtatgatacgcacgtagtatttcatagctaaatgtagtaatatcttattttattgttcttc

SEQ ID NO: 178 - DNA, 1793 bp, Oryza sativa
gagtgctactcgtacgaagaacagagagaactcgagaggtttcattcagtgccgaagctagctattccactccggtgcgtttgcgatgaagaagacggtggttctctaccccggcctcgccgtcggccacttcaaccccatgatggtgctcgccgacgtcttcctggaccacggctacgccgtcgccgtcgcgctcatcaacccgtcggtcaaggacgacgacgccgccttcaccgccgccgtcgcccgcgccgtctcctccaagagctcggccaccgtctccttccacatgctcccgcgcatcccggaccctccctcgctcgccttcgacgacgacaagttcttcaccaactacttcgacctcgtgcgccgctacgacgagcacctccacgacttcctctgctccgtgcagggcctccacgccgtggtcgtcgacgcgtcgtgcggtttcgccattcaagccgtgaggaagctcggggttccggcctacgagctctacccctgcgacgccggcgccctcgccgtgaacatccagatcccttcgcttcttgctgggttcaagaaactgggaggaggagaagaaggcagcgctcccctcgagttgttgggcgtgccacccatgtcggcttctcacgtgacggacttgttcgggcgctcgttgagcgagctgatcagcaaggatcccgaggccaccacggtggccgcgggagcgcgcgtcatggcggagttcgacggaatcctgattaacacgttcgtgtcgttggaggagcgtgcgctgcgagctctcgccgacccacgttgctgccccgacggcgtggtgctcccgccggtttacgccgtggggccactggttgacaaggccgccgccggcgccggtgacgagaccagccggcggcacgagtccctcgtgtggctcgacgggcagcccgaccgcagcatcgtgttcctctgcttcgggagcatcggcgggaaccacgcggagcaacagctgcgggagatcgccgccggcctggacaagtccggccaccgcttcctgtgggtggttcgtcgggcacccagcaccgaacacctcgacgcgctcctaccggaggggttcttggcaagaaccagcggccgcggcctcgtcgtcaacacctgggtgccccagccgagcgtcctccgccaccgcgccaccgccgcgttcgtgacgcactgcgggtggaactcggtgctggaggggatcaccgcgggcgtgccgatgctctgctggccaatgtacgcggagcagaggatcaacaaggtgctcatggtggacgacatgggcgtcggcgtggagatggagggatggctggaagggtgggtgaccgccgaggaggtggaggcgaaggtgaggctggtcgtggagtccgagcatggaaggaagcttagagagcgtgtcgaggcgcacagagatggcgcagccatggcctggaaagatggcggctcgtcgcgtgtcgcgttcgcccgactcatgaccgagttggacaatgcacaacgatgaaaatggtagtagtgcataatttctcaaccgtacgtactgattttttatattgattgtattattcctatattttgaaatatcgataatcgaaatgaaaatgttagatgggttttcatctatcgatgtactgattttatccgaattttttaaataaataaccgtcaatggagacagcccatccaaatgtaataaaacttagatgtaatccttatgtgttagtattagtttttaagcaatgtcatggtcattaagtatctaaattattttcttttta

SEQ ID NO: 179 - DNA, 3164 bp, Sorghum bicolor
gatcgggagaggcggaggccggcgagagcgatggaggaggaggtgacgggaagcggcggggggattgggcggaagatggctgcgggggaggtggagctgaaggagaaatcggggacggcgtggagccactcgtacctcaaccagaagccgtggcacccgctctcgtacccgaaccagcgccgcaagtggatcgccgagcaggtgcacgccaaccgcgcgcgccgccaggaggaggtgcagcgggagttcgcacaggagcaggagttcttccggcagaccgcgctcttctccaagaaggacaaggagaagatggaggtaatgaaagctgtgagttttatgtacgtgcgcccacctggctacaatgcagagagtgcaaaagctgctgaaattgaagatgagaagaagaggtcagatccaagtgacatggctcaaggtactgcatctgcaaccacctcttcaatacctgacaagggacctgaaaagactcaatcaggcacagataagaaaaataggccaaaagatgtttttggtcggccattggcaacagaacaagaatttgaggttctcaagaatgctccaaggttagacaccggtgctcctgcaaggatcaaaccatttggagttgaagttcgtaatgttagatgtctaaggtgtggaaactatggtcatcaaagtggtgaccgggaatgtcccttgaaggatgtgatcatgcctaatgaggagagtcggttgaaaagagatgatccacttacaactataatggcgcagactgattcaagtgagcctttgaagtgggaacttaagcaaaagccaggcatgagccctcctcgtggtggatttgacccagatgatcctaatcagcagattgtggcagaagacatctttgatgaatatggaggttttctgaactgtgacattccagctctcatttccagtttttctgctagcaaatccaagaaacgttctaagaagaaaagcaagcataagcaggctaagtctgctgttcatgaggattctggtagacatgaaagcagttaccatctatcgtcagactctgaaaatgagaagagaaacaaagcatcaagaagcaagagaaagaaaacaaactgttctgattcgtcatattctgattctgagatagatgctagaaaaggcaagagtaagtcaaagcataggcataaaaagaaataccagttagagtcttcttctgattcagaatttgaggtccgtgaagatacaaggcggcatctgaagagagaacacgtgaaggagaaaagagatgtgtcaccattgtccttctctaaggatcaaggagacacagaaagcaagaggcattcaaggcgttcaagggagaagcgccgctacagctattcatcgagttcttctgagagaggcaggcattctctacggcacaaggagaaacaatattacagtgactcgagttctgatctgagccatcgacactcaaggagatcgagggagaagagacatgatagagagtcaaattctcctgatgccatcaggcgctcaaggagatcagtggagaaacagcgccattctgatacaagtccacgtcataccaacaggcattcaaagagattaagtggtaagcaagactatactgaatgcagccattacgaaaccagtagacattcaaggagatctcgggagaaacagcactaccctgattctacaaccacacccaaaagcccaaagcctgaaggaaacgccagaggagaggagagcagcagcggcagcggcagcggcaggccggcagccgagcgagagcgcccaacccaacacccccaagcaaagatgctgtcgtcttccacctccaccctccgcctccaccaaccaacccgtccccaccgccaccacccgccggccccggccgccgggggcgccacccacctagcctccccgcggcggtggcgcggccacgccccgggggcgtcgtccccgccggcgctccgcgcacgggcccagcgcatccgcgcgctggacgccgcccagccgttcgacttcgagtcccgcgcggcggggctgctggaggagcgtcagcgcctgaagatcgccatcgtcgggttcggcaacttcgggcagttcctggcgcgcaccttcgcgcggcaggggcacacgctgctcgcccactcccgcaccgaccactccgcgctggcgtccacgctgggggcctccttcttcaccgacccgcacgacctgtgcgagtgccacccggacgtggtgctcctcgccacctccatcctctccgcggaggccgtgctccgctcgctgcccgtccaccgtctccgccgcaacacgctcttcgtcgacgtgctctccgtcaaggagttccccaggaacctgctgctcagctcgttaccgcccgacttcgacgtcatctgcacccaccccatgttcgggccggagtcggcgcgcgacggctgggacggccttcccttcgtgttcgacaaggtgcgcgtgggcgactgcccggcccgccgcgcccgcgccgaggcgttcctcaacatcttcgagcgggaagggtgccggatggtggagatgtcgtgcgccgagcacgacgcgcacgccgccgagacccagttcctgacgcacaccgtcgggaggatgctcgccatgctggagctccgctccacgcccatcaacaccaaggggtacgagacgctgctccgcctggtcgacaacacctgcagcgacagcttcgacctctacaacgggctcttcatgtacaacaagaactccaccgagctgctcaaccgcgtcgagtgggccatggactccgtcaagaagaagctcttcgacggcctccacgacgtgctccggaagcagctcttcgaggggtcgccgcacgcccccaatgtctcctcctccaacgtccgcaagtaaccaccgtgcttgctgctcatgtcatgatcgacattgtaccagtctgtatctgtattcttcaccccccaattcagatttgactttgttgagaggggttcgttcccgtactctttcttccttgtcagttctgctgtgttccatttccaagtgagggagaaaaagaaaatcttatctgtggtagcttgacactggaatttgtgatatggtcacgaataaaatgaataaataagcaatctttggcattgatgagtttctgtatc

SEQ ID NO: 180 - DNA, 1672 bp, Hordeum vulgare
cctcacctcacctcacctcaggaagcgcaccgtaggttccggaacactccagagccccgccgccgccgcccctccatctccaccacgccacggccgaccaaggcgaggaggagagacccatcaaaccaacgagagcactacaaaaagaaaggggaggagccagagtccatacaacaaccactactgcctccggcggcagcccacggaatcgtcctcgcagcaccagcggctctccggcgacaagcgcgaggaaatggccaaggaaggagctggaggcggccccgactggaacggcctgctcaagtggagcctcgcccacggcgccgacggcaccaacccgccccgcgcgctcagcgaggaggacaggaaatggtttatggaggcgatgcaggccaacacaattgatgtcgtcggcaggatgaaggagatcgcccaggtgatgaaaacccctgatgatgtgttgcagtctcatggcgtcactccagggaacattgaagatatgcttgatgagttacaagagcatgtggaatccattgataatgcaaatgatcttcattctattggtggactagatcctctacttggttacttaaaaaattcacatgctggcatccgagcaaaggcagcagaagttgtgagtacggttgtccagaataacccgaaaagccagcaacttgtcatggaatctaatggacttgagccactgctgacaaacttcaggtctgatcctagcacgaccgcacgcacaaaagctctgggagctatctcttctctgattcgtaataatcagcctgggcttgccgcatttcgtctaggaaatggccatgctgcactgaaagatgcacttggttctgatgatgctagacttcagaggaaagcgctgcatctcacgcagtacctcctgaacaacaaggcggataggagcgtcgctgaagagatcggtcttccgaatcaactgatacacctcgcatccagcgaagattctggagtccgagaggctgccctaggtggcctcctcgagctggcgcgtgacaaggcaccagttgcccgcaacgctctacctgaccaagacaagctgaaggacgtcctgaggagccgaatcgaaggcatcagcacaatggacgccgacgacctccaagcagcccgtgaggagcggcaactggtggactccctctggaaggagtgctatggcgagccgtcgtctctcagggagaagggcctggtggtgctccccggggaggatgagccgcagcagccgccgccagacgtcgcggggaagatgtttgagccgccgctccgtgcgtgggccgcgccgaggccttcttcggcggaggactccgattcggccagcgggaagaaggatccgcccctgctgctaggcccgtgaggccgtgaccgtctccggctctagttcttggtggaacccagcggatattttgggaggccgaagagcgtgcgttgatggtagaagtctagcgattctgcctgtaggaacctttatttgccccaatggttgtactacgctggtcagatgtgcggttgattcgagtgttttttcctgcaaatttcacagatgcttgtgttattatcctttgcctcttgagcgatgatactgctatacacttgttatacagtagacacaatctgcaagggaaagtacactgaagtcatc

SEQ ID NO: 181 - DNA, 1639 bp, Oryza sativa
gtaagccaatttgagagcatttgctacgtttttatgcatactgtttgatcggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccgtgctccgggagttcctccgctcgctgcccgccgtcgacgcactcctgctcgacatgttctgcgtcgacgcgctcgacgtcgcggccgagctcgccatccccgcgtacttcttcttcccatcccaggccagcgcccttgccgtctttctccacctcccgtattactaccccaatctgccgacatttatggagatgggcaaggcggcgctcctccgctttcccgggatgccgccgatccgcaccgtcgacatgccggcgatgttgcgggacaaggatagcgaggcgaccaaggttaggttgtatcaattcaagcggatgacggaagcgaagggcgtgctggtgaacagcttcgactggctgcagcccaaggccctgaaagcgctcgccgccggcgtctgcgttcccgacaagcccacgccgagggtctactgcatcgggccactggtcgacgccggcaggaaatcaaggatcggcggcgagaggcacgcgtgcctcgcgtggctggacgcccagccgcggcggagcgtcgtgttcctctgcttcggcagccagggcgcgttcccggaggcgcagctgttggagatagctcgtgggctggagagctccggccaccgattcctgtggaccgtgaggagcccaccggaggagcagtccacatcaccggagccggacctggagcgactgcttccggcggggttcttggagaggacgaaggacagaggcatggtggtcaagaactgggtgccacaggcggaggtggtgcagcacgaggcggtcggcgcgttcgtgacgcactgcgggtggaactcgacgctggaggcgatcatgtcggcgctgccgatgatatgttggccgctgtacgcggagcaggcgatgaacaaggtgatcatggtggaggagatgaagatcgccgtgtcgcttgacgggtacgaggaaggagggttggtgaaggctgaggaagtggaggcgaaggtgaggctggtgatggagaccgaggaagggaggaagctcagggagaaactggtggagacgagggacatggcgttggatgccatcacggaaggtggatcttctgaaatggcatttgataagttcatgagagatttggaggagagcagcttggagaatggagttcgtagctgattaagcagagtaaggctcacgattgcattagtgtatcaatggcgtcagttaccatgaaatgtttgcgatttttgctacggaattgctattaagttcagaagcacagtagtgcgcatagtgatgttcttttcatcctccaatgacggatgccatt

SEQ ID NO: 182 - DNA, 2258 bp, Zea mays
catgacaattggggcaagctgccctcctttgctccacgcgaccaccaaccttttacaagagcctgtgagctgagcaccgcccgtccctctcctcctataccccctgaggactttaccgggctaccattcctgatccctccctccccctctcctcttcttgtcgccgtctccctgcagcgttacgctggcggaaaagaaacggagcgagcgagatcaactggcggctcaagaaaccagagggaggagtgagtgcacgcaagggtcagagaagagccgagagagcgcgcagcagtgcagtggtgctgtatccgctgcattcttcctccccctttggattccctgactcgcatggtatctggtcagaaaggcacaggctttagtgtgcccgttgctgttgtaacgcccctgtctgctcctgcggaggagaggtgcgcgagacgagagacgcgggaaggagagggacggaggcggggaggagtagtggtgaagtcaatgccgccgccatcgccgctcctccgttcctccgccttcgtcgtcttgctgctcctggtgtgtcgcccgttgttggtcgccaatgggagggccacgccgccttctccgggatggccaccggcggctcagcccgcgctgcagcctgcacccaccgccagcggcggcgtggcctccgtgcttccttcggccgtggcgcctcctcccttaggtgtggttgtggcggagaggcaccaccacctcagcagggagctcgtcgctgccattatcctctcatccgtcgccagcgtcgtgatccccattgccgcgctgtatgccttcttgctgtggcgacgatcacggcgagccctggtggattccaaggacacccagagcatagataccgcaaggattgcttttgcgccgatgttgaacagctttggctcgtacaagactaccaagaagagtgccgcggcgatgatggattacacatctttggaggcagcgacagaaaacttcagtgagagcaatgtccttggatttggtgggtttgggtctgtgtacaaagccaattttgatgggaggtttgctgctgcggtgaagagactggatggtggggcacatgattgcaagaaggaattcgagaatgagctagacttgcttgggaagattcgacatccgaacatcgtgtcccttgtgggcttctgcattcatgaggagaaccgtttcgttgtttatgagctgatggagagtgggtcgttggattcgcaacttcatgggccatcacatggttcagctctgagctggcatattcggatgaagattgctctcgacacagcaaggggattagagtacctgcatgagcactgcaacccaccggttatccatagggatcttaagtcatctaacatacttttagattcagacttcagcgctaagatttcagactttggcctggcagtgactagtgggaatcacagcaaagggaatttaaagctttctgggactatgggctatgtggctcctgagtacttattagatgggaagctgactgagaagagcgatgtatacgcgtttggggtagtacttctagaactcctgctgggaaggaaacctgtcgagaagatggcacaatctcagtgccgatcaatcgttacatgggccatgcctcagctaactgatagatccaagctcccgaacataattgatcccatgatcaagaacacaatggatctgaaacacttgtaccaagttgctgcagtggccgtgctctgcgtgcagccagagccgagttacaggccactgatcaccgacgtgcttcactcactggtacctctagtgcccacggagcttggaggaacgctgaggatcggcccggaatcgccctacctacgctactaagaagcagtctcccatttgagtcgaatgaaactatctctcatggagtttggaattgctggttcagtatggctcgtccaagtgtggtccagataagttatgaggtcgaccacgagggttattgctccttgctttgcattgccttccttccatggtgttttgtcttgagtgccaatccgagacatgtcggagtgaattggcacggtttttggatttgtggaggagggctatgtatttcttttggctatataagaaagtaaaaaaaaaaaaagaagcccccgtatggttctgttaacttgtgtatagattgaagattttccacactaactcatctgtatcaccttttgcacctacgaaaccatgtcgattcatttcaactgctactttctttt

SEQ ID NO: 183 - DNA, 2073 bp, Zea mays
cagaccacgcaccagggacctcaccgagcacaggtagggtttcggccaccagccatggccgactccgcgccgtccatcccgggcgtcatcgcctccctccaggcctactccacggccctctccgcctttaccgccgcatggcgtgccgtcgagacccacgcctccaccctcgactccgccctcgccgcccgcctagccggcttctcggagctcgagctgatctgctcggcgatggacggagccggcctccgcgcgtacctcaccgagcacagggacgagctcaaggatcccacgcgcgccctcgacgcagccctccaagttgcgcccgacccggggcttctggtcctctccgcggcagcgagtttctgccgcacgctgccggaggtggccaagagcgacggtagcgtcaaggcgtcctgccgcctgctcatcgccttgctcgaccggctgcgcgcgattggtgtcaagccgtcgcctgaggcgcgcgaggaggccagagctgttgcgacggactggaagcgaggcaagcggatcgggacggagacgatgtttaagcaggagacgttcgccttcttgcatctcgtgggagtgtttgggctcgtggaggatgtgggcggtaccagcgaggtgcttgatcttgtcgtgtcgatctcaggtcgtgagcgcgccgttgatgcgttcgtcgtcctgggcctggacctcgaccagcatatgccaatcctcattcagaaaatggtaaacaaaaacaaacagctagaggcagtcaaattcattcaagctcttaatatagcgcacaaatacgctttgttgcctattatgagatcgtacattgatcatgccgcagttgctggtaagatgatccgcatcaggggagatgatcttgctactcagaatgcagctgatgcaaaagagcgcacacttattggaacattgcagaagttcattaaggaacagaagctagaagaactgcccatttttgaagaagctaacaagcgaatggcacatttggatcagcaaagtgctgagagaaaaagaactgctgctgcagcggctgcggctgctcgaaaggttagtaagaacattgaggagcagcagaaaaggatacaggagctgatgcagcctgctaagagaccaaggtctgagaatgtggtgaaaggatcttcgggccagaacgtgaactttgctggaacctctactcaacagtttaagccacaacagagcattcataaagctggagtgtcaaatcagtatcaagctgctttaacccagaatgtactgccagcaatcgctcagatttcacagctagttgctgggagccatcgtccagttggcatcccaaatcaggcccttgctgttccgcctcaatatggtagtggtagtgcaaattattatggagtgacgtccaccaggccatacaggcccatcactctacctcctggacctggtgctttgaatggtccaagtgcgcaggcatcttcaagatcaaggctctattctggagatccccttgcggctgtctcccgatcatcagataagaagggatcgtcttacaagtattctttgtccagtatgtcaacttatgatcgtaaatgaggatttgttttatctgccagtggacgaacctagtgaaccttgaaagtttgggtttcagaccagagatttggtccctccgtagatgttaagtcattgtagctaacaatgggccttttttacagtaaaggatgtgggtttgtatctagaagagattctcctacagagtctaataaatattgtaggaattctaacttataaggacaagttaggtgtaatggtgagagttatcttaccgagccaccagatcctaggtttgaagtagcctcttcctattttcattgggtcatgaatttgtagtatctgtatttgcagcggaaagcttaccttgttttatgcctttgtcgtgtgagtcttcggtagtgagtctaccctttagggtttgttcgattatttccattccatatggattggaggggattgatatggattgtgagagattttgacttattagggattgaaactcccctcaatcatcctcaa

SEQ ID NO: 184 - DNA, 1356 bp, Oryza sativa
tccctcgaaaaccctcgcgaatctgagatccccaagaattccttctcgaaaaccctagaggagagcgagagagaagaggaggcggcggcggcggcggcggaagcacatggcgatcatctccgacttccaggaggaagaggctccgccgcggcagcagcagcaaccggcttcggtggcggcggcggcggggagcggcgacgaggtcctcgcggcggagctggagcggaggggcggcgcgatccccttcctccaggcggcaatcgacgtggcgaggcggcggtccgacctgttccgcgacccctccgcggtgagcagggtcacatcgatggcgtcggcggcgagggcggtggtggaggcggaggagaggaaggcgagggaggccaagaggaaggcggaggaggcggagaggaaggcggccgaggccgagaggaaggcgaaggcgcccgcggagccgaagccggagagctcggcggggaaggatagcatggaggtggacaagaaggaggagggcaacgtgaggaaaccaaatgctggcaatggtcttgatttggagaagtactcttggattcagcaattgccagaggttaccatcaccgtacctgttcctcaaggaacgaagtcaaggtttgtcgtctgtgatattaagaagaaccatctgaaggttgggctgaagggccagcctcctatcattgatggtgagcttttcaaaccagtcaaagttgatgactgcttctggagcatagaggatggaaaatcgctgtccattttgctgacaaagcaaaatcaaatggagtggtggaaatccgtagtgaagggtgaccctgaagttgatacacagaaggtggaaccggagaacagcaaactcgctgatttggatccagagactcgacaaactgtggagaagatgatgtttgatcaacgccagaagcagatgggtcttccaacaagtgatgaaatgcagaagcaagacatgctcaagaaattcatggctcagcacccggagatggacttctccaatgcaaaaatagcttagaacttataaatcgagagtgaccagcagtatggagaaggttggagatgctgaatggagaactacatttcatctcgttcttagtgtctgtcgatggatggtttacgggtagtgtctgtcgatggatggtttacgggtttagccgtgaggtgattggcctcacgtcattttgtgaattttgtgttcttcagaaacgtgaatccgtgctgtttcctgaacctttgaatggatagtaaaatcagttgcaccccagtgacctctatttgtgaatcgattgcttgtaaagaatttctctgcatcatcacgtctatttttcttaccagtaa

SEQ ID NO: 185 - DNA, 1280 bp, Zea mays
tttgacttggcctgcctctccgcctcgcttcgtcttcacttcccgcccggcgaaagagcacaagcagccgccaccaatggctgcctgagaccttgcgggcgagagcggcggagaaagcagttccagccttccaaagctgccgccgatgcaagctccgcgtgagggctacgggctggccacgatggacttcgagtacgtccccgcgtcccccggcagcagcaggtgggcgggcgagtcagcggcgcggcggcggcagcgccgactctcttcgccgtcattgaggacctacctcacgccggccttcgacgccgtggccggcggggagggcggcgtgtctgggtactcttcatcgtcgtcctccggcggtctggaactcgggttcgacgcctcgctcctccgctaccgccgctcctgcttggcggcctccgcggacctggatagccgtgtcctcctctactccccgcagtcgttgccaccgccgccgccgcagatgagggcggcgtatatgccagcggatgacgaggtttgggcacctggcgtcagccactacggctccaagcatgaggctggccggcttactggcgcaccaggttttcaggattcagaaaaccgcattgctttcgtctccccgtcacggacaagtagcaatcttcatactacagttctcggcgcctccacacccgtcaagctccctgctgaactccagttgcccgagggcagtgcagagctcccaacgccaaagccagaagctacgccttcagctctcaagttatctgctgatccagaaccagacgtggatgccgatgaaatcactgaagccctgtacggtggcagtggtcatcgcaggctccccattttcagggagatctgtccagaatgagtgtcagcctcagcattctcctcaacgtcgctgatggatgcatttcggctttagatgtatattctgtttatctatctcgtacccatagtcttggtagcagttactctggagggtcatttctagcttcctaaaggagaatctcttctattgatgtcttcattaagcgagaaagctatgatatacatgacttgattaagcaggcaattgacccgttttgcttggcgttggttggaggtgcacgtgcaccttcgaatatatatgaatttagcccctctcttttttttggccctatgtaattgagttgcagtgttttgcatacattcgatgacccgtgtaattaatcatattggtaatggtaaaaacatgcaatcaagtggcatatccaatcaaaatttaacta

SEQ ID NO: 186 - DNA, 1514 bp, Zea mays
ataaatcttctcttctgttctgttctggcaccttcttcccagatcaataggggcgaggcgacaccagcgaggagacgaaatcgtttaaaggcgccagcttgtcttctgttccatttgtggtttcatttcctctgcaaacgatttccattttttctgcacgccgtcagctgatccttttcgccgtagtatccccgagcaaaagagaaaacccttttttttgtgcgctgtgctgtttcgccatctctgttcgtcccaccgaggcaccgactcaatccccattcttggcatctggcttcacaaaacaagaccggttcccgttccctagatctctgcgtagaggcggcggcgaggcacctgaatccggcaaaaaagggttcgcggtttggttgggaggagcgcaggagcccggcgtcaaaacccaatcttggcgcccgggctgccgtgcgccatcgtcttctccctgtggtgtttagggagaggagaaggccggtggagatggtgccgtgggaagggtacgtcagcgacgagacgatgggcaccttctcgcccatcgtgctctactggctgtacgccggcggctaccagctgatccttcaccgccggccgcttgagcggtacaggctccacacgcgggacgaggaggaggagaagaacctcgtcagcctctccaccgtcgtccgtggcgtactcctgcagcagctcgtgcaggccatcgtcgcgatgattttgttcatggtgacttctgatagctcaataactgttgttcagccacctatcgtcgtccagatcttccagtttctagttgcaatgttagtgatggactcatggcagtactttgtgcaccgctacatgcaccaaaacaagttcctgtatcggcacatccactcgcagcaccatcggctgattgtcccttacgctatcggggctctgtacaaccacccactggagggcctgcttctggacaccttaggaggcgccatctccttcttggtctccggcatgacgccgaggaccgccatgttcttcttctgcttcgcagtcctcaagacggtcgacgatcactgcgggctttggctaccgtataacatcttccagcacctgtttcagaacaacaccgcctatcacgacatccaccaccagctgcaaggaaccaaatacaactactcccagccattcttctcgatctgggacagaatgctaggaacccacatgccgtacgacttagtgagcaggaaagaaggtggatttgaagcaaggccgtcgcgagactagcttgaagtcatggaagtgtacaggctccggtgaatgagtcagacagaatatggttttttagctgtcatggttcattttttaaaaattttgtgcagggctgccatttacattgctgtgcagatagtgcatttgaaaatccacacttctgtatgtacccagttatttgtgtaattgattgaacctctggtcgtgatcgacaccttcggagcaatctttggctactactgactgtgctttgtttc

SEQ ID NO: 187 - DNA, 5369 bp, Oryza sativa
gcagtctccactagcctccctaaaacgaaaaaaaaaggaaaaaaaaagaaaaaaaaaaactgcggcgagccggagacgtggctccccgactcctcgcgcgcgcggccggcggcgagaagggcggcggcggcggcggggaaggccatcctcccctcatgagcggcgtggcctcctcgcgcgcgcgtcgggggagcaggcaggtctggaggggcgacgccgccgacgacatccttccgtctcggttcggatcggattgaaggaatgcatgaggaaccactgaagatttattggtggtaatggagaatgatcatggagatctagatgatgtgggatcagggtggcttgaagtgaaaaaaaaacaccgatccagctcaaaattcacattgcagaggtcttcaggaggttccaatgataataaaatttcaaactcgtcctcacaatctcagaccaactttggcagtgatagtgcaaagtggtgtgacaggttacaatgctcacctcagatcacaaaggttaatgtttgcgttaatgaaccgggtagcgtagtcacaatggttgttcatggtgaagaatgtgctcatgcagatgctagcaatctgaagagtgaattaagtgtttcagcctcggatcatgcaatagaaaaacctaaaaaactgctagtgactgaagaaataagtgaacctcccaacgttggtaagattgactgtgctgattctccaactccacatcaatcctccaactgttcaagtggtcttgcaaaatcttcaggtttttatgatcatgttaaaggccctccaatgacagatagtataggtgttttatcgaacacttctgtcaggtttggtgattttgatgaagtgccaggtctagcattacctgcagatgcatgtagaaataatagttcatctcaaaaacacatacacattggcgatgctacagaattcataaatgaatgtaaagatgaaagtgaacttaaaactgagccgaattcttgtaaaacaattgttgagacatctcctgttattattcaaggggcagaaacgcccactgaagatgagagcaaggtattggatatatgtgaaataacagataatcgtttggatgttagtggttcaccttccttggacgacacagtctccttgtcctgtgcaaacaatgatcttgaagttccagttaagtcgtcttctgttgcttcaacagaaagccagacagttcttcatgcaccaacttcagcagattttggaggtgaaactgctggaagcaaagaaaggttcaggcagagactctggtgttttctttttgagaatctgaatagggctgtggatgaactttacctcctctgtgagttagaatgtgacatggagcaaattaatgaatccatccttgttcttgaagaagctatatctgattttcaagaactgaaatccagggcggagcattttgataacaccaaaaaatctactgctctaccaaaggaggggatgccaatggctgtgaaagctgaccatcgaagaccacatgccttgtcttgggaggtcagaaggatgacaagttcaccacacaggcaagagatattgtcttcatctctagaggcatttcagagaattcaattggaactggctcgcaaacaagctggtataacaacagagagctttgcatccagctcttctggagaagtttctggtagctcatcaaagctaaccacagcatcagcgactgttggaagtataagtttgaaagtggagagtcaggtgaaactttctgacactgagaaaaaaattgctggagagaggcaaagcaaggatacaatcaagtcaggtagatcacctccacaaaatatgccttcatcttctgcaaagagtcgaaaaggatcactggaacctatctctgaggtagagaagcataattttaggaaggataaggaattgccagaaaacaaatttgacaagctcaggtcaacagatacggcaaaaaggactacagttcatactgagaaggagaaacaaaatgcagcaccacggaagtcattggatgcctggaaagagaaaagaaactgggaagatatactgaaatctcctgttcggagttctcgtgtctcccattcccctggtgttggcagaaaagtaccagagcgtgctcgtgttctacatgacaagttaatgtctcctgaaaagaagaaaagaagtgctttggacatgaaaaaggaagcagaagaaaaacatgcacgagctttacgaatccggagtcaactagaaagtgagagagttcagaggctgcaacgtacctctgaaaagttaaatcgtgtcaatgaatggcaggctgtgcgcagctcaaaactgcgagaagtaatgaatgcacgccaccaacgtagtgaatctcgtcatgaggcataccttgcccaggttgcaaaaagagctggtgatgagagtactaaggtcaatgaggtccgttttattacatcactaaatgaagaaaacaagaaattcttactgaggcagaaacttcatggttctgaaatgcggagagctgaaaagctactggtgatcaaaacaaagcaaaaggaggacattgcaagggaagaagctgtattggaacggagaaaaattcttgaagctgagaagatgcaacgtcttgctgaaatacagcgtaagaaagaagaagctattattagaagagaagaggagcgcaaagcatctagtgctgcacgagaagcgagggctgcagagcagcaacgtagaaaagagataagagcaaaagctcaacaagaagaggctgaactgttagcccaaaaattagcagagaagcttcgtgaaagtgagcagcgccgtaagtattaccttgagcagatacgtgagagagcttcaatggatttcagggatcagccttcaccttttcagcgccgctttccaagtaaagataaccaaaatcgttctagctcagctaatagtggagaagattcacaaataataagcagtgccaacgctgctgagtctggtgttaaatcattcaattccacgcaaatgaaacgaaggattaaaaagatacgccagaggttaatggctcttaagcatgattttgttgaaccactcataggcgaaaatacaggaattgtgcacaggtctgctctaggtactgcaaaagctaagttaagtagatggcttcaggacttgcaaagacttcgtcaagctagaaaagagggtgctgcgagtattggtttgattgttagtgacatgacaaagtatttagaaggaaaggatcttgaattacatgcatctagacaagttggcttgcttgattttattgcatctgctttacctgcctctcacacttcaaggcctggagcttgtcaagtcactgtctacctactacgactgttgagagtgttgctctcgcttccagccaatcgaacttattttcttgtacaaaatcttttacctccgattattcccatgttatcggtatctctagagaattacataaaggttgcagcatcaaactctggaagttcgaacattcagtcaagcaaaacatcaactgaatacatggagtcagtaggtgaagtgttagatggatttttttggacagtgaccgtaattgttggccacgtatatctcaatgaccaacagcttcaaatgcaaggggggttgatagaactgattgtggcttatcaaataattcatcgcctgcgagatctttttgccctttatgacaggccccaggtggaaggatccccattaccatcatccatactatttggtctcaaccttctggccgtcttaacatctaaacctggaaatttctctaccattgattgggagtcctgcaaatgcagaactctagcgggtaatctagttcaagaatatgaatatctttgttcacaagacataggtatgggcaaccagttgatgatatctgatcaatctggagatgtcaaattgtcatctaccaagtctgatctattgaaatgtgatgaatgcgatcctagcgaattgatcaaagaaaataagtccttggatcatcataaattcaacattccaggggacaacatgtcagtttatgaagctagcaaagactcagggtccatgccagaaatgcagtcatctgatacactagaggtacactctgtaattccctgccagggagatgctgcagatggcacccttgaaagaaaaaaggggagtactacatgtttgcatgatagtcctggaaaagacaatgaaataaacctaaatcaacctgtagtgcttgtactttctgctatggcagagacaggccttgttagtctgccttctcttttgacagctgtgttgctccaggccaacaacagatcatcatcagaacaggcttcagcaattcttccatcgaattttgaagaggtagccactggcgttttgaaagttctgaacaacatggcatgtttggatatcacccttcttcaatgcatgctggctagatcggatctaaagatggagttcttccatttgatcagtttccttcttagccattgcatgaataaatggagagtgccaaatgatcaggttggtttactgcttctagaatctctgctacttcttggttacttctctttgttccatgctgggaaccaagcagttcttcggtggggaaagagtcccaccatacttcacaaggtgtgcgacttgcctttcgttttcttcagtgacccggagttgatgcctatcttggctactgctcttatcgcggtctgttatggttgtgaccagaatagaagtgtagttcagcaagaaataagcacagagatgcttcgttctttgatcaaatcatgcaaaacaccaggactggctgcttcagattccattcttttggatggttggggaaccaacagttccagtgataatacacagatcttattggatacaagaaacccgcaaggtgatatctcaataaggtcgaaccgcaaaagtgcacggccagttttaggaaaaggagtttcaggggtcatcagattgagcagaaataagggccaaagagacggccgaggagcaagaattggtgatgatggacctctgaagcaaagagctggagaaacttcatctaacttcatgttgcatagaaaaatcccagcttctttcttggacaaggctgaagagttcttctgtagtgaaaatgatacagcagcgaatataacaaactgaccagaccacagaacaagctacttaatttggaccttttttatttccttttgagatgatggttcttgagaatatacaactagacaggctaaacttcagctggacggatggtgatgattagggattgactgtataggttttggaaaagacatttgccatttttacaaggcttgctcgaggtaactcggccaaattggt

SEQ ID NO: 188 - DNA, 1478 bp, Oryza sativa
gtcattactaacaaacagataatctccacgcctcggcaactccgctccccactgccatggccggcagcggcggcggcgaccgcggctcgcccgaggcggagctccggcgcgggttcaagacgctcgccgtgacgcggcccgacccgtccgcggcggtctacgaggtccgcctcaaccgccccacccggctcaacgccctcagcccggacgccttcgcggagatcccgcgcgccatggcgctcctcgaccgcgcccccgccgcgcgcgccgtcgtgctctccgccgccggcccgcacttctgcgccggcatcgagctcggctcccccgggagccccgccacggccccctccggcgaccccgcgcccgcggccgccgaggggctccgccgcgccatcctggagatgcaggcggcgctcacggccatcgagcggtgccggaagccggtggtcgcggcggtgcacggcgcctgcgtcggcggcggcgtcgaggtcgtggccgcctgcgacatacggtgctgctccaaggacgccacgttcgtgctcagggaggtggacatggccatcgtcgccgacctcggcgcgctgcagcggcttccgcggatcgtcgggtacgggaacgccgccgacctcgcgctcaccggccgcaagatcaccgccatggaggccaaggagatggggctcgtgaccagggtgttcaattccaagcaagaattggatgctggcgttgcaaagattgcaaaagaaatatctgagaagtcagcatgggcagtgatgggaacaaaggctgttttgctgagaagcagggatataacagtagagcagggcctggagcatgttgcaacatggaacgccgcaatgctgagatctaatgacctggaggaggctatccaagccttcctagagaagcggaagccagtcttctccaaactgtaatgatcatacaccatacttgacagaagaaagttatatttgaatcctagtacttcagaataagggaaaggctataaatctatgattgcagttggcaaatatgtgaagagcttacacttagtacagtggaccagaaatgcttccaatcaatgcatcaaagatctccaacatgttgctgctttgttgatttgttcaactgtggaaatgtgttctataatgacctgaagaatgctataaaaaggacttcctggagagggggaaagcctgtctaatccaaactgtaaagttgaggttgtgtgaatcctggtacctaagaagttgagattgtaaacttgtaagagtagcccacttttgggaaaatatgtgaagatcttacatgtagtaaactgaaatgctccgtttaataagtcaaataattcacgatgccgtggcttggttaatttgttcaattgtttattgtcgtctgctttagccatttcttgggtcatactactatatattaccctttttctgtaactgctccatgctaactgatgcactattggttaa

SEQ ID NO: 189 - DNA, 737 bp, Oryza sativa
agacaagagagaagctccactcttctccaccccaagagaattgaagccaagcatggagaatggaggggaagaagatgacagagcaagccgatgcaagaggattaccagagaatcagatgcaaccaagaatggtgcagcgaccaagctgcaagctttgaggctcgtcgaggacctctccctcccttctgtgcaggtggtggtgatgagcgccaacatgggctgttcgcactgccgacagcgggtcacaaaggttgtctccaagatgaacgggttgctagattacatggtggattttgggaagaaggaggtgacagtgagagggacgatggtgcacaccaagaagaagaggaagcaacacaagaagaagcatgaggaaaacaagaagggaatcgctgcaaactgggagaagaaatcgtcttctcagagcaatgacagcgccaggacgctggcctggtttctacgatgctacagttcatagcaactactactatctagtgcatactatagtctacatatagtgttacttatatactactaatatatatagatatatctagaagctatatagctgctcgattaattgtttatttttctctttagtttcttcttgcaatttctttctttctcatgttttattatttttctttttgattgaaaataacgtatgatggtaggaaatgtgtatattctgcccataactgtgcattataaaatcctctatttgcaaggtaacatac

SEQ ID NO: 190 - DNA, 2234 bp, Oryza sativa
gaagctggcagcccacccacatcgaggtctcccatctcccctctctcgcctcgcgttcacacatccccccttctccttcttccccccctctcccaagccgcgaaatcccctactaaaccctaggattttctcccctcccaatgctggagacggagccgtagcaaggtttcttacctctggaatttgggggattctcaacgcccaagctagattacataacatgaatgcaggattcagcccacagatcttggcgcagaagcttttgaagctcaataattcacgacaaagtatagagactttgtcacattggtgtgtctttcattatcgacactgccgacaagttgttgaaacatgggaatctgattttcactcagctcctcgtgagaggagggtatctttgctgtaccttgcaaatgatatcgtgcagaacagcaaaaaggactctggtagatatgtaaatgagttctggagggttatccctgctgccttaaacgatgtgtttgtcaacggcgatgattttggaaggaatgtcgtacagagactggttgacatatgggaagaacgtaacatatttggatcccatgggcaaagtctcaaggaagactattctagaaggttcaaggagttcaaatccaagtcgagaaattctagtggggagctgctggaaaaggttatctcttgctacaagcatatgttgaatgctcatgtagacgacgatactctcatgcggaaatgtcaaaatgctcttagctttgttgacaatctcagcaacgaatatgagaacaactctattttagactgtagtaatggatctggctttgtggaggagctgcaagaacaacataacatcctgagagactccattgaacaattcaaaacatcagaattactcagaggcaatcttatttcttgcttaaaggaagcactccatgaacaggagttcaaaatggaacgggccagaagccagattaaggaagttcaatcccgatacaagaaagctgatgacctctgccagaagcttggaatacatgtagaaaggcaggaacaaccgaaccatgggcctaagaactcaggttctgaaatgcatggtagctttggcccagattcagctaatgccagttcttttgagaagggacaatcaagtgcggtgatgtattcccaggagaacggcggtgagcatgagatccccaatggcgttttctcttcacgggccaccaaggataacattgagcagaaactagaagagcactctacgaataagagacagaaactacagaatgatgtgtatgtttcacggcctcaatcgccacctccgccactgccatctgatgcatttgaacagccgccgccaccacctgagcatcccccgccaccagagtctacatcgccccctccaccgccaacttctgatccacctccagtccccccgccaccaccgacaacaggttcattcatgccaattccttctgctccgtttgcgggactgccagtacctgccggccctatgacagcagtaccctacaactcttacccagtatttcctcctatgaactatcccatggtcaacatcccacctcccttccctagtgctccaaataccccccctggtttccaaggtttggctggtcccttctatggccctccttaccccgcaccaccaccgccaccgccaccaccgatgaacaggaaatagactagtttcttgcctgcagattagtactgccagccagctttggaggatagccatagactttgcttcactgaagaatatgatcgtgatgattcatcgccatgtgttgtggagcttggaatatactgttcctagtgttgtacattagtcagctggccagatagtagcggatttaacagttaattagcattagttgttcaggtcatggtcatgaagcaaaaaggaaaccatgtgtgactgctagaaagaaattctggagttatgagttatgacagctgaaggcaaatgccatagcatgacatcttttgttactcttctttttcttccttagaaaatgtttgtcacattttgcttgtgttgtttactagattattatgtccatagttgttgcaatgttgagagcaggtaattctgttgttttggtatgagatgcaaattttaatcctctcattttctggcaagcattgcatagtggccacttgccactttcttggtgcctttctatgatatgcttctctaattcatccatgtataatgccttttc

SEQ ID NO: 191 - DNA, 585 bp, Hordeum vulgare
cgcagccacacaacactatctcctcggtacatcagagcctcccagttagcaatatggcaaagtgtctcgccgccgcgctcctgctactggtggtgctcgcgtactgcgacggtagggagctgaaccagaaggaccaggcactagcaacggcacgcggtgccggtgccggtgccggtggtggcgtcggcgaggagaagatcttggggttgccagagttgccgcttgtgggaaccgttaccggtaccagcaccgttaccggtccggtggtggtgcttcctgcccttcctgggatccctgctcacccatgatcatctccagttcatgtgctggcttacatgctgaagctgaacatgtggctctagatctctagcaagcactgtccggacgataaacgccggcaggaacggcgtttcgctcatttcatgttccttaataagcgtctgtatcaactatcctatcgtctgtattttctttcagttcatgtcctagtattttccgttccttatgtgctatgtatcgtcaacctaataaaaaaatattcatcgtgaaaaaaaaaaacgacagcaacggaattcttaacacacg

SEQ ID NO: 192 - DNA, 2474 bp, Oryza sativa
tgtgtctcgcatcagttctatcttgtttttttttatgtgacagggagtatgaactgtaagagaatcaatccttttcgtgtcaaaacctgtaagccagtgcaaaaatcaaacgcagcaagagcaaatcccaaaaacttcaaagatttgacaatgccacttgtgcgaggagccgattcggataaaagtcaggaaggatcggggtgtataacaaacaaaacctaaacgagccaacacgcacgctcatcgcatctttgcgtgcgccgtgcagccgccatggacatagacgacgacgcccgccaccgccgcgtcatcatgtcaagggattgccggagtcgcacgccgtcttccaggacgcaagacaagaacagatcgttgctccttgacaaggttcgtgcctcccacgcggaggcgctggaacggctgcggccggcggcggacctcgacgccggcctctgcttcggcttgctggatcccgtctccaacgccatcgtcaacgccgccgtcttcgccgaagcggaagatgggaacgacaggacggggcgatctctcgacggcgcggtcaccttcctcaccacgttcttccctcacctcccggactgggaggccgtgcgctacctgctcgacgccgacgctgacgtcctcgtcgcggcgcgcctcgtcgtgcgggaccgtggactgaggagattcgggttcgcctcggacaccgccggcgccgccgtaaggttggccctcagatgcgccgcgctggccgtgaagcatccgcatcccgaccggctcgtccacgcgtggctgtccctgtctcgccgcctcgacgaggccgtgtccgcgctcgccaaccacgacgtgcgcggcctcgtcgcgctggtcgtcgacgaggcggaggcgccggcggcggccaacatggagagggcgtgggagctggcagcgtcccgatttctcggccgggacaacggcatcgccgcgccgccttaccggcacgccatgcctctccagaggacgctcctctacgcgatccaggggttctacctccgggcgctcgcccggctgccctccggcgagctgcggtctcactaccaccggagcctggtgaaggccggccattgctacggccccatggaccccgtctccaacatcatcctcaacgtcgtctggtacgacgccgcgcacccgccggtggaagagctcgagctggccatgatcccgcccaagagcatgtccagcatcgccacgcgttccttcctcggcctcgtctccttcctctgcacccgctaccccaacctcggcctccatgacgccatccggtgtttgctcgacttcgacggcgacctcaacgccgccgcaagagaagcagatcggcggcagcaccgtccctcctgcactatccaggagtcctacgccgccgccgccgcggcggcccggcaccccaaaccggacgaacaagtggagttcctcagctctagcagagccatgacgacgccgctgctcctgcagaacggcggccagctctcctcggaagacgttcgccgcctcgccgccgccttactgcctccaactccctccgccgccgtctcgccaatgcagcgcaaaccaacgaaaccacggcggcgaagacagctcaaactgaaggcgcagatcatccgtgatcagaacaagatctgcaggaaggtgaaggctgcattggacagatacgcgttgcagaacaacgaacccggtggttacgagctccatgtcatctgtggcatgaacaattgcgtatcaggacccgtgtattgcactgacgatgacatcgtcagttatactcctctgatatactttcgttgtcatgtcaatttcttggctcgccggagagactccgatccatctgccattgccggcgagggagctcttcaactcttctttgcagaatgcggtaactatcgcctcaaccacgacggcatttgctgcccagtaaccatatcgccaccatgctcagaacaagtgcgttgcctttactgcgaacatgaaggggttgggattatgcatccgtcgatagaaaatttccatgggcgtgaggtggattttgagaagatggtatgtggagaagatacctgcggagacgaatttgatccagaaattgatgaggaaccgttttacaccaacgatggtatcgttaatagcctcaaagtgaatattttgtccgggttagaagaggaattcatttatcgcaatagcgatgaaggcaccgacgaggaagaaggtgactctgatgatgatatcgattttgtgtgagttttcttttttttttacgaactggcaaaagaatttgtcaatttcattgagaagaaaaagaataacatgattgtacattttgattggtggagttgtgtacattgttgttgttcatgtaccagtcttaccagtaggtatgataaagaaagtatatataaatattcaaagatgggagaaaacctcacctaatgaacgagatcattgcc

SEQ ID NO: 193 - DNA, 2477 bp, Oryza sativa
tcctcacacacatcccaaaaaccaaaaaccaaaaaccaaaaaccaaaacctctcctcttccctctccttctctaccctcttcttcgtcctcctccatccgagaggcagcaagccagcaactgcacgagcaaccacccgtagtcagtgacctaggcggcggagggagatcggccggcggcgagcgacgacgatgaagtacgtgctggtgacgggcggggtggtgagcggcctcgggaagggggtgacggcgagcagcatcggcgtcgtgctcaaggactgcggcctccgcgtcacctccatcaagatcgatccttacctcaacaccgatgctggaaccatgtctccattcgagcacggtgaagtgtttgttttggacgatggtggtgaggtggacttggaccttggaaattatgagcgatttctggacatcaagttgactcgtgacaacaatataaccacgggaaagatctatcaggctgttattgacaaggaacgaagaggagactacttgggaaaaactgttcaggttgtaccacacattacggatgaaatacaggagtggattgaacgtgtggcaatgaatccagttgatggcacagatgagccagctgatgtttgtgtaatagaacttggtggcactataggggatattgaatcaatgccttttattgaagcattaggtcaattttcataccgcgtaggggctggaaacttttgcctagttcatgtcagtcttgtaccagttctaaatgtagttggtgaacagaaaaccaaacctacccaacatagtgtccgtggactaagaggacttggactgatacctgatattttagcatgtcgcagtactcagccacttgaagaaaatgtgaaagtgaaactcgcacaattttgccacgttccgatctcaaatattgtcaatcttcacgatgttaccaacatctggcacatccctttgttgcttagggaccagaaggctcatgaatctattctgaaagttttagatcttcaatgtgtgggaaaagtgcctcgagcacctaagctgactgaatggactgaaagagccagcaaattcgacaaactgaaaactcctgttaggattgccatggttggaaagtatactggcctatcagactcctacttgtcagttttgaaggctcttctgcatgcatcggttgctttggacagaaaacttgtggtggattgggttccttcctgtgatcttgaagattctgcagccacagagactcctgatgcatatgaaaaagcttgggatctactaaagggtgcacatggtgtactagttccaggaggctttggagatagaggggtccagggaaaaattcttgctgcaaaatatgcgcgagaaaacaatgttccatatcttggtatttgcctgggcatgcaaattgcagtgatcgaattcgcccgctctgtcatgaagttgcgtggtgctaatagtacagagtttgatccagctacaacgacgccatgtgttattttcatgccggagggctctaaaacccatatgggggcaacaatgcgccttggatcaaggaggaccttcttccaggccaatacatgcaaatcagctaagctgtatggcaatgcaagctatgtagatgaaaggcaccgccaccgatatgaggtgaatcctgaaatggttccagaatttgagaaggcaggtctctcttttgttggcagggatgaaagcgggacacgcatggagataattgagctaccaactcataggttttttgttggcgcacaatttcatcctgaattcaagtcaagacctggaaagccatccccacttttcatgggattaatagcagcttcatcaggacagcttgaccatttacttcagcaatcttgcggcgttgtcagctcgccagtcagacgtggcaactactgcaacggagccacgaaacaacagaagctataccaaaatggacatgtcaagaacggcctggtgaatggctgctactatgcaaacggcaacagcattcttcatacttagcagcatagctctgcatcaggccattgcacttgagagatttacctgctttgttttttctcccttttttttgcgtgttttttctcctattttttttagggttatggattcgtctctctgctaaactaagaagagattgaaagggtccttagctccagcgacatgaagagccatttccgatgttttaaggagggagaaatgagcacttgagctgtcgcatcaacgcaaaaatagctagggtttactagtagtgaactagttaatctaatgcaatattattatttcttttgtttgttcgtttgcttgcttgatgccttatattatattgaagtttaaggctagctggaggtgtgtagctagcttggtggagcctgcacatttcatctgtttgtacattggaaaagaaccactattttcttagtaactgaattgatgaatacacattatttggacatatgtatca

SEQ ID NO: 194 - DNA, 2345 bp, Oryza sativa
aaaaaaaaattcagccgcgagcccgcagcctccggtcgcctcctccgccatctactcggagctcccggatcgaggggagcgctcgccgccgccgcagcgacctcgccggatcacggcggcgggggccgatcgatcggaggtcggtcgattgccttcggcgggtgggagatggatggcggcgtgggaggcgcgcacagctcgcggaggagcgtgtcctcgtcgaccggatccaggaggagggccgggcccacggagaacggccaccacgacgccgccgctgccgccgccggcaggaggtcctccgcttccatctcccgcgcctcgcagcagtcgatgaccggggagaggaccgtgaagaggttaagattgtccaaggcactgacgattccggatcacacaaccgtctacgaggcttgtcggaggatggctgcacgcagggtggacgctgtgttgctgaccgactccaatgctttgctgtgcgggatccttactgacaaggacataaccacaagagtaattgctcgcgaattgaagctagaagagacacctgtttcaaaggtcatgacaagaaatcctctctttgttctgtctgacacactcgcggtcgaggcattgcagaagatggtgcaaggtaagttcagacatttacctgtcgtggagaacggtgaagtcattgcactgctcgacatagccaagtgcctgtatgatgctattgcgcgaatggaaagggcagccgagaaaggaaaagccattgctgctgctgttgagggtgtagagaagcactggggagcttctgtgtctggtcctaatacttttattgagactcttcgagagcggatgtttaggccatcactatctaccattatttctgagaattcaaaagtggtgactgttgcaccaactgacacagtgttgacggcatcaaaaaagatgcttgaagttaaagtaagttcagcggttgtagcaattgaaaacaagcctggggggattctgacctctagagatattttgatgcgtgttatagcccagaatctcccacctgaatctactactgttgagaaggtcatgacccagactcctgaatgtgccacggttgacactccaatccttgatgccctccatacaatgcacgacggaaagtttttacatttgcctgtcttagacaaggatggaaatgttgtaactgtagttgatgtccttcacataacccatgctgcaattgcaactgttggaaacagcgcgggatctggatctgaggcgacatcagctatgatgcagagattttgggattcagcaatgtccattggacctcttgatgatgatgatgactccagaagtgaaggatcaactaaagtggcgtctgaggcaacagatgtaggaagatcagctttttatccggcttctggtttgtccaacacattcgggttcaagattcaagacaaacaaggcaggatgcacagatttaactgcgaaacgagcagcttgacagagttgataaccagcattctacagaggcttggcgatgacatcgatagaaaaaacctaccacaaattttgtatgaagatgaggatcatgataaggtcatactttcatcggacagtgaccttgtagctgctgtggaccatgcaaggcaaatcggttggaagagcttgaagttgcacttggattacgccggtgttggtcgccggaagagaggcggtggtggcacttcagacttcgagtacgctggaaaggatgcgtgggcttcagcctacagcgctgtggctgcaggagcagctcttgttgcaggccttggcgtgatggcttacctgaagagagcaggctaggcttgcagctttgcagttgcagatgcagatgcagatgaggctttcatcttgtgatgatgatgatacgaaatgttacagaatcaaatttgagcagattggtgtgtaaattaattcttgtggggaaaaaaatctgtaataatctcacggcagcggatggctgcctacatataatgacgaaattttccggtggctaaaaaaatgtctggtattcagcttgtatcgccactgtacaatgaagcaaatgctctgtactatgtgttgggacagtgtgaattcttttgccgtttgctcgtttgacaacacaccatgtgtccgtctgcaaattcaaagcccttctggcaaaaacaatggaacgaggcctataataactggtgttggtagtaacaatttgcagcagctattcaagtacagatgtttcatgtaaatgcacagaaatgtatatggttgatctgatcgattcgttggaaaggcgttatgtcgtgtgaccggcgccattgccgccggtggcattcatgatt

SEQ ID NO: 195 - DNA, 2047 bp, Oryza sativa
atctgcgttggcgttacggtactttcggatcccttcttctccgggcggcgatttctttcttcccatcggccttgttggtttgaaatacagagtccaggtgcgagccaagtcccctctcttcgcgactgattgcgtttccttaaatatgcaaggcaggtagagggccgggtgagaaattttgagatttcgacccacagagggcggaaaacccttggattttagattcactcaaggcttcgtcgcgtcatgggtattttcaagttgaatctgctcctaaagctgcagcggcagcggcagcgccgtcgtcgccaaatccaagcccgtaatggatcagttttgattcatccacgggataaaataaacgctccagcctgtcaaaataacacacactcttggagtggccaagcgaagtgttcagacccaacgcttccggaggacatctcgtgtcatatacattccctgatgtctatgcgggatgctgctcgtgttgcctgtgtgtctcgggcgtttgcacgttcctggagatgccttcccaacctcgacttcagtgaggaatcattaggaataaatagaagtacatgcaaaaaagatgagaaactgggagatttgaccagcaaaattgattggattctgaaaaatcactcaggcattggcataaagaaactcatcattcaggttggcagtgtatacagtcgggacagtagtcatcttgctcatctcgatagttggcttcagtgtgctgttaaaccagggattgaagagctgattgttaatctgtcatcaatgaatgcaaaatacaatttcccatgtgaacttttatctagtggaactggagattcacttcgctatatttatcttgcctcttgcaacttccatcccacagtaagaattggttgcttgaaaagcttgacaagactacagctgtgtatggtgaatatcacggaaaacgagctaaggtgccttctttccatttcattgggtttggagcggttggaactcaggcactgcagtacgttaaaatgcttgaaagtaccatgcctgcagcgtctcagctacctagatgttatgacttgcaccgggctgcaagttatagagagcaaagctccaaatctctccagtattcgctttgaaggtgacctctatgtacaattgtcacttggtgaaccactgcaaattaagcaattgtacaggttatgtaatgatgctgccttttatgctcgtactgagctgccatccagcatgccaaatcttgaaaggcttattatacattctgacactgagatggtcaatacaccaatggtgcctagcaaattctatcacctcaagtacttgagtattgcccttggtggacagacctatgattacctttctctggtttccttttttgatgcttctcctttcttggagacttttatcttgaatgcactccgagaacgcacggaacgtgccacaatttttggggatccttcaggtctgaggatgatgccagagcaccgtcatgacaaactcaagtgtgtgaagataatcaatttctcttctgtgaagactttggttgagttaacatgtcacattgttgaatcagcgacagcactcgaatgtcttacgttggacacaacgtcaggttcgcctagatgttctgtgaacagacttggtaaatgcttcttgatgcgcagagagacactcatggaagcccacagagcactcaaggctgttcaaacatacatcgagctcaaagttccctccaaagttgagttaaacgtcttggagccttgcagccggtgccatgctcttgacctttagatgtcaaatatgtgcgtgtggttgttcttaataaccagtattgcaactgtcagttacaagtgttgttttattaaacgtacatttgccccgaaactatcaggctatcagccctgtttactgttgaggtttgtaatgacatggatgtggtaatgtttcattctgttatttctcttgagacttatgattctttatttgctgtgtttgtaggattgattgttgataatatgttaataatgaggaattactg

SEQ ID NO: 196 - DNA, 1577 bp, Oryza sativa
atctggcttctgacatcacactcacctaaatgttgttaggaagtgaggactgagctttcctctccttcactcgtactgtttctgatatcattgattgctatcctcctcctcctccttcctcccctaaatctctagagaaatggaggacaatctaccagtcaatgtccgggagtatcaagaactcgccaaaaaagcgttgccaaagatggcttatgattacatcaatgggggagcagaggatgagcacacactgagggagaatatcgcagcatacacaagaattatattacgacctcgcgttcttgtggatgtgagcaagatagacatgtcaacaactttattaggatacaccatgcgttcacccataattgtggctccaactggggggcacaaattagcacatccagaaggggagaaggctacagcaagagctgcagcatcatgtaacgccataatggttctttccttttcttccagttgcaagattgaggatgttgcctccagttgcaatgccattcgcttttatcagctatatgtgtataagaataggaatgtttcagcaacattagtacggcgggccgagagttgtggattcaaggcacttcttttgacagttgacactcctatgctcggtcggcgtgaagcagatatccgaaacaaaatggttttcccacggagtggtaatctcgaaggtttaatgacaacagatgaccatgataccacaaacggttctcagctcgaacgattcgcacgagcgacgctggatccatcattatcatggaaggatatagagtggctcaagtccataaccagcatgccgatctttctcaagggcatcgtcaccgctgaggacgcgaggagagcagtggaggccggggtggccggcgtgatcgtctccaaccacggcgcgcggcagctggactacgcgccggcgaccatcgccgccctggaagaggtggtcagggcggtggccggcgccgtgccggtgctggtcgacggcggaatccggcgaggcactgacgtgttcaaggccctggcgctcggcgcacgggcggtcatggttgggaggccggtgttcttcgggctggcggcgaggggggaggcaggcgcgaggcacgtgatcgagatgctcaacggcgagctggaggtggccatggcgctctgcggctgccggagcgtcggcgagatcacccgcagccatgtcatgaccgagggtgacaggatcaggtccctgctctgatgaatcatttctcatctggccaatgcagcttcaggtctaaaaatacaagtgggctatgggccaacccgtaaaccgatttataggtaataaaatttgaccgacccgtgaatctatttatatgtaaaattagtgggtaatccaaagtctacttatttggtctataactataagtggcttcgcggatcagtccagttacatcatattcaggtctcaatgtgagagactttagtatatgcagtatattgcaattggatttatggataacgggtagtaacatggttgatgaaatggtgaataattgagctttaaggttagcagattaccatatgctacagaa

SEQ ID NO: 197 - DNA, 453 bp, Hordeum vulgare
agagcagagcacaacccttggagacttcttccacatagtaacccgacccaccctttgccaagatgtataacgctccatcggggcaggagatgtcctacacggaccacgtccagaagcgccacgaggagaagggctgcatctacgcatgcgtgttcacggcgctgtgctgtttctgctgctacgagacctgcgagtgctgcctcgactgcatctgctgctgctgcaactagtccatggcctccatggaaggtggccgcaaggcgcagcagagacccaccgacctccgctgcctttcacaataagcatatgtgactagtgtcttagctcgatgagaggaactgtagtatcagatgttgctactataataccatctgtcccggacaagactatcactgtaatcatccatcatggttcgtgttgcatcttaattcaattcagcatcagattctggct

SEQ ID NO: 198 - DNA, 1040 bp, Zea mays
acctccatcaaatcagatctcacgcccctgcagccaaaacaaaatcagcatccggatctccacattccccaccaaaaatcatcctccggacgaaatcagcggcggcggagatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcattgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaacccgcgctgcgacgacaccgagctcccgccagtcgccaagcgcgtcggagaccacatcttccgatacttcccccgctccgcggtgttgttggtcgataacaagaagcttgaggaggccgtcaaggggaagttttctgatgcggtgattcagttacacaccagggattcatcaaaaagttggcgtcaggctggatcagatggaagcagtcagctggttctaaaagaaccttctaccaatgttgtcctagctgatcatgttacaacaaagaaatgggagaaaattgttgatttcgatgaccaccttgatgatattagcaaggattggtcgaacccaggcctccttgactgagttttcatgattgatctcgctatactgttttggaacttcgctagaaatgaggtggtgaagctcgtcctgctgtgctatggatttctctcagtcgcaacgagttgtaagcactaagcacggatttcattttaatgtaaacgagtgattttgtaacaattacagttcaaaatgctaaaattatgcagagaccatgagattgtttcaaggtcatgacaattattacgagttgtcacaaacaatttttgttcgtacatgactcttattttaaagaatgaaagttcacataaatttaagtga

SEQ ID NO: 199 - DNA, 3184 bp, Oryza sativa
gtactactactcgcagttgcctcggaattggcgctctcggcgtcctcctctcctcggcgtggagagagaaggagcagatcgctctcccctctggataggcgaggcgaggagaggaggcgacggccgcgagcgcgaggcgaggcttccgactcgagcaaggagatcccactgctccaaccagatcaggtgatgggtggggaatctacaggaaacacgacctccattccccaatgggagaagccactgttcccctcagtatccatgttactctgagctactgagctctctgctaagttggtgcctcagctgtgtatcttgcagcaagagtgttctagccttctaggctgccaagatgaagtccaatgcggttacctccaaaggcaaggccgtgttcgagctgaagcacaggctggtccaggccatcaacaagattgcagacagggacacctaccagattggattggatgagcttgagaaggccgctgacaccttgcctcctgacatggttggtcccttcttgtcttgcgtggttgacaccgatgccgagcagaagagtgcggtgaggaaggagtgcatcaaggtgattggcacattggctcggtcccatggaagcctagtggcacctcacatgacgaagatggtgaccagcattgtcaagcgcctcaaggatgctgactctgttgtgagggacgcctgtgttgatacctgtggtaccctcgcattgtgtgctagaggctatggggatggtggcgctgcattggttgcgttggtgcggcccttgtttgaatcacttggtgagcagaataggtatgttcaggctggggcagcgtcttgcttggccaaggttattgacgagagcaattacttccctggccctgttctgccgcagatgcttgttcgtgttgttaaactgctcaagaatccccatttcatggcaaagcctgcagtgattgagttgatcagaagtattattcaggctgaaggtgcttctacagagcagtctttaacatctgctctaacaagtattatggatgccctgaagagtagtgattggactacaaggaaagcagcttcaatagctctatctagtattgctctcagttctggatatctggttgcctcctttagaacttcctgccttcgctcccttgaacgttctaaatttgacaaggtcaaaccagtgcgtgatgcaattacccaagccattcagttgtggaaggttattccagggtctgatactcccgagccatcagaagctggatcatccacaaaagaaaacttctttggtgaccatcatgatggtagaagtataaatgatggtggatcacgagacacttctttcaggagagttgatcctgcatcttctgtttctgcaatcagtggcaattctattacttcatcaaagaagagatctcctctgtctatcaataaaatagccctgaataatgctgcaaatcagcaacgctcgaagttgagcgattggcatgttgagatatctgttcctaagcagaatatgataccattagttgattttgaagaaaaggtgtctggcaatggttccatgctaaagggttcaaatagaagtccatatgaaatcgtagacaatgacagcaagtatgagtatgaccccatggatgataaacaagattgctcctctatgtcagaagtagccagcaggagttgtgagacaaagcatgtcacttctgctcaggaatgcgttgaggattgtgattctgcaagagacattgagcaattccccagggctcaaaagagtaagagcatagactccactgttacagatatcacttcacatgggacacatacttgctgtttgggtgcaatgaaagaactatctcatatcaggaagcagcttcaagagatggagaggaagcaagcaaatatctttgatatgttgcaggaattcatgtctaactcagtggagaacatgtcagtattaagcatgaaagtgcataatttggagaatgctgtagacaaaactgtgtatacaattactcaaagtgaaagccgctatcaccttcctggttccaagtttattaagaaccaaagtgccacttcttcaccgagggtttctacttctacacctagatcatctgtggatgctaactataagccaccaccaattcctcatttgaaacaagagaaaaagtggatgcaagatcaaccatcaaagggcttaaacatgggtgtaaaagagggggaatttctaaagagtcatactcatgacaaaactagaaagcctggggttgtgagatcggaaagtgctctgggaagatatgttccaagctcagcaaggactcgagcatcaggggttaagggaaactttccagtttcacttaccaattcctgtgagcagcctgagctgcaaaatgcattgcgtgcttctaaagaatttgatggtaatgatgacatggcgtctgcatatgtagaagccctgaacagtggtgactgtgattatctgattgacgtaatggatagaactggacctgttcttgagaaattgtcacgtgaaacaacaagtgaacttttgagggttatagctggccagtttctgaataaaaaaatgtttgatttggcattgccttggcttcaacaggtagcggatttgagcatgatttataagccaagtcaactttttgtgtctgtgagagcacagaaggagttccttgctttattggaggaagctgcaacaagtggatctacagagccagcaatcagaattgccattgcacagcttgcatttaaactgacaaaagtctgtgaggttgcaccatgcaggaaagttttgagtagagtgtgcagaggaaatgaaactatcatggccactgcgatgtgaaatacttcccctagcaatgtaccccctagtgtatgttcaaacttcaatgtcatgctgcagtgattgagtgcacccatttcattttgttgtagccctgtaatctgtgtgacaatgtatactcggtttgggtactatgtgcaagactagatgagttctgcaaattcatctatagtttgctagttaagcttggatcttctgttgctaggaaacggctgtttttagctgtgttgtgagatttggtctcataagtagtgatcattgagcttgtgaattcatgttttgtcatcttacaaaagggaattcatgctatgtcagcaatgcctgttactg

SEQ ID NO: 200 - DNA, 1292 bp, Oryza sativa
gagtgtagcttcctccctagctgtccgcgactccgcgaccgacggcggcggcggcagatggagaggaaccagcaccgcgacggcgacggcgacggtgagggacgccatcatcatgtcgtccaggtcccagcgtcagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcgatgctcacagcgttcccggcgtcgagcctcctgtcgcggctgtactacaacaacggcgggcagagcaagtggatcctgtcgtggtccgccgtcgccggctggccgctgccggcgctcctcctgctgccgtgctacctcgccggcaaggcggcgccgacgccgctgtcgccgaagctgtgcgcctggtacgcgctgctcggcctcctgagcgccgccgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtccgggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaacatgaaaaatatgtgaactgagtatgttcttgtattgacca

SEQ ID NO: 201 - DNA, 2015 bp, Hordeum vulgare
  misc_feature (73)..(73): n is a, c, g, or t
  misc_feature (167)..(167): n is a, c, g, or t
atcaaccaccaccaccagcaaaagcccggcgcggcggcgtctcttcctttccttccccgctcgccatccgccntcgccgtccctcatcgggcgaaatccatgtggttctgcgggtcgtcgccgataatgtggggccaacaagaggaagaggaagaggaagaggatcntgacgagcatgacagtacccagtcgccgccgacagtgtgggacgaaaatgaagaggctgatgacgagcatgacgccagatcgccgccgacaatgtgggacgaagaggaaaatgctgatgtggagcatgacacccaaccgccacccatgatgtggggcgaaaatgaagagtctgatgacgagtatgacacccaatcgccgccgacaacgtgggacgaaaatgaagaggctgatgacgaatcgccgccaacagacgatgtggggcgaaaatgaagagtctgatgacgagcatgggcacgatgacaacgatgttccctccgggagttccgaggaaggggagcccaagttcatagaagacaagtacaggtacagcacggtggatgaggtcattactgtactgagagaagctgggcttggatcatcaaatcttatttttggcattgacttcaccaagagcaacgattggtcaggtaagcattccttcggaggagaatctctgcatgccatcagtcgcaccccaaatccttatgagcaagccatttctattattgggcgaacactatcacattttgatgatgataacttgataccatgctttggatttggtgatgtttctacatgtgatcattccgtcttcaacttttacgaagaagaccgtccttgtcgtggttttgaggaggttcttgatagatacaaacaaatgattccatatttggacttttcaggaccaacttcttttgcaccccttatctacgcggcgatttcagtcgtcgaaaggagtaacttccaataccatgtcctcgtcatcatagctgatggacaggcggccacctcaaagtcttacagcatcttaagtccacaagaagaggaaactatacaagcacttgttgatgctagcttctatcctctttcaattgtgatggtgggagtgggcgatggaccatgggatgaaatgaagcatgttgatgactgtattcctgacagggcttttcacaatttccagtttgtgaactttactgacatcatgtcaacgagcaaggatatggagaagaaggaggctgcattggcctttgcagctctgatggaaatacccgctcaatacaaagcgacccaatgcctccaacctccagagtggcacgaagaaatggctgacccttggatgatccttccgccaccaattgaagtccttgaacgtgattatgctgttgcagtttcccattttccagccgcacccgccctgtctaccggcattggcaaggacagttcggatgaacaggtatgccccatctgcttaatgaatccaaaggacatggctttccaatgtggtcatctgctaagtctccctagcgcggcattaaccggcgttggcaagggcacttcggatgaacagttatgccccatctgcttaacgaatccaaaggacatggctttccaatgtggtcatctgacatgcaaggagtgtggtccgacgctatcgacctgccacctgtgccgcgcaccgatcaccgtgcgcctgaggctcttctcgtgaagatgacgtggccctctgtagcggagtaccggatcggccgttccatccaactcggtgtcagtagtaatgaaggagcaagaggttggaaagacaatccggtcaaaaaaaaaaggttgaaaagacaaagatacatgaatagaactttactttatatgtccagaaccaactgcatttcagacttccagtgacctgttgtttgcacagtttattactgtcgtcatgcacaaagtagcagtggtaggaaactgtgtttcctttttctggtaaaacctgaatggaatatcagctattgtgttacagtatgatctgcatgactcta

SEQ ID NO: 202 - DNA, 1930 bp, Oryza sativa
atcaaacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctccccctctcctccaccaccttcacctcctcctccatctccaccaccaccatctccatcgcctcctccaccttctcccccgccgccgtctcctccaccaccatcgccatcgccgcctccaccatctccaccgcctccatctcctcctccgccatcgccagtgtactacagctcgccgccgccgccgtactacgaggtttcaccggaggacaggtacctctcgccgccgccacctccggcgtaccacgaggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgattttcttttgcttgtactgtatgtatttttcttcttttatttttttctccttctttgaatgaacagcaggaaatctgcttttcctccc

SEQ ID NO: 203 - DNA, 1063 bp, Hordeum vulgare
  misc_feature (837)..(837): n is a, c, g, or t
  misc_feature (1045)..(1045): n is a, c, g, or t
cggcacgagggctcaattcacctcccaagcagagcagcgctatcttctcagaaaaagaagagcagcggcggcggggaggacgcagaaccgggaaggggaaatggcggaatccaactcgtacgaggagcagcgccggaggcagatcgaggagaaccgccggaagctggaggagctgcgggtgcaccacctctccgccgccgtccgcgaggccgccgccaggcccaagcccaagcccaagcccaggccgaagcccaaggccccggaggccggcgagctccggcggtccggccgcgtcgccagcctcccggagcagcccaactacctcaacgacgcagagcagcgcgactaccgtggagtgtacgaggcatacgctgttcggaaagggccgaccgacgagcagagggccggcgccatcgccaaggccgaggaactccggcgccggatccaccgctcccgctgccccgccttcgtcaagcccatgtcccacagcctcgccatcaatgaagtccacatgcgaatcccgagggacttccgcaagtatctcccggcggcgcatggtgaggcggtcgtggtggtggatgaggcggatgatgagttccacatgatgtataatgcctacaaaaagcgctgtcactatctcgaaaaggggtggaaagggttcgccttcgaccatgaccttgtcgatggcgattgcttggtcttccacatgacagagagggcaaaattcaaggtctacatttttagagcaaagccagactataaaagtgaccaaacttctgatgaatctggggatgaagagtaatgaagatgtgtgcttcccatacattgttcggtcanagctgtttgtaggagaaatacgctcttggctgatgttggagttgcctaccgcgattgcatgctggttgcgtgtagagtcgcattctcagacccagtgtagcaggcctgcattataacataggttagatgggagtagtaggtagtgcaggccttgtattggttgaactactaaacggttgtagtctgactatggtctcaagtgcatttnttcatgctgttccttttt

SEQ ID NO: 204 - DNA, 948 bp, Hordeum vulgare
  misc_feature (882)..(882): n is a, c, g, or t
  misc_feature (938)..(938): n is a, c, g, or t
acaaacccgataagaaaatggcggcttgtgctgcgcccccctacgtccgcatctcctgctccacaccttcaccgaccgctctccgccggccacgccgccggcgcgtcccctccgcccgatgctccctcgccgcggcccccggcctccgggcgccgccggagctcgtcgactccatcctctccaaggtgagggggactgaccggggcgtgctgctgccggaggaaggccaccaggaggtcgccgacgtcgcgcagcagctcggcaagtactgcatcgacgagcccgtcaagtccccgcttatattcggagactgggaggtggtgtattgctcggtggcgacgtccccaggaggtatttaccggacccctctcggccggctggtgttcaagaccgacgacatggttcaggtggtggaagcccccgacatcgtcaggaacaaggtctccttctccatctttggccttgatggcgccgtgtctttgaaaggcaagctgaatgtattagacagtaagtggattcaggtcatatttgagcccccggaactgaaggtaggctccttgggtttccgatacgggggcgagagcgaagtcaagctggaaatcacctatgtcgacgagaagatcaggctcgggaaaggatcccgaggctcgcttttcgtcttcctaagacaagattagaaggttaggcacgtatggcaccatgccaccattgcatactttcatgtgctcgacgccacaagggatatcagacatatgggtgtctgcacaactgcttgcacatgtaaattcagagataaagcccacaaagtagttttttatgatattaatttctacctgaagcagactgccttgttgtgagcgaaaatgtttgcggtactcatgntgtttctgaggttgaggagccgttttgagttgagggtgatgtggttcaaatctganagtttatggg

SEQ ID NO: 205 - DNA, 966 bp, Hordeum vulgare
  misc_feature (895)..(895): n is a, c, g, or t
caagcacacgcagccggccgcgcggcacggttttcttcccccgttcgccggccgccccgcccaccccctcgcttgcccactccttccccgaccgacggagccgatggcgacgctgcagctgaaccacatcgcgcgggagaccggcgacgtgcgccgcctcgccgccttctacgaggaggtgctgggcttcgagcgcgtcccgtcccacgcctactccggcttccaggttgcctggctccgcctcccggcctcccccgacgtcgcgctccacatcatcgagcgcgaccccgccgtcgcctccccgggggccgagggcgtcccgccttcgcagctgccccggcggcaccacctggccttctccgtggccgacttcgacgggttcctcaccgggctcaggacccgcggcaccgagctgttcgagaagacccagcccgacggcctcacgcgccaggtcttcttcttcgaccccgacggcaatggcctagaagttacaagctcgagccctggcgataagtaacctgggacagggagcacgaaacagtttctacttctgcgacatccatgtagtgatgcccacctcgaggctgagacgatggaagctgcagaatctgagagtaaacatccaggatcatgctttagtaccttataaataatggacttatgcctatctctgctcctcatgcttgtaatattggatatgtatgtcttgtggctgaagtactgaactgtgctgtgtgttggaacatcaagttatgttacttcaaaaaaaaaaaaaaaactctagggggggctggcgtattaaaaaccaaaaaaatcctcagggggggggcccggtccccaattcccctataagggagtgttataaaaatccatgggcggcgctttataaacctcnggaacggggaaacaccctggctctcccccactaagtggccttgggaggaaattccctctttgggccgtgtg

SEQ ID NO: 206 - DNA, 871 bp, Hordeum vulgare
  misc_feature (508)..(508): n is a, c, g, or t
  misc_feature (644)..(644): n is a, c, g, or t
  misc_feature (665)..(665): n is a, c, g, or t
cttggggtgccgagtctcctcctcatctccatgctcttcctgcctcggagtcggagaccctttacaataattacttacttacttggagcatctctagcagaccctttacaaccgggcctggatctggatccggatccatctcttctcccctcccccgcgccggatcgcgcatcggcttggaggcccctcggggctgccgccggcgcgggaggcgtccgcggccgtgcgagctgggaatcgggcggcgggtttcgatcgagggctttctcgggctggcgcgggatctgagccgccgtccatggatttctcgcagcttgggtttggtactatccccacctctctctctctccctccctcggcgttgacgcgcgcgcacctaaaccgaatcaggcgagcgctcgttgccggatcgctcaaccatcgtccctggtcggctggcgccaggtatgagcagctcctgagcctggtcgctcgatgcgtgcacgcacgcatgtatgcatatatatanaatgtgtactccctctgtaaagaaatatcatggtcatgttgcttggtgtggaattgtggctgaaacaatcatgtcttgggcaatcaagacagccgtggtggtgggtactaaataagagcgtctacgaccggacttnttgacccatcatttgtaccgncctctcagttccccgtcagctacgggggcggcagccatcgaacattccattgcctgggatccggttgtggggtgggctgggagccctaccgggtttgttgtctgaagggtgctggaggggttggttcggctgaggccagttttaacaccctctggagatgggggaggggagatttagcctgcgataaacttgggcaggcgtggacg

SEQ ID NO: 207 - DNA, 1189 bp, Hordeum vulgare
  misc_feature (947)..(947): n is a, c, g, or t
  misc_feature (1015)..(1015): n is a, c, g, or t
gcgtagctttgcttcttcctctgctctcctcccaaacagaggagacgcaagaaacatagctccctcgaccaccggcgatggtgtggacgacggtgcaagagctggcggcggccgtcgaggagccaccgcgacagtacctggtgcacgaacaagaccaaggcctgctggccgctgaccagatgccggagcccatccctctcatcgatctcagccggctgacggccgacgacgaagccgacaagctccgggcggctctacagacctggggcctcttcctgctcaccaaccatggaatcgaggagtcgctaatggatgccatgatgggtgcgtcgagagacttcttccggcaaccgtcggaagagaagcagaaatgcagcaacttggtagaccacggcaagaaatctgagctcgaagggtatggaaatgacaaggtggtaaaccaggatgagggcctcagctggaacgaccggctgcatctgcgactggagccagaagacgagaggaatttcaccaagtggcccactcacccggcatctttcagggatgtgctgcttgagtatgcatcaagaaccaagagaataagagacctcgtctttcgatcgatagccaagatcctggaccttgacgaggattactttctcaaccaaatatcaaacaaggatcccgggttcgcaagattcaactactaccctccgtgtccacgacctgacctcgtgttgggcatgaggccgcactccgatggcggtctccttaccatcgtttttgtcgaccacgacgtcggtggcttgcaagttgagagagacgggaaatggtacaatgttccagccaagccttattcgttggtgatcaacttggctgactgcatggagataatgtgcaacggaatcttcaggagcccggttcacagggtggtgacgaatgccgagaaagagaggctttcactggcngtgttttatgctgtggatggagaaacgatgctggagccagcgcctggtttgctggatgacaggcgacngccaagatatgggaaattcaaggccaaggatttcggtctttctttggactgaacatttccatcaaagaaagaggttcaccgagaacctgaaaatacaaatttgatggttttagttagtttatttacggatttgtagcagtgattgcctgggagaataaagagaggtttctcttc

SEQ ID NO: 208 - DNA, 736 bp, Zea mays
agcttcaagacatccatcggtatctttggcatcctcatattgctcatactactgggacgagtggcatttgttttccctatatccattttgtcaaatatcatgagtggaagttctgaaagaaccccgatcacattcaagcaccaggttgttatttggtgggctgggctcatgagaggtgctgtttccattgcactagcatacaatcagttcacattttcaggtgtaacatcggatccagttcatgccaccatcatcactagcacaataatcgtcgtcttcttcaccactctggtgtttggcttcttgaccaggcccctgatcagtggcatgctcccgcaccagtcgagggcgctgtccagaggccatagcacaggcagcaactccccgaaggatgacttcaccctgccgttcctgtcgggcgatgaaggcgcgtcaggcagcggtatcgtcttggagcaagccaagaggagcttgtctatgatgctggagaggcccgtccacacggttcacatctactggaggaagttcgatgacaggttcatgaggccaatctttggtggaccgcggtcgcactgactgcaggtgcatataagaggagttagtttctctgaattctgtcagcatagttcgcccatggcactgtaaagttgataacactgaatgctttcaagcaactctttattatttttagtacttatattacatcactgcaatcttacaaacataattttttttt

SEQ ID NO: 209 - DNA, 1220 bp, Hordeum vulgare
  misc_feature (799)..(799): n is a, c, g, or t
  misc_feature (804)..(804): n is a, c, g, or t
cgctaaactctgcgacagccgcggcgaaattcctcggccgaaagggaaggcgacagtgacacgggcgcacgtcgagctctccgctgcccagcgttaaatccgcacgcaactcagtgtcacggcaaggtaactaccgcacggcacgacagtcaccactcaccaaccaccacccgagtccacgccccccaaacccaaaccacccacaggccacagcgaccggcgacgatgtgcacgctggagcagcgcggccgcgtgttcgtcctcaccctcacgggcgacggcgagcaccggctgggccacccgctcatcgcctccatccgctccgcgctggcctccgtcctcgcggcggcccaggcccagccccagggcccgggggcggccctggtcaccgtcgccgagggccgcttcttctccaacgggctcgacatcgggtgggcgggcgcctcccgcgcgcggctcggggagctcgtcgacgcgctccgccccgtcgccgccgacctgctcgccctccccatgcccaccgtcgccgccgtcacgggccacgcctccgcgggcggcttcctcctcgcgctctgccacgactaccgcctcatgcgcgccgaccgcggcgtgctctacatgagcgaggtcgacatcggcctccccctcccgccctacttcgtgcacgtgctccgcgccaagatctcccaggcgcacgcgctgcgggacgtcgtgctcaggggcaagaagctccgcgcgcccgaggccaaggagatgggcgtcgtcgacgtcgtctgccccggcgcgcccgagacagccnccgangccctcaagctcgccgagcagctcgccgccaggaagtgggacggcgccgtgtacgcgtcgattaggatgtccatgttccccgatgcgtgcagggccgttgggatcgccgtcgagagcgacgaggagaagagcaagcacttcgcctccaggctctgatcaggggaggtcggaggttctgaaccgacctgcctttgttctggcagagtgtctacggagcctgatgtctctcttggtattctgtatctgtacatggatcagccaatgatgctttgtatgaaacatgcattatatatattacttctgtaggcgttgtattttttgttactttgaaagtgtgaaacaaatagaatgcttgtgtgttaccgttggactggttattttgttgttgctgcagtgaaattctcatttgcaaaatc

SEQ ID NO: 210 - DNA, 1151 bp, Hordeum vulgare
  misc_feature (39)..(39): n is a, c, g, or t
  misc_feature (1024)..(1024): n is a, c, g, or t
tcggcacgaggctgtttttccggtgttcctcccgcgagnacgagacggccgcctctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtctagctctgtgtactccatatgtcaccatttgtactctgtatctgatgagccttgtgcgttgttccctgaactatatctgtagtagcaggtagccaggttaaacccgcagtgatatatctgttattgacttgttgagaaggccactgggtaacatggtatcttgctttgggcggatccgcgggtgggcgcttttcttctgtttttgatggtgctgtactcccttatattaattgtaagatgtataagattccncaacagcagtgagaatttaatttttttttggttaagtagcgtgcattattggcggtgtaattgttgggtgctgtgttcatgtactgtaattggaatttattgttggctttggaacacaggcaatcag

SEQ ID NO: 211 - DNA, 1411 bp, Hordeum vulgare
  misc_feature (1292)..(1292): n is a, c, g, or t
  misc_feature (1305)..(1305): n is a, c, g, or t
tggttgacttgggtgtctggtccgcagtccgctagcggatcgatccgtccgaccacggattgattcccctccctggtcgcctatccgctgacggatcacgccggctggccgcccgcccgcccgcccgccgccgcgagaccctgccggactgccggtgggcaggtttactacgatgagccctcctccgccgttgcgtccgactcccacttacagcctgcttctgctgctcttcttctcgctaaccgcatcggctgcacaaccaaaaggggtatgtgtttcacctggcggacggttccctgctttctcatctgaaggcaagcctcctggaaaagcggcaaaggggcgccgagacctagcattatgtaggatattccgccagaacacatgttgtgacgttacacagacatttcctgccctgctttcagtgagaaagctctcgtcaactggcgaaggcagtggagaatgccttcatttgtgggagttgctcgagtgctcagtttgtgatccaagggtgggtgtcaggcctggacctcctgttatatgtgcatcattctgtgacatggttttcaaagcttgttcggaggcatacttctccattgatatgaaaacacaggccttatctccttgtggtttaggtgacatcctttgtggcaaagcacataagtgggtttctaacggcacagagctatgtcgccttgctggtttctctgtgcaagtttctgatgccagtctcagtgaagttgacgaaaccttctgctatggcgggaaagcaagtttggattccatctctgatacatggacgtcttcaaaagatcgaccagcattacatggtatgccctcttgggatcttgaagattttcagagatgggcaaaagaaatgcctgttggtgaaagaatttcgtgggcagtcggaggaatggttcttacagcaggccttatttttatcagcaaaagagagggctacagccgtcgtcgtaagcaagcttccgtcgctcaaactgtaagaaaaaaatggaatcgggagctaacccgcagcaactgaagcgatgctaggaagacataggcacctgtagcattactaatagatgatctcttggatttgtatttttgctgctctgtggttatattctaatcaactatgaaagattggttgttagactgtctcctctctatcctggtgcgtaggcacaaccaccttttctaaatgttgtgtgaaagaaaagctggagaggtctatgaattgtggttgagattgtttcttaatgcagtttttacttttgctttagtatctntatatactgtcanagtattcggaaatgaattctgcagaggttacccacagatgtctttactggcgcctaaatatttggcgcaaagtctgtccatctattataagcacagtgttgaccgt

SEQ ID NO: 212 - DNA, 1238 bp, Hordeum vulgare
  misc_feature (606)..(606): n is a, c, g, or t
agcacacacagcgacaagtccgcggcacgcagcgacccgctggagaaagtggaagagaacatgggcggcggcattttcccactgctggagccatggttcgtttccctggccgtcctcggcgcggtgtactcaacagccgtcgtgctccgcctcctctcacacctcaccctcctcctgcgtcggccgaggaacccccgccgccgctacggggcatgggccgtcgtgaccggtccaacgtctggcatcggccagtccatggccctggagctcgcgcgcttgggcctcaacctcgtcctcgtcggccgcgaccccgccaagctccaggatatctccgagaccatctccaaaacccacgccgtgcagactaagaccgtcctcttcgacctcgccctcatcgccactcctcaaggggacgaggcggtgcggcgtctccgggaggccgtggaggggctggacgtgggggtgctggtgaacaacgccggggtggccaagccatgcgcgctgtacctgcacgaggtggacgtggaggcgtgggtgaagatgatgcgggtgaacctatgggcgctgacggaggtgacggctgcggtgctgccggggatggtgcancggggcaagggcgccgtcgtcaacatcgggtccgggtcgtcggaggccatcccttccttccccctctactccgtctacgccgcttccaaacggtacgttgctcagttctcccgaagcctctacgtcgagtacagaagcaaagggatcgatgtgcaatgccaggcaccgctgttcgtgcagacgaagatgacgtcgatagtcgcgggatccggcaagcggcgccgtggcgtgctgccgcggctgatggtgccgacctcggacgagtacgcgcgggcggcggcgcgctggatcgggcacggcccgatatgcatgcccaacctgggccaccgcctccagtggtgcctctgccgcgtcgtgccggaccggctgctcgacgcgctgcgcctgcgcgagaacctgcggcagagggccgtcttccagcggctcaggtcgccgaggtcgccgtcccatgccaacggcggcaagcagagctagcttggtccaggctgcgcttgtttgtgcatactttgtgtagtactgtgtgtgatttgacatggatctgtggaccgcagttcggtttgagtcgccgttgatgcgcgcgcagctgatgcctgcctgtatctgcatttccgttggcaataaatcaaattcac

SEQ ID NO: 213 - DNA, 1519 bp, Hordeum vulgare
  misc_feature (29)..(29): n is a, c, g, or t
cgtggacgagcaccgccggtattccgttnccgaattccacagatttccgctccccactcccaaagccccgatactttatagccggcgacagcaagcccagcaaaataccacctcccaacccggaaatccgcccactcccgcgaatgaatcagcttccccttccccttacccttccctgagatcccagcccgagcctacgcgccaggaattccaccggaatcctcccctcctagccgcagcgtcgccggattgattcaggaggcattcttggtggccggagaagtggtatttgctcctccgcttgagagaatataacagaggctgtagttcagatcatcatcatcaaacatgtcgcttctatcgaaattacggttggtcactgtggatgtgactggtactctgcttgcttataaaggacggcttggtgattactactgtatggccgctaagtctgctggaaagccatgccctgactatgatcgaatgcacgaaggcttcaagcttgcatacactgagatggcaaggaaatacccatgctttggatttgcagcaaagatgccaaccattgaatggtggagaatttgtgtcaaggattcatttgttaaggctggctatgactacgatgctgagacatttgagaaagtgttcaagagaatttattctgcctttggctcctctgccccgtactcagtgtttcctgatgcgcagcccttcatgagagagctgagggagaagggtatcacagttgggatcgtcagcaatgcagagtaccgttacaaagaggttatcttgcctgcattagggctgaatcagggctcggagtgggacttcggggtgttctcaggcatcgtcggtgtcgagaaacctgacccaaaaatatacaagatcgcgctggagatggcggggaacgtcgcgccggaagaggcgctccacatcggcgacagctaccgcaaggactacgtccccgcacgaagcatcgggatgcacgcgctgctcctggaccgattcaagaccgccgacgccgagagctggaggaagtccggcgcgccggtgctccctgatctcgaagccacaaaggcatggctcgccaagaacccgaccgaggaacccgctgaggagccactaggggccgcgctgctgcgcaggatggccgagaagctctgaacctcagcccctggggtagttcctgttgtgctcttgctggggagtgagggagccaaggaaaagggatgtgttgtagtgatggttcactggccagtttcagtttgctggagctgcttgaactttggtagtagcttcctgtgctgttgctgactgctgaatgtggcaagtgatccagttgcgcgacgaacatcttgcaatgacgaataattctaatcgtgtttcacataatggagaaatttgacatgattctgcatttgtatgaggttggtaggatcgcgatgtcggggttatattcaaactcccaagatgaatgtgatagctcagcagaagccatgtaatctgttgagcggccgcc

SEQ ID NO: 214 - DNA, 738 bp, Hordeum vulgare
  misc_feature (724)..(724): n is a, c, g, or t
tcaaacctccctccctctctctctctcgagtggcgtcctaatagctgcttcttctcttctctctaccttcttcttcggtcagctctctcaagcaaaagcgaagggccatggagggcctcatcccgttcatctacagggccgtggcgcagtacaggaaggagggccaggtctccctcgccgacctcctcttcgacgacccctcctcctcgccgacggccacctcggcctacttccgtctccccggagactccggccggcaccagctcttctcggccgactacggtacggcggcgcggcggtctcccgcgcaccgtcggctcaccatggagcacggatcgtggtgaccgaccgtggatgatgcgacgccgattgctgaggagctgcgagtattgttggcctagctaagctaatacgagctgcaaaactagcagtttgtgtgtgttatgcatgcatgtatttgtgtttcagttaagcttgtaaaatgatcggtccgtgagtcggtgagtatcaactgtaaataattatgggatgcataagcgcaggacctccgaaggaggccctgcctgtgaagaagatgtatgtatagtgtcggagtgcatacgtggagtgtaatatggcaataaaaggtttaccatgtatttacacaagacagaagacagaaggttataacatgacttgctgcaatgcaacgctgcaaaaatgcgtacaaagcatcaagattgcnatcacatgcatcct

SEQ ID NO: 215 - DNA, 2103 bp, Hordeum vulgare
  misc_feature (1222)..(1223): n is a, c, g, or t
  misc_feature (2048)..(2048): n is a, c, g, or t
cggcacgaggcttctgggccgtatacggaattcagtggcataatccagcctcagcagaatttcatggagctgcatggccatccttcagaacattcatcatcaagggaacctaacatggtcacttcgcttgcagagcaaagctccttcgctcctgtcaaagatatgagaaatgagatgttgatgcatttcatggatggcgcacacagtggtggtggtgatctcatccacaatgatgcccatagcagtgcgcagcttgagtttggcttgttgaacaaccccagctcggcgattgttccatcagcaccaggccaaggattgtcgctgagcctcaacacacatatcctggcaccttcatacccatactggtccccaaagccagacttattgacgacccaatcttaccagggagatgaaaacggaatgaagaatatgcagtcggaggcctcacgggcaatcaggaattcaaagtatctaaaggcagcacaagaattgcttgatgagattgtcagtgtttggaagagtataaaacagaatgcgcagaaagacaaggttgaagcaggaaaaatggatggaaaagacgctgatgaggtgttgaaaagcgagggggtatcttccaacccacaggagtctgctgccaatgcagaagctgagatttctgcggctgagaagcaagagctccagaataagatggcgaaacttttggccatgttggatgaggttgaccgaaaatacaagcattattttcatcaaatgcaaattgtagtgtcgtctttcgatatgattgctgggtctggagctgccaaaccttatactgcagttgcccttcagacaatatcgcggcatttccggtgtctgaaggatgccatcaacgaccaggttaatgtcatccggaagaaactgggagaggaggataattcatcgggcagagagggcaagttaactcgcctccgtttcattgatcagcagttaaggcagcaacgagctttccaacagtatggtatgttacagcaaaacgcttggaggccgcagaggggtctgcctgaaaactcagtttcaattcttcgtgcttggctgtttgaacacttccttcacccgtatccaaaagattcagaaaagctaatgctagcgaggcaaactggtttaacaagaagtcagatttcaaactggttcataaatgcccgtgtccgcctgtggaaaccgatgatcgaagacatgtataaannagagaccggggaggccgagctcgactcaaactcctcctctgacaacgtaccaagaagcaaggacaaaatggcatcctgtgaagacagagaagatcagaaatgctccatgagccagggccaggcttaccaaaccagtgaattcaaagccaacgttggaatggtgggcctcaccggagggccggccagcttccacaatgaggcgagctccgacgacggcttcatgaacctgctgttgaaggaccaaagaccgggcgaggcggacggcggtctcctccatggcgacgagagcgcacggttcatggcctaccatctggcggagctggggggatatcagaacagcaatgtgtcgttgacgctaggactgcagcacactgagaacaacctttcagctccaaacaacactcaccggccaggtttcaccgtgggcggggaaggggatatctacaacactaccgcggctcatcccggtggtggcgccgccgccgcctctccggattacgaatcgacgaaccagttggatcagcggcagcagtttgagccgtcgcctctgctgcatgatttcgtggcctaagtgaaatgaacgctcgttgctggtgaagatgggatggggaggattatctgtaatttgtaggccatgataataacgtgcctgaaaaagcctggaaattgtagctgtagttgcatttggtatagaagagagggggtatagcatgaaatgtattataagtttgtgggggtggggtaaataatttttgtaaagatgaatggaatgcattatacgtgtaaaagattatgaatgaagaagaccaaccatcctgtaaaaanaactacacaatccggtttaacgaatacttctggtggtttaacgaaaacagaaaac

SEQ ID NO: 216 - DNA, 1211 bp, Triticum aestivum
  misc_feature (1041)..(1041): n is a, c, g, or t
  misc_feature (1082)..(1082): n is a, c, g, or t
  misc_feature (1142)..(1142): n is a, c, g, or t
agtgcagcaaatagtctccatgttcaacaatagtgctgctccaaggagactatttgctcttggatttttgctcttcttcactacatgacagatgctgtcttgagatctggttgtgtgtggctgatgggtgttccagcaggctttaaactgaatactgagttagcagagcttctaggcatgatttctctgaatgcaatccaaatatattctaccctttggttcatggtgggaggcttccttaggcatataattcaaggccttgcattttctggaattcttttaggcttcacggttcctgtttcaatcttcattgacattatccagcttgcgacgttgcatgttaccatgcttcagtggttaatctccttaatatattcaaggcagattcagacagtgacatcattgtggcgtcttttcagagggcgcaagtggaatcctcttaggcagagattagatagctatgactacacggttgaacaacatgtggttggttcactgttgtttacaccagtcttgcttcttctacccacagcttctatattctacatatttttctctatcttgagcagcacaatcatctgtctgtgtatagtgttggaaactgcaatttgtataatccactctactccttacgctgcggtaattctatgggtgacaaggaggcaaaggtttcctgctggattaatgttccttcctatgtcatcgtcatctgtatctactgatgatgatgctccatcagttgaatatcgttcaaccagtttatctggcgaaaggaaaacagatgaacccatccatgtacattcagtaccactagtttcagaacttaactgtaactataacaccctaggacaagtaatcgggccacattaccagaaagttttcaacgggatcgctctccccttctgcaaacaactggcacatggaatccttaggggcacaaggatacctacaacactgcatctgccgtcttctccactgccctggatgcatattggcattagagaatactggatgctttgccgtcgcgcaaccaagtggggnaggaattaaaagttctccgcttatgattaactattagtcgntcagagaattttgcttagttgccaccgttttgcagtggatgttttgctttagttgccttnacacagtaacaaatgttggtagttgccaagatgttgcgttgtggactgctttgtagcactgataccatt

SEQ ID NO: 217 - DNA, 1752 bp, Oryza sativa
agacacagccgagctcaggcgacgacgcccccgcctttaatgggctttccctcccaccgacatggccggcgatccccacacccgcgccgcccccggtgacctctcctcctcctccttctccttctccccctccccttccgccgccgcggttgcgcttggagttgggggtggcctcggcctcggcccctctaggctcctcctccacctcctcctcctccactccctcttatagcccaccgccaccggccgccgcgcgcccatggccgccgtgttcttccaccatgttgtcggcgacctcaccgtcgggaagcccgaggtcgtggagctgcacgacaccgacacgccccgggcggcgcccgacgagccgccgtcgggcgccaggttcctcgggatgatctccgcgctcgacatcgccacgttcgtggccgcttccggcgtcggtgaccgggccatggccgccgtggtcggggaggtcgtgcagcccaaccctggcctgctccgggaggtcgatccaggcacgaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacggacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacactgcgcctggttggttcttttttgtctttcgagagttggggagttttttgtccgcatgagactgaaactgaagggtatattgtgaattccttgtggatcggtgctactatggcagactcaggcttgtgctttggtacggtggaatgatagtctactcattcgtatatgtataatgtatcgtttctctgtgctcccttaccaatggcccaatgggatcagagatggggtaattaacccagcagctgccatttcttgtcaa

SEQ ID NO: 218 - DNA, 2489 bp, Zea mays
atgtctcccgacgtagacgccgccgtggcaaccgccgtcgctcccgggggaggctgcggcggtgacggagaggcgggcgccggcacgtcgtcgtccccggcgtccgcggcgaacgggcgggcgttggtgcggtgggaccagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgcgagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaaccagtgagaaagaatgaactgcgtaacttatggcaacatgtgtggaggcggcatgcaatgaattgccagacaaatggatcagaaaataatgcagccagcaatcatattagtgccaacgttgctaatgggtcaaagacaggagaaaacagcgacgaggaaagtgatgcccaaagctttggtagcaagagggatactgaaattcatagtgttgaggcggtacaagatattcgtagagatgaagtggctggctcatccaaaaataacgaactacaaaataagtcttatgatggagtaaacacaaaagtggatgtgtcaaaatataccaatggtgctccaagtggaagtgagaagaatgtgcggtccaaatgccttaacggtattacttctgcaaaggtggctgagcaaattatggataatgccttgaggatcacggatgcaagttcacgccgtccaacaaatcttggcaatggtttggctatgactgagccagcagctgacagaaaatgtcaatcttcggtcatggaaaataatgctgtcacagaaaataaccctggtgataagtcgaagggtgctgcaataggtcatgctgattcttgcccctccgaatttatggtgaccaacttggggaaggaacaccatcttaatggttacaaaaaccaagaattcagggaaaaagatatctttaatcactcgaattcctctgccttttcaagatatggcaataaaaggatagaaccatcaggtgagattcagtttttcccttctccctgcgtcattgggcaagggcatgttaatggcaagaacccagttttccaacccaatggggtgttgctgcctcccaatgaacataatacaggtgagagtacaaggcaagctcgaatttctctggacagtaggacagagggtgctgccatcctgtgttccactagtgccagggaagatgctggtgcaaatagttcttcccatagaaaggacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaagctcccggtaaaccatctcatgttcttattgaacacaaacagtcagaggaaaaccaccagttgcatcattcaagacaaattcttcgggaatcaggagaaccaattgacatggcgagagctcacgtggatcgtgctaaccagactgcaagctgcagccaaggtatctgtaaaggaagtggatgcacatgtagtggtgaagccgatatcaacgcaaacacaatggttgccctagagagtggcaacgagagtggaatccaaaatggtgacaggtctcgccgtgaagctgcgttgatgaagtttcgcatgaaaaggaaagatagatgcttcgagaaaaaagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaggctggcagaagttttttcccttccatggttagcctttctgcacaatgggtgaactcttgtgtcgggtgtttggtgccgttgtggccttatttttgtaaagtgcatcaaattgacaaatgttcagaggggaatgggttgggggtttaggaaaacggtgcagctgccagatttcgcctatgtacttagatgtttgtggggggtgagaaagcagagcctgtacagcttattcacccattttgttgccattacactagtagtgacttgtactatgacaacagtagacattgttgtacagccttaccagtcagcagcgggtctttctcatttta

SEQ ID NO: 219 - DNA, 4338 bp, Zea mays
atggcagaaggaagcagtagccataggaggagtgcattctcccctgggctggctgtgttattatctggcgatgaagctaagattagctcccagaagtcgcacctggtgtcctatcatgacgaaattgggcaccaggctgttgagaggacgatagagcacatctttgatctccctcacaagtcagtggtccggcctcctggaccagttgacacaggcttcgtgcactcagtggtgaggaatcaagctagaaaatttgatcttgactgggaaaactgcattcggggataccatcgcagcgtcttcattgtggacaaaggtgctgggcagaggaaggtggttcttgatgattcgagcatttgtggtagcttcaggaatgtccggggaccttcacttgttgagagttccgcccctttcagcagtgccagggctaatgcttgtgtgtggaaaggcaaatggatgtatgaggtgacccttgagacgtctggagttcagcagcttggatgggctactctctcttgtcctttcactgatcagaaaggtgttggtgatgctgatgattcatattcctttgatggccggagggtgactaagtggaacaatgacccaaagccatatggccagccatgggcagtaggtgatgtcatcggttgctgcatcaacttggatgcaggagaaatttccttttacaggaacgggacttctcttggtgttgcatttgatggaattcgcagcgtggaacctaagaagggatattatgctgcagtatccctctcggaaggagagcgttgtcatcttaatttcggctcacatccattcaggtatcctgttgatgggtttgatccattagaggcgccaccacgctcttggtcgtttgtcacataccttcttagatgcctgttccggttgctagaagttcacaacctggagaaatctgaatcagcatacttcgagaaactgaggagggtgaaaaaatttgcaccactacaagaactctttggacccatttcagaagggatctgtgcagaaattttcagtgctattgaagcaagccaggggtgccttgagtatattgcctggggctcgttgatcactctactcttagatgttttcagaactcgtgagccgcatgatttctcatgccttgatcaggttcttgaccttttcctccggttcccaggttgcacttcattatttcaggagctcattgtggccctttcttgcatgtgcaaagttgcaccacttgtgttgacagaatgcccatattctgggtcatatccatttttagcgctggtttgccaccttcttaggcataaggatgtaatgtgtttatggtggaaagcagaagatttcgttttctcgtttgaaggcttccttacaaggaagattccaaataagcaggatctacagtgccttgtgccatctgtttggtggcctggttcttctgaggatgaagttagcatgacactgacgatgacaacactctcagatgcaataaaaaagattgaggagatgcatcgtgaactttgcagcttggtaatatgctttattccaccaatgtctacgcctcagcctccaggctctgtatttaggtcctttgtacaaagtttggtgctcaaagctagaggtggagatcataggatggttgtcaatgggactttcaacaacactgtgcttgtttcattgtacacagtaatcctgcatttgttgtctgaaggattttctatggattctgctggatctgcatcatcctctaaagcgaactttgggaatggtgttggatttcttcacaaaggtggaaaacgcaagtttccgacacaattatttttcaggaatgatgcctatcacagtgtaattcctagaatcggtggaccaccaagtattttgatgcatcaccaatttgatgctgtggaaaatgaagtgcagtgggatgaaggctgcatgaatgatgaagagacacgtgttacacacactacagcacagaagccttgttgctgctcagtgacagatgttgctgttggcctaagatacaaagaaactgctaagtatgtgccatcaacttcaaaaggctcatgtaagcctatgcctgaaagatctcctcatgttgctgctgagtgcaatggtagaggtctgagtgatgagatcgaagacaaacctagcacaagtgctcaatcagaaattgaatatggataccaatcactgcatagtcttgaaaacatgccaatggcaactcaatcttcgtcggaaacacttaaagaagaagagctgcttgatgttatgttgttgttatatcatctcggcatctcaccaaattttaggcaggcaatactcatttcaattagttctctacaggcattttatttcatgtctcagcagtcgcagtccatttctttactagaagaaactgacaggcagatacgagaaaaatcatgctcagagcaagtaaggcgtttgaaagaagcccggaatagctatcacgaggatttggtagattgtgtacggcattgtgtttggtaccgggccacccttttctcccagtggaagcaaaggggaatgtacgcaacttgcatgtgggtcgtggagcttcttttggtccttagtaactcaaatagcatgttccactatgttcctgagttctatgtggaatcactggtggattgtttccatgcactgcgaaggagcgatcctccttttgtttcccctgcattatttctcatgcaagggttggcctcgtttgtcactttggttgtcaagcacttcgatgatacaaggatagtgaaccctgacttgaaagatcttcttcttcaatcaatatcagttctcgtacagtataaagaattcatgcttgttttcgagaacaatcgggaggctataaataaaatgcctagatcactgttatcagcttttgacaacagatcatggattcctgttacaaacatactttcccggttctgcaaaggctcaggatttgcttcctataagaatggtgaatccgcatcatctgcaacttttcaggttctactgagggagacatgtattcatgaacaagagctgttcttttcctttcttaatcgacttttcaatacactcagctggacaatgaccgagttctctatgtccatccgggagatgcaagataaaaaccaggttgctgatttgcagcagaggaagtgcagtgtaatttttgatatctcatgtagccttgcgagaatcttggaattctgtacccgagagattccttgtgcttttctcatgggaccagatatgaatttgcggaggttgactgaattggttgtctttattctcaaccacatcatatcagtagctgatgcagagttctttgacatgacactaagacggccagggcagcatcaagagaaaacaaatcgtactatgatcttggctcctcttgtgggcattatcctcagtcttatggaatgtagcagcacatcagaacgaagggagctaaatgatgtgattgcagtgttcgccagcatggattgccctgccacaatccattttgggctgcagtacctactgagctacaactggagcaatgttcttcgaggggattcatcccttgcaaagctagcgcagcttaaagagttctcccattacttccgacgcattacagcgtccgtggatggtgaagaagaagaccatagcctaaacgcgggcgatgaagacgacgaccacacttgttgcatttgctacaactgtgattccgatgcaacattccagccatgccatcaccggtcctgctttggctgcataagcaggcatctcctgaacaaccagaggtgtttcttctgcaatgcagtggtaacatcggttactagatagccgattcgcgagcgatgcgctgctctactcattgcctctttcggtatcgtgatccgaaggaagatggtgccactgatttgtcttatctattttgcttgacctgagggctggggcgctggcgtcccagagatctttccattgcttttccaggaagaacgcgttacctttgtgcacgagggtcagaagcggttcttcgttttccttgctgtatatgtaaaggccagggggagattccacgactgtaaatatgatgagatatgaaacagaaaagggggtggcagatcaacatcgaccttctgtaattagccagaataaaagaactagatgctttatattgagcagagctctcgtctttttgatcctccccacggtgtagtatcaagaatgaataaatcttctgtttcttgtctggttgtagcatgccagcatctgtaagttgtaacaattcagtgaatttatttaccttcagcaaaaagggtaaaaaggttgcctcttcaa

SEQ ID NO: 220 - DNA, 552 bp, Zea mays
tgtgattctggataggggcgctggcaccgattggctccggatatcgcagcgtggcggtcgctcagttcagtccgccatggaaggtgcagccggccaaatgctcgtcccgatcctcggcatcgttgccgtggccgccgtgaccttctacaccgtcagcttcatggagatgcgagacaaatccttcgaggagctcgacgagaagtactcggacttcgacgagtcaggcgggcggcagcggcggtctcgccgcagggccgagcgcgacaggaagaagtccaaatgattggccacgccgccatttgtgtccctgctggtttgagaggggactgacgggggatgaagacgcagctgctacttacaaatttttgggtttcaagtcatgggtgagtgtgagtgtgtgtggttatgaacatctgcctatttcctagctattagccactgaagcagctaaaacgatggatttatttaaaagatcgactccgtaatacattatgtaccctctgttgtgctttcagttctgtcatcgggacttataaaacaaattttcccatg

SEQ ID NO: 221 - DNA, 2469 bp, Zea mays
cgtcgtcaagtgctggcgccggcgggctggctccctggcaccggcgccgccgccccggacatggccggagcgccgtcgtcgctagcgcgcctcctcctcctcctcctgctagctgccggatgcctcctcccgctggtcgctgacgccgcgcggctcacgctgtccctcgcgcccgccgccgacgcgctcctcaggctcaaggccggcattaaggacgacggcggcgcgctcggcagctggtcccccgacacgagcccctgcgccgacggcgggcccagctggaagggcgtcctgtgcaacaaggacggcgtgcacggcctgcagctcgaggggatgggcctctccggcacgctcgacctgcgcgccctcaccagcctgcccggccccggcctccgcacgctgagcttcatgaacaacgagttcgccggcccgttgcccaacgtcaaagagctcagcggcctccgcgctgtctttctgtccgagaacaagttctccggtgtcatccccgccgacgcgttcgccgggatgggctcgctcaagaaggtggtcctgtccaataacgacttcactggccccatcccggcgtcgctcgccgacgcgcccaggctcctggagctgcgcctcaacgacaacaagtttcagggcaagatcccggacctgaaacaggaggagttgacggaagtcaacctcgcaaacaatgagctcgagggggagatcccggcgagcctcaaatccatgacatcggacatgtttgccggcaacaagaagctttgcggcccgccgctcggtgccaaatgcgaggcccccccgacgccgtcaccaaaggcgcatccgcaggcctccgtcaaagaaggcaccacgccgtcacaagcagcagcagacaccgtggcatccacgggcgcgtcgtcagcagacgacccgaagcaagacgaaggccaggagcccgtcgagggctccatttcgttcggcgtctccgccgcgttgcttggcacgcttttgatcgccggcgtggcgttcatcgcgctgcggaggcggagggggtacaaaaccaagaacttcggcccgaccgcgtcgtcgtctcgcccctcggggccgccaagggtcgagccgcacccgccggcggcaaaggcgcccgccgccgccgggggcgtggcgcacggcggcggcgcggcgcggaaggcggagcaggggcgactgacgttcgtgcgcgacgaccgcggccggttcttcgagctgcaggacctgctcaaggcgacggcggaggtgcttggcgccgccaacctcggcgtgtgctaccgcgccacgctcacgacgggccagtccgtcgtcgtgaagcggttcaaggagatgaaccgggtgggcagggaggacttcgaggagcacatgcggcggctgggccgtctcagccaccccaacctcctcccgctcgtcgcctactactaccgcaaggaggagaagctgctcatccacgactacgtccccaaccggagcttggcgaacctcctccatggcggcggcgagagcggcgggatgaagaaggcggcggtgcactgggcagcgcggctgaagatcgtgaagggcgtggcgcgggcgctcagctacctgtacgacgagctgtgcatgctcacggtgccgcacggccacctcaagtcgtccaacatcctgctcgacgcccaccacgggccgctgctgacggactacgcgctggtgccggtgatgaaccagtcgcacgccgcgcagctcatggtggccttcaagtccccggagcggaagcagttcggccgctcgtccaagaagagcgacgtctggtgcctcggcctgctcatcctcgagatactcactggaaggccgccgacctacgacccgcccaaggcggcggcgccctcaggcgagctgtcgtcgtcccagcagaagccggggccggcggcgggcaacaccgacctggtgaccgtcgtggggtcgacgccggagggcgagtggctgaacaccgtggtggaccgggacctgcggggcgaggaggaggaggacaaggaggagatggtgaagctgatcagggtcggcatggcgtgctgcgagagcaacgtggacaaccggtgggagctcaagaccgccatcgagaggatcgaggagctcaaggcgaaggagcgccccgacgaggagcaagcgacggtgatcgacgaggactacagcgatgttgccctcaactgatcatcgacacgaaccggccgggaatcgatcgatagggagggttgtgcgcaagctgatgatatgagcccaaaatgtgatgacctgcatgcatgccgagaccctaaacatggactagtactgtgtattcttatatacctttgctggttgttaattgccggtggtaggtttttggagagaaaagaagctacttatatataatcacacagatcttagtttgcttttctcagtgaacagaaatctattacaaagcatctggtggac

SEQ ID NO: 222 - DNA, 3100 bp, Hordeum vulgare
  misc_feature (435)..(734): n is a, c, g, or t
  misc_feature (926)..(926): n is a, c, g, or t
  misc_feature (1069)..(1069): n is a, c, g, or t
  misc_feature (1927)..(1927): n is a, c, g, or t
  misc_feature (2403)..(2403): n is a, c, g, or t
atggagaccctcaacccggatgccgccgatggggcggcggcggcggcggggggtgcggccaggggcgaggcggaggcgcggaggccggagaaggccgaggctctgggcttggatccggagctcaccgtcgccaggatctacctcgggagaatcggtgctggtctgcaaaatcttgggaacacttgctacctcaactcggttctgcaatgcttgacgtacaccgagccgttcgcagcctacttgcagagtggaaggcacaagtcttcatgccgtactgctggattttgtgcactgtgtgctcttcagaaccatgttaagactgcgctacagtcaactggaaaaatagtgactccatcacaaattgtgaagaacttgcgctgcatttctcgtagcttccgtaattcgaggcaggaagatgctcatgagttaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcacgagggcgagcgctgcaggcagaaagttgtagcaaagaaaggttcacaattgatagggctccaaatgttttgacagttcatctgaagcgctttagccctttccgtccccgtgaaaagattgacaaaaaagtggattttcaacctgttctagacttgaaaccatttatgagtgattctaaaggcgcanattacaaatacagtctttatggtgtcttggttcatgctggttggagcactcaatctggtcattattattgctttgttcggacttccagcgggatgtggcacaatcttgatgataatcaggtacgccaagttcgtgagccagangtactgaaacagaaagcctatatgttattttatgtacgtgacagaattgggaacacattggggtgcaaagacaacatcactcctaatctgcctgtaaacaaagtgattcctgggaagatttcatctatcaatggtgcaatccgaagtggtgtaatggaagcaaaatcgagtggtctgacatctccttatgcaaataagaagttgcagagtacaagcaacgcccattctagcgttagcaatatgactttagtagaccattgttcaacaaatgatggcaaagctgaaactgctgcagcccctcaaaacagtgtcctgcctgccgcacagaaagcccttggacctcaaaatgatggtgttacattgtcaactaagtcaaagcaagttgcttcaagtaatcataaagagacatcttcatcaggtcaaccggcgagcagcaatcagacaatggctaagatgtcattgcaggaaccaaaggctggtggtgcatttgccaagctgggaaacaatacttctattgtctcatctatggtcagtggtcctgctggactgtcagagacagataaacaaacttcttgcgctcaaacatgttccaagccaagcttgaacttggttggcacgattaccgggtttaccacacaaactttccaaactaaggatgctgttgtttcaaatggtgtgatccctagcaccagcggtggaggtccagtttccagtgagaaaatgaaggacttaacaggatctctcaagcaagatgaccacacggtgaaggctttgacgacgagcaaggagaaaaccctactaccaggacttgagcaagttgatgtcggaaaacagatctcctcgcaagtttccacaaangtggttccaggcgattcatgtaatggcagaatgactaaaagggtggactggaagtcaaagaaacttgtgagatatccagtaattaagttgtggcttcggccaagacaattgccactaaagcaacaaaagaagaagcataagagaaccaaaaagcacgctatagtcaaggacacgaccagtgttgattgttctggtgacaacagcagtgagcagcagacatcaacatcagcaactgtgccgcccaaaactgcagaatctacatctcgtaagcggaaacattcccatgctagtgtaagttctgaaaatgacaccaaagcattcaaagatagccagcaggttgttggagcaagtagtgctggtgctggtgatcataacatggacaccaggaacagtaagagtggaacttctgctagcacagggcttccaaagttgggctcaagctcttctgcaaatcaagcacattcaagaaacaacgnagatgcaaagaggcaagtcgttattcacacagaggacttgagggcggaagttactgttccatgctgggatgatgttgccgtgccaaacaccgagactatagagtacagaagttcagggaagaagagcattggatatgtgctggatgagtgggatgaggagtacgaccgtggaaaggcaaagaaggtcagaaaagcgaaggaagacgaggacgacgacggcacgaaccccttccaggctgaggcaaaccacgtatcagcgcgaaaggagaaacaaagaccttggagcaagccggccagaccacgtcgctaggcgagctgaagagacgccgccccaagaagactcggtagaaagaaaagaaagaaaatgttgtatcgcctgtttttccaagacgccttcctttctcgccttgtttgttcccttttccgccttgttgttcgactcgacgtctcaagtagaaccgcactctttgatcgatcaggacctgcatttaattgtgagagattctttgtagcgtagtagccgtgggacatgccgccgtttttgtcgtagcatttttttggttcttgttactccagcagcacagctatggattatcatgaataatatgggttagccatcctttctgcagcggtttcagttgctggtacgtcgcaatgcaagtcgtatttctggtatatatatatatggtagaaatgc

SEQ ID NO: 223 - DNA, 1055 bp, Hordeum vulgare
  misc_feature (671)..(671): n is a, c, g, or t
ccccatcatgccgccgctcctcctgctcctcctcgccgccctcgccccggtcctctcccacgccgccgccggaggttcctacgacccggcgcgcgtcgcccagatctcctggcgtccaagggcgttcctctacagcggcttcctctcgcacgccgagtgcgaccacctcgtcgagctggccaaggggaggctggagaagtcgatggtggcggacaacgactccgggaagagtgtcatgagcgaggtgcgcacaagctccggcaccttcttgtccaagcgcgaggatgaaattatctctggaattgaaaagcgtgtagctgcttggacatttctccctgaagaaaatgccgagtcaatgcaggttctgcattatgaagttggacagaagtatgacgcccacttcgattattttagtgacaagaagaacgtgaagcgtggtggtcatcgagttgccactgttcttatgtacctgactgatgtgaagaagggtggagaaactgtgttcccagttgctgagggaagagatttacagcacaaggatgaaacgtggtcggagtgcgcgagacatggcctggcagtgaagccaagaaaaggcgatgcgctattgttcttcagtctccacgttaacgcgacgacagatccgagcagtcttcattgcgagctgcccagtnagtccgagggcgagaagtggtctgccacaaaatggatccacgtccggtcattcgacaatcctccagatgttatgacggacgcaccgtgttctgatgccaatgagcaatgccctagatgggctgctcttggggagtgttacaagaacgcaaaatacatggtgggcacgaaggacacactcgggtcttgccgcaaaagttgcggggtctgcgatgcttgaaccaccccaccaatcttaactgaatttgcatggttactgagacgtagattaccaaaccaagtaggttcttagtagcatggcatgagatgtttactcttcttgtcatgtagtttgacctcagattatcttgatatataaagcagaaaagaaattgacctgtattcag

SEQ ID NO: 224 - DNA, 729 bp, Hordeum vulgare
  misc_feature (392)..(392): n is a, c, g, or t
cggcacgaggcccggacagccctcggacgcggacctcggggagctgctcccggaggggtttttggagaggacaaaggagaagggcatggtgtggccgaccaaggctccgcagaaggagatcctggcgcacgcctctgtggggggcttcgtgacgcacggcgggtggaactcgaccctggagagcctgtggttcggcgtgccgatggtgccatggccgctgtacgcggagcagcacctgaacgcgttcacgctggtggcctacatgggcgtggccgtggccatggaggtggacaggaagaggaacaacttcgtcgccgcgtcggagctggagcgggccgtgaaggcgctcatggagcgcgactccgaggaggggaagagggcgagggagaagnccgcggagatgaaggcagcgtgcaggaaggccgtcgaggagggcgggtcctcctactctgccctggggagtctctccgaggagataatcaatggagcgaattagtaattcgagaatgccagggcgttgtggttgcaggctgcagttcttgttcttcctgctgatcattccgggttttgtgccggcatcgcgagcaatccgcatgcggtctctagacctaataaaactccatgctactacaaactaatccgtggttggatagtcagaagagtgtggtatcccatgtcagaattcaagtcctagacttgacattggtacttctattttcctgaatttat

SEQ ID NO: 225 - DNA, 453 bp, Hordeum vulgare
  misc_feature (403)..(403): n is a, c, g, or t
ctcggtgctggagagcctgtggcacggcataccgatggcgccgtggccactctacgcggagcagcacctcaacgcgttcgagctcgtcgccgacatgggcgtcgccgtgccgctcaaggtggaccggaggcggggcaacttcgtggaggcggcggagctggagcgggcggtgaggtgcctgatgggcgaggaggggaggacggccagggagaaggccgccgggatgcgggacgtctgccgcaaggccgtcgacaagggcggctcctccgacgctgcgttgcagaggctctcggaggcgctccaccacggcgcggtggccccgaccatatgaaaccgtgtaccgccgtccgccggcacacttataaatggagtgtatatttttctcacacgcaaaatgatgatngtactaaataaagttgaagtgggtggttggaacaccacagcacaacatta

SEQ ID NO: 226 - DNA, 802 bp, Hordeum vulgare
  misc_feature (742)..(742): n is a, c, g, or t
ctacacagtggggccgctccatctcacggtgcgcaacaacgtcccggagagagccccctcgccggcatcgggtccaacctatggaaggagcaggacgcgcccctccggtggctcgacggccggccaccacgctccgtggtgtatgtaaattttgggagcatcgcggtgatgtccaaggagcatatgctggagttcgcgtggggactggccaacaccggctacgccttcctgtggaacgtgcggcctgacctcgtcaagggcgacgatgaggccgcacttccaccggaattctccacggcgacggaggggcggagcatgctgtcgacctggtgcccgcaggagaaggtgctggagcaggaggccgttggggtcttcctcacgcactccgggtggaactcgtcgctggagggcatatgcggcggcgttccgatggtgtgttggcccttcttcgcggatcagcagaccaactgtcgttacaagtgcacggagtggggcatcgggatggagatcggggacgatgtgaagaggaccgaggtggaggccctcatacgggaggccatggagggagacaaggggcgagagatgagacgacgcgtgctggagctctgggagagcgccgtggcctctgcacgtcctggcggaaggtccatgcgcaatgttgatcggctcatccacgaggtgttgctagcctgaaacaagcaaattaagatggtaaaaataaaggatataaggcagaccttcnctgaaaagggatgtttgttggcagttttagttgcgacccaagattaaatgaggcaatttc

SEQ ID NO: 227 - DNA, 744 bp, Hordeum vulgare
tccatcagatattacacccttctcccatagtgcagctaccatcagtaatgctgctgctgttttggatgctctaactgatgatcctcaacagctagggatcaaagcctggaagaatgcccgcgatgcgaccgggtacactccagaggattacgctcggaggagagggcacacatcctacatccagatggtccagaacaaaattaacagggggttacctgcagcccatgtgtctgtttccatgaccaccactggtatcaccgaagagcatgcagatgcaggtcgtccgaaatcaactgatcagaccatatttgatgtcgagaaaagcctaccgggatgcagacaatgtgtccagctccagcacattgcctaccggccctgcccaaacaggttcttgtcgaacaggcctgcggtgctatccttggtcgccattgccactgtctgcgtctgcgtaggtttgataatgcagagcccgccggtcgtccgcggtatgccgggtccttttctctggaatcgcctccgttggggacccacttgaaacgcccaatcagctgcagattctgctagtctgtacactcgagagtgaggatgcttgtgatagaccaaagtgcaatctctgtacattatatgagttgtggagtgcctaactctgcttaggtagcagtagttctattggatattcgagcttttcattgttgtactgtgagtcagagaaacaatcacaaaggtggtgtctagagaaagcag

SEQ ID NO: 228 - DNA, 1825 bp, Hordeum vulgare
  misc_feature (1819)..(1819): n is a, c, g, or t
  misc_feature (1824)..(1824): n is a, c, g, or t
cagctgtcacacacccccactactgctctcacccaaacccgacccaaattgacataactccgcggcggccggcgcgatgcccgccgcggcattcgcctccgcgctcgcgtctcctcctcctccatgggccccacgaccgtcccctcggcacgctagcctccgcctgcccccgccaaggagcagcggcggcggaggggacaagcccaccacgtcgtgggtcagccccgactggctcacgtcgctgtcccgctcggtgctcggccggggaaacgacgactcggggatccccgtcgcctccgccaagctcgacgacgtgcaggacctcctcgggggcgcgctcttcctcccgctcttcaagtggttccgcgaggaagggcccgtctaccgcctcgccgcggggccgcgcgacttcgtcatcgtcagcgaccccgccgtggccaagcacgtcctccgcgggtacggcacgcggtacgagaaggggctcgtcgccgaggtctccgagttcctctttggctctgggttcgccatcgccgagggagcgctctggacggtgagacgtagagcagttgtaccatctctacacaaaagatttctctcagtaatggttgataaagtgttttgtaaatgtgctgagagattggtggaaaagctcgagacatatgctttgagcggtgaacctgttaatatggaagcgagattttctcaaatgacactagatgtgattggtttgtctttgttcaactacaactttgattccctcacatcagatagtcctgttattgatgctgtttacaccgcactgaaagaagcagaggctcgttctacagatcttttaccatactggcagattgatttgctgtgcaagattgttcctagacagatcaaagcagaaaaggcagttaacacaataaggaatactgttgaagagctaattataaaatgcaaggcaatcgtagatgctgaaaatgaacagattgagggtgaagaatatgtaaatgaggcagatcctagcatcctgcgttttttacttgctagccgtgaagaggtcagcagtttgcagttacgtgatgatctattgtcaatgttagttgctggtcacgaaacaacaggctctgtactgacatggactatttatcttctcagtaaggatccagtagcactaaggagagcccaagatgaggtagatcgtgttctacaaggtagactcccaagatatgaagatgtaaaagagctgaagtacttgatgcgctgtatcaatgagtccatgcggctatacccacatcctcctgtgctgatacggcgtgcactagttgatgatgtgcttcctggaaactacaaggttaagactggtcaagatattatgatttctgtgtacaatattcacagatcacctgaggtatgggacagagcagatgaattcattccagacagatttgatttggagggtcccattccaaatgagtcaaacaccgatttcaggtttatccctttcagtggaggtcctcgaaaatgtgttggagatcagtttgctcttttagaagcaattgtggcacttgcaattgtcatacaaaagatggacgttcagcttgtggcagatcaaaaaatcagcatgaccactggggccaccatccatacaaccaatggactgtacatgaatgtaagtctgcgtaaagttgagcaagaagctgacttagcactgagtccatcaggctaggcaaaagcaaagtaaagcagagcagggcgagattagtacaggcagcggcaacagaattgtcaataccaggttccagctatcatggctaataggtgcggaaactgnaaagna

SEQ ID NO: 229 - DNA, 1109 bp, Hordeum vulgare
gaaaagagttcatattggaaagaaatttactatatcctaatcctttggagaaggatctaacaaatgaagacaaggaagtttatcatcgatacaaggttttcatgcgtttcctttccaaggaggaacatgaagcacttgttaggagtgttattgaagagcgaaaaatccgtaggaggattcaagagcttcaggaatgtcgttcagctgggtgtcgtacgctggctgaagccaagatacacatagagcaaaagaggagaaaggagtatgaggcgaatgccctgaaagctaaggaaagtggccagcttatttcaaatagtaaatcaggacacaaaacaaaccggcctatgaaagttgagactgatgggagtttggatcttaagaaaggtagtgccattttggatgctggtggtagggattctccaaaaagcacaggaccaacaagcgctaagcaatgggatgattgggacattgttggtcttcctggggcagagctattaagcgtcagcgaaaaacttctgtgctgtcagaacagattgctacccagtcattatctgagaatgcaggaggtgttgatgcaggagatgttcaagggcaacatcgtcaagaaggaagatgcccatgtattgtttaaagttgaccctgccaaagtcgatacggtttacgatatggtgacaaaaaagctgggtaacaacgaggaggctccgatggtttagctatgcaatttgggctctgcctgctctaggcttggcccagaaccaaatcttggtttctcagcacgacggaggcccaggtgagaaaggaggctatacttacatgacttggctgtagcagtgttacattgagatttgtgtcagatttctgaaggaagtgcaataaggcattcgagccaaattgtaaaattacccggcagcgggaatgtgtagcgtgagttgttgccattgctgtttgatttttaaagaggagatagacgccattgctgttgaaagtgtactgtgatgatgatgatgtgatagtgcctttgttgtaggtttaggggactgagaatgatgtaccatgtatgtaaacatttgtccattttatttatgataatgcggattcatgtgcaacca

SEQ ID NO: 230 - DNA, 550 bp, Hordeum vulgare
cctggacaggaccaaggacagagggctggtggtcatgtcgtgggcgccgcagcgggaggtgctcgcccacggatcggtgggcgggttcgtgacccactgcgggtggaactcggtgctggaggcggtcatggcgggcgtgccgatgctggggtggccgctgtacgcggagcagcggatgaacaaagtgttgttggtggagggaatgcagctaggcgtggcggtggaacgaggcgaggatggcttcgtgacggcagaggagatcgagaggaaggtgacttggctgatgggttctgatggcgggagggagcttcgggagcgtactctggcggccatgagaggggcaagggaggccctgagcgacggtggggattccagggcggcactgctgcagctcgtgcaaaggctgagcgcccccgatgtgacggaggagagtgtttgccagctgtagcttgtgcaaccgtgaatgaacaggctctttttcttttcgaatcaatgattacgaaaaactgtctttatatatgacaaaacctaataaagcgacagatttgct

SEQ ID NO: 231 - DNA, 822 bp, Hordeum vulgare
  misc_feature (627)..(627): n is a, c, g, or t
ggctaccgcgtgcccaagggcagccacgtcctcctcagccgcctcggcctcggccggaacccggccatctggaacgacccgctccgcttcaaccccgaccgccatctggaaggagcaggcggcaacctggagctcaccgagaacgagctgcgcttcatctccttcagtacaggccgccgcggctgcgtcgcccccatgctcggcacggccatgaccgtcatgcttttcggcaggctcctccatggcttcacctggtctaagccggcggagatgccggatattcagctcaccgagtcccacaacgacctctccatggctaagccgctggtgctgcacgccaagccacgcctgccgctgcacctctaccgcccgtgaattcgatcgtcgatctccctcaagttactactccactccctagtagtgtagttaataataaccggacctgctactgctcatgtccatgctcctgtccggccggaacaatattgatccattaataagtttgttgtcatctttcccttcacacacactagaccactttgattccgagtaataataatattatttagggagaattatccttttgcccaaaattgtgtctgttttgccctcagttgtgaatcgtgntcagttttgtccctagtctgtccgcatcgattcattccgtgaacactgtcgtaaatcaacaccagaactgtacatgggtgttagattcattccaatgttaatcgcatagcgatgtaagactagattattgactctagtgcaagtgggagactgttggaaatatgtcctagaggcaatgataaaatagttattctt

SEQ ID NO: 232 - DNA, 575 bp, Hordeum vulgare
cgccgggccattgtccgccgacttctccgtaacgggttccgatctcaggctcgcgccgttcgggtccggcaggcggagctgccccggcaagtcactcgcgatggccaccgtcggattctgggttgccacgctgctgcacgagttcgagtggacgccgccgccgccgtcgtctgccgggccaggtggcgtggacatgtctgaggtgctgaggctgtcgtgtgagatggcagctccgctagaggcgaggctaaggccgaggcgtactgtgtgattacgtgcttgcttggggcagccatgtgagcagttggcctcttcttcccttctgtactactatcagtatcagtgcgtgtagtgtagtggtaatgtagtgtctcgcttttggaaatgtgcccgctactacaataggtccggtcctcgtatgtgtaccgctgtcgtttactgttcttaactgggtagacgtttacttacgtagttatcaactactgccgggaggtgagtgtcacaaatttcttgtgcttcctgtttgctgcctagagatgtactatttctactatgtaaaaatatttctttatcct

SEQ ID NO: 233 - DNA, 625 bp, Hordeum vulgare
  misc_feature (503)..(503): n is a, c, g, or t
  misc_feature (572)..(572): n is a, c, g, or t
atagccacgcactaggcctctccatctcgtcgagcacttcattaatcgcacccatgtccatgcaacaacaacagcaacaaccgacgagtgccaaccttctcggcgccatgcctgcgtcctctatgatcagcatcgccttcacggccgccgtgggtaccgcggtcttattcgtcgccgtcgctgtggcgaggtacaaccggaagtacagggggctgaggctcccgcccggcccgcccgtgtggcccatcgtcggcaacctcttccaggtcgccttctctgggaagctcttcatccactacatccgcgacctgcggcgtgagtacgggcccatcctgacgctgcggatgggggtgcgcacgctcgtcgtcatcagcagcgccgagctcgtgcacgaggcgctcgtcgagaaggggccggagttcgccagccgccccgccgagaacaccacgcgcaacatcttctcctccaacagttcaccgtcaattccgccgtgtacggcgccngtggcggtcgttgcgtcggaacatggtgtccgggatgctgagcacgtcgcgtctccgggagttccgccngcgaggcttcgagccatggaccggttcgtggcacgcatgcgcgccgacgccgc

SEQ ID NO: 234 - DNA, 1499 bp, Zea mays
cgatggccgccgccgactcctccccgctccacatcgtcattttcccttggctcgcgttcggccacttgatccccggcctcgagttcgccgagcgcctcgcagagcacggccagcgcgtgtctttcgtctccacccagggcatcctccgcaggctccgcccggtcgcgcccgcgttggcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgcaaggtggactgggtgctcctcgacaacttccacgcgtccatggcggacgtcgccagcgagcacaaggttccctgcatactgaacatgccctactccgcggcgacgacagaggatttcggcattccagacccgtcggttctaccaatgttccggccatttgtggagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgttgtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatgctgagtgcactcaggcagcatacttggcaatggcattggcgttacacaagtgatccgctggactccagctaatagtacgatgtatcttattttgctgcaatatgtaactttatcattgtttggttgtaaaaatatttgaatttgtttctcgtgaattgcatgaaagttattcatatctatcattacaaaagctgactcgaaat

SEQ ID NO: 235 - DNA, 1901 bp, Zea mays
atgggtataatgcgagtcgcggacgatgtggaggccaggttggtggtcggggcaggtggcggcggcgggaccgccaccaccacgacggagccgcttctccgccactgccacggcggccgcaaggaggaggacgaccaggggtctaagatccgggacagcccggaggcggagggggcgtccgactgcgggaggacggacggaggctcgctgcggatggtccttgtctccaccgccgtcgccgtctgcggctccttcgagttcggcacctgcgtcggctactctgcgccgacgcagtcagggattgtagaggaagtcgggctatctatctccgagtttgcaatttttggatctgtactgacagtcggagcaatggttggtgccgttactagtgggcgcttggctgattttctcggacgaaaaatggtaaaatcactacgctgtcaactgaggccaattttcttaaccatgcggatatcagctactatttgtatattcggttggctctccatacatctggccaagagcgctatcatgctctactttgggagaaccttgctgggtttcagcactggagttctttcttatgtggtgcctgtgttcatagctgaaatagcgccaaagaatctccgcgggggtctcgcaacgtcaaaccagctcttgatctgttccggaagctcagctacctacatcataggagccctggttgcatggcgcaatttggtacttgttggtttagtgccttgtgtcctcttgctagctgggcttttcttcattccagagtcgccaagatggctggccaatgtcggaagggaaaaggaattccacgcctcattgcaaaagctgcgtggagaggatgctgacgtatcagaagaggcaattgagatcaaagagtatattgaatcactctatagccttccaaaggccaggcttcgagacttatttctgagcaaaaatatatatgcagtcattgtgggcgttggcttgatggtttttcagcaactcggagggataaatggtgttggcttctatgcaagttatatcttcagttctgctggattttctggaaaacttggaaccatcttgattggcattattcagattccaatcacattgtttggggccatactcatggataggagtggaagaagggttctcctgatggtctctgcatctggaacatttttgggctgcttcctcacaggagtatcattctatctgaaggcacaaggactgttctcagaatgggttcccacactggctctttccggcatactggtttacatcggggcatactcaattggaatgggtcctgtcccttgggttgtcatgtctgagatattctcaatcaacatgaaagcaactggtgggagcttggtgacccttgttagctggctgggctccttcgcgatttcttactcgttcagcttccttatggactggagctctgcaggtaccttcttcatgttctcttcagccagcttgatcactgtactcttcgtggcgaagctggtccctgaaaccaaaggaaggacactagaggagatccaggactcactaaacaccagaagatagtaatgaatttacttcacactacagaataattaattctaagatggaaaaaatgggaatttacaggacacagcagaataattccaagatggaaaacgaatgtaccgtcagacctctgctcatcgatagatatgtatacaagaaacaatatatataattctcacgtcctcccgcttcccctccctttctctcccgcaccacctccgtgtaatacgtagtgtactgtgtaccctatgtaggttaaggaatgctgcagattcagattacgcattatgtaccgtgcccctccagattgtttgagcatgagcagcgacagaaccgacattatgttt

SEQ ID NO: 236 - DNA, 1538 bp, Zea mays
ctcacctgcgcgcgcgccatgggacctgcgtgcaaaaccgcagcgcggccgcgcgtgctgctgctgtgcagcccgtgcatggggcacctcatccccttcgcggagctcgcgcggcgcctcgtggccgaccacggcctctccaccacgctcctcttcgcctcggctacatccccgccctcggagcagtacctcgcggtggccgccgccgtccccgacgccgtcgacctcatcgcgctgccggcaccgccgccagacgcgctgcctcccgccacggccgcgcgcgagcgcgcggagctcgccgtcgcctccaacgtgccacgcgtccgggagatcgcgcgggagctgggcgcggcggcgccgctcgtcgcgctcgtggtggacatggtcggcgcggcggcggcgcgcgacgtggcggcggagctgggcgtcccgttctacgccttcttcacgtccccgtggatgacgctttcgctgctcctccgcctccccgagatcgacgcagcccgcgccggggagcaccgggacgccgcggagccgatccggctccccggctgcgtgccgatccacgcccacgagctgccgacgtccatgctcgccgaccggagcagcagcgcgtacgccgggttcttgtccatggccaagggcgtcgcgggagtcgatggcgtccttgtgaacacgtttcgtgaactggagcccgcggtgggcggcgacggtcgtctgcagctgccggtgtacccggttgggccattggtttggaccaggccggccggcgtggacacggaccacgagtgcatgagctggctggacgggcagccacgtggctccgtggcgtatgtgtcgttcggcagtggcggcacgattacatggcagcagacggctgagctggcgctggggctggagcttagccagtgtaggttcatctgggctatcaagaggccacaccagagctcaacaatcgcggcgttcttcgggactcaaagaggcgatgagcacagccccttggattttttacctgaagggttcatggagaggactagagggatggggttggtggcccagtcttgggcgccacaaacagctatacttggccacccttccattgggtgcttcgtcacgcattgcgggtggaactcggtcctagagagtgtgatcaacggtgttcctatggttgcttggccactctacgccgagcagaacatgaatgctgcgatgatggaggtccaggttggtgtggcattgcgggctaaggtcggagctgatcgatttataaggaaggacgaagttgcgaatgcgattcgacgtgcgattgtaggggaggaagctgaaaggctgaggaagcgatcaagcgagcttagacgccaatcagcgcaagctctgagcaaggatggttgttctactcgtgctctagcacaaattgcaaatgcatggaaatgcgctagcagaaaatgaagaaaactcggcgttatgtttgcagctctatcaattatcgatggtaattttgtgctagatgacgtatttattgaatatgtctatttgtc

SEQ ID NO: 237 - DNA, 2509 bp, Oryza sativa
aattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacgttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatcaacttgtcggggcttggattaagcggcacgctaggttatcagctatcgagcttgaaatcagtaaccaaattcgatgtcagcaagaacaatttaaatggtgaaatcccataccagcttccaccaaatgtggttcagttaaatcttcgaggaaatgccttcagcggtggtgttccttattcgatatctcagatgactgatctggaaacgctaaatcttggtaagaatcaattgagcgggcagttgacagatatgttttctcagctgccaaagcttacaacaatggatttgtcattcaatagcttctcaggtaacctgcctccgagttttcaatacctcaagaacctcaaaacactagatgtggagagcaaccaattcagtggtcatataaatgtgctggccaaactttctcttgaggatctgaatgtgaagaacaacaagttcactgggtggatcccaagtaaactgaagagcattgacaatttagagactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggcccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtacctacatgaggtctgttcacctccagtgctccacaaaaacataaagtcttcaaatgtcttgcttgatgctgatctcaaccctcacctctcggattgcggcctttcattcttctatgaggacgcaagtgagaacttgggacctgggtacagtgctccagagtgctcaagaccatcagcttacgtgatgaagagcgatgtctacagcttcggagtcatcatgctggagctactaaccggccgaaagccttatgatagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactactta

SEQ ID NO: 238 - DNA, 1672 bp, Hordeum vulgare
  misc_feature (1050)..(1050): n is a, c, g, or t
cctcacctcacctcacctcaggaagcgcaccgtaggttccggaacactccagagccccgccgccgccgcccctccatctccaccacgccacggccgaccaaggcgaggaggagagacccatcaaaccaacgagagcactacaaaaagaaaggggaggagccagagtccatacaacaaccactactgcctccggcggcagcccacggaatcgtcctcgcagcaccagcggctctccggcgacaagcgcgaggaaatggccaaggaaggagctggaggcggccccgactggaacggcctgctcaagtggagcctcgcccacggcgccgacggcaccaacccgccccgcgcgctcagcgaggaggacaggaaatggtttatggaggcgatgcaggccaacacaattgatgtcgtcggcaggatgaaggagatcgcccaggtgatgaaaacccctgatgatgtgttgcagtctcatggcgtcactccagggaacattgaagatatgcttgatgagttacaagagcatgtggaatccattgataatgcaaatgatcttcattctattggtggactagatcctctacttggttacttaaaaaattcacatgctggcatccgagcaaaggcagcagaagttgtgagtacggttgtccagaataacccgaaaagccagcaacttgtcatggaatctaatggacttgagccactgctgacaaacttcaggtctgatcctagcacgaccgcacgcacaaaagctctgggagctatctcttctctgattcgtaataatcagcctgggcttgccgcatttcgtctaggaaatggccatgctgcactgaaagatgcacttggttctgatgatgctagacttcagaggaaagcgctgcatctcacgcagtacctcctgaacaacaaggcggataggagcgtcgctgaagagatcggtcttccgaatcaactgatacacctcgcatccagcgaagattctggagtccgagaggctgccctaggtggcctcctcgagctggcgcgtgacaaggcaccagttgcccncaacgctctacctgaccaagacaagctgaaggacgtcctgaggagccgaatcgaaggcatcagcacaatggacgccgacgacctccaagcagcccgtgaggagcggcaactggtggactccctctggaaggagtgctatggcgagccgtcgtctctcagggagaagggcctggtggtgctccccggggaggatgagccgcagcagccgccgccagacgtcgcggggaagatgtttgagccgccgctccgtgcgtgggccgcgccgaggccttcttcggcggaggactccgattcggccagcgggaagaaggatccgcccctgctgctaggcccgtgaggccgtgaccgtctccggctctagttcttggtggaacccagcggatattttgggaggccgaagagcgtgcgttgatggtagaagtctagcgattctgcctgtaggaacctttatttgccccaatggttgtactacgctggtcagatgtgcggttgattcgagtgttttttcctgcaaatttcacagatgcttgtgttattatcctttgcctcttgagcgatgatactgctatacacttgttatacagtagacacaatctgcaagggaaagtacactgaagtcatc

SEQ ID NO: 239 - DNA, 3509 bp, Oryza sativa
gcagtctccactagcctccctaaaacgaaaaaaaaaggaaaaaaaaagaaaaaaaaaaactgcggcgagccggagacgtggctccccgactcctcgcgcgcgcggccggcggcgagaagggcggcggcggcggcggggaaggccatcctcccctcatgagcggcgtggcctcctcgcgcgcgcgtcgggggagcaggcaggtctggaggggcgacgccgccgacgacatccttccgtctcggttcggatcggattgaaggaatgcatgaggaaccactgaagatttattggtggtaatggagaatgatcatggagatctagatgatgtgggatcagggtggcttgaagtgaaaaaaaaacaccgatccagctcaaaattcacattgcagaggtcttcaggaggttccaatgataataaaatttcaaactcgtcctcacaatctcagaccaactttggcagtgatagtgcaaagtggtgtgacaggttacaatgctcacctcagatcacaaaggttaatgtttgcgttaatgaaccgggtagcgtagtcacaatggttgttcatggtgaagaatgtgctcatgcagatgctagcaatctgaagagtgaattaagtgtttcagcctcggatcatgcaatagaaaaacctaaaaaactgctagtgactgaagaaataagtgaacctcccaacgttggtaagattgactgtgctgattctccaactccacatcaatcctccaactgttcaagtggtcttgcaaaatcttcaggtttttatgatcatgttaaaggccctccaatgacagatagtataggtgttttatcgaacacttctgtcaggtttggtgattttgatgaagtgccaggtctagcattacctgcagatgcatgtagaaataatagttcatctcaaaaacacatacacattggcgatgctacagaattcataaatgaatgtaaagatgaaagtgaacttaaaactgagccgaattcttgtaaaacaattgttgagacatctcctgttattattcaaggggcagaaacgcccactgaagatgagagcaaggtattggatatatgtgaaataacagataatcgtttggatgttagtggttcaccttccttggacgacacagtctccttgtcctgtgcaaacaatgatcttgaagttccagttaagtcgtcttctgttgcttcaacagaaagccagacagttcttcatgcaccaacttcagcagattttggaggtgaaactgctggaagcaaagaaaggttcaggcagagactctggtgttttctttttgagaatctgaatagggctgtggatgaactttacctcctctgtgagttagaatgtgacatggagcaaattaatgaatccatccttgttcttgaagaagctatatctgattttcaagaactgaaatccagggcggagcattttgataacaccaaaaaatctactgctctaccaaaggaggggatgccaatggctgtgaaagctgaccatcgaagaccacatgccttgtcttgggaggtcagaaggatgacaagttcaccacacaggcaagagatattgtcttcatctctagaggcatttcagagaattcaattggaactggctcgcaaacaagctggtataacaacagagagctttgcatccagctcttctggagaagtttctggtagctcatcaaagctaaccacagcatcagcgactgttggaagtataagtttgaaagtggagagtcaggtgaaactttctgacactgagaaaaaaattgctggagagaggcaaagcaaggatacaatcaagtcaggtagatcacctccacaaaatatgccttcatcttctgcaaagagtcgaaaaggatcactggaacctatctctgaggtagagaagcataattttaggaaggataaggaattgccagaaaacaaatttgacaagctcaggtcaacagatacggcaaaaaggactacagttcatactgagaaggagaaacaaaatgcagcaccacggaagtcattggatgcctggaaagagaaaagaaactgggaagatatactgaaatctcctgttcggagttctcgtgtctcccattcccctggtgttggcagaaaagtaccagagcgtgctcgtgttctacatgacaagttaatgtctcctgaaaagaagaaaagaagtgctttggacatgaaaaaggaagcagaagaaaaacatgcacgagctttacgaatccggagtcaactagaaagtgagagagttcagaggctgcaacgtacctctgaaaagttaaatcgtgtcaatgaatggcaggctgtgcgcagctcaaaactgcgagaagtaatgaatgcacgccaccaacgtagtgaatctcgtcatgaggcataccttgcccaggttgcaaaaagagctggtgatgagagtactaaggtcaatgaggtccgttttattacatcactaaatgaagaaaacaagaaattcttactgaggcagaaacttcatggttctgaaatgcggagagctgaaaagctactggtgatcaaaacaaagcaaaaggaggacattgcaagggaagaagctgtattggaacggagaaaaattcttgaagctgagaagatgcaacgtcttgctgaaatacagcgtaagaaagaagaagctattattagaagagaagaggagcgcaaagcatctagtgctgcacgagaagcgagggctgcagagcagcaacgtagaaaagagataagagcaaaagctcaacaagaagaggctgaactgttagcccaaaaattagcagagaagcttcgtgaaagtgagcagcgccgtaagtattaccttgagcagatacgtgagagagcttcaatggatttcagggatcagccttcaccttttcagcgccgctttccaagtaaagataaccaaaatcgttctagctcagctaatagtggagaagattcacaaataataagcagtgccaacgctgctgagtctggtgttaaatcattcaattccacgcaaatgaaacgaaggattaaaaagatacgccagaggttaatggctcttaagcatgattttgttgaaccactcataggcgaaaatacaggaattgtgcacaggtctgctctaggtactgcaaaagctaagttaagtagatggcttcaggacttgcaaagacttcgtcaagctagaaaagagggtgctgcgagtattggtttgattgttagtgacatgacaaaggtacttcttgtttgttccatattgtgttgtaataaagatgtttactaataccactttctttttattttggcacagtatttagaaggaaaggatcttgaattacatgcatctagacaagttggcttgcttgattttattgcatctgctttacctgcctctcacacttcaaggcctggagcttgtcaagtcactgtctacctactacgactgttgagagtgttgctctcgcttccagccaatcgaacttattttcttgtacaaaatctttta

SEQ ID NO: 240 - protein, 204 aa, Oryza sativa
MCEGEKKKDSSSGALYCVNLALRIVVLGLAVAAAALMATASQCTIFLYYGGPLHTITYKDFGPFVYLVVASSIGAFMEAIAIFLTICKKKDGTPAKVLLPLLDAAVPVLLYSATAAAFAAGDMSYCAVGKRVGVCTTAAAGNFCNQVHIAMYVSLAAGVALLVAEIVKHWPDSGKKKEGGGGGCGSDSDSDKSTPCHHGCHSKH

SEQ ID NO: 241 - protein, 492 aa, Oryza sativa
MKLRNTAITRANSACLPMEDCVGIKYSSVNEGEERKGGHGVPKVSIIPLIFLIFYEVSGGPFGIEDSVKAAGPLLAIAGFLLFALIWSVPEALITAEMGTMFPENGGYVVWVSSALGPFWGFQQGWAKWLSGVIDNALYPVLFLDYVKSSIPALGGGLPRTLAVLILTVALTYMNYRGLTIVGWVAVFLGVFSLLPFFVMGLIAIPRIEPSRWLEMDLGNVNWGLYLNTLFWNLNYWDSISTLAGEVENPKRTLPRALSYALVLVVGGYLYPLITCTAAVPVVREFWTDGYFSDVARILGGFWLHSWLQAAAALSNMGNFVTEMSSDSYQLLGMAERGMLPEFFAKRSRYGTPLIGIMFSAFGVVLLSWMSFQEIIAAENYLYCFGMILEFIAFIKLRVVHPNASRPYKIPLGTIGAVLMIIPPTILIVVVMMLASFKVMVVSIMAMLVGFVLQPALVYVEKRRWLKFSISAELPDLPYSNVEEDSTIPLVC

SEQ ID NO: 242 - protein, 574 aa, Oryza sativa
MATSWSVAFTIFFSCILLLETISSSASLDCSYGSAQVKILSSSVVSEQQNVYLFLKPFQSTRSCSARRLAGEFVNGVVVPNLRLNVTGVVVTANERQLGALRCTLESVQAELAVAGLGRSVKVSPELSLPSLRAMAKCRRRGEKHWRRVMEFVRRSGSFVVVEMGAEEKADLAVADVAAAFEEGVGVAFRISGRAARSAAEMARLIGDADKGRRWTGVLAEVASPSPRRELAAAARTTARDVFAPVTNPTTTPATNPVTVPATNPAMNPVTPGIVTVPSTNPATGYSNNPNLPPLYPEPTPVTMPDPTTTTTPTPFMNPVTAPTMPSPVTNPATTPAVTNPTTMPYPYPPQQGGVMPTTPTYQPPATMPAAGGQTWCVAKAGLMDAALQSGLDYACGMGGADCTAIQPMGACYNPNTLQAHASYAFNSYFQRNPSPASCDFGGAGMLVNINPSSGTCLFQASSAGYGAGYSPGVTGTVPVGGGAGAGAGVGVGVTPMGPAVGGTGGAGVTPMGPAVGGGSGSTVLNANSPGGNSMYGSDSNPTSLTGAAAAALSSGWVLCLVWIFTFAYVKEKV

SEQ ID NO: 243 - protein, 529 aa, Oryza sativa
MASSAAAAFYRDREDAAPPSSGPGGGGAMAAYDPSYVPDSVKTFVSHLYRHIRDRNVYETHQMYEGGFTRLSDRHFRDTPWPPAEAVAAHCDGDHVFLLLYRELWFRHAHARVQGLTPAQRAESWDNYCSLFSVVLQGVVNMQLPNQWLWDMVDEFVYQFQSFCQYRAKLKNKTHEEIALLKQYDQAWSVYGVLNYLKALVEKSMIGEILEREKVGLEQFTATDGYDYEGGSNVLKMLGYYSMIGLLRVHCLLGDYHTGLKCLAPIDISQQGVYTTVIGSHISTIYHYGFASLMMRRYIDGIREFNKILLYILKCKQYHQNSPQYDQLLKKNEQMYALLAICLSLCPQDKLIDENVGTQLKEKYGDKMTKMHRYDDEAYAIYDELFSYACPKFITASPPVLREPYTNYNQDAYRLQLKLFLYEVKQQQLLSGIRSYLKLYSTITIGKLAKYMDVDEVTLRTILMTYKHKMHSIDSDGKVISSADFDFYIDEDIIHVVESKLTKNHGDYFLRQILKFEEMITQLDKVQFD

SEQ ID NO: 244 - protein, 254 aa, Oryza sativa
MGREERFPVWEAALGAGVAAAFATGLVGVYLSMPDSDYSFLKLPRNLEELQILTGHLENYTSDYTIQVLVGYCSVYIFMQTFMIPGTIFMSLLAGSLFGQLRGVALVVFAASAGASSCFFLSKLIGKPLVFSLWPDKLMFFQKQVAKRREKLLNYMLFLRVTPTLPNTFINLASPIVDVPYHIFLLATLIGLIPASYVTVRAGIALGELTSLSDLYDTQSIALLFLIGIVSVTPTLLGKDEAQEKTTEIAVTAS

SEQ ID NO: 245 - protein, 1014 aa, Oryza sativa
MAFPSGKAYYLHLLLLAILPSLVARRGAAQQGGVDEKQLLLQVKRAWGDPAALASWTDAAPHCRWVYVSCDGGGTGRVTSLSLPNVAVAGAVPDAIGGLTALTVLNLQNTSVGGVFPAFLYNLTAITSIDLSMNSIGGELPADIDRLGKNLTYLALNNNNFTGVIPAAVSKLKNLKVFTLNCNQLTGTIPAALGELTSLETLKLEVNQFTPGELPGSFKNLTSLKTVWLAQCNLTGDFPSYVTEMMEMEYLDLSQNSFTGSIPPGIWNIPKLQYLFLYTNQLTGDVVVNGKIGAASLIYLDISENQLTGTIPESFGSLMNLTNLALMTNNFSGEIPASLAQLPSLVIMKLFENNLTGQIPAELGKHSPFLRDIEVDNNDLTGPIPEGVCDNRRLWIISAAGNRLNGSIPASLATCPALLSLQLQDNELSGEVPAALWTETRLITVLLQNNGHLTGSLPEKLYWNLTRLYIHNNRFSGRLPATATKLQKFNAENNLFSGEIPDGFAAGMPLLQELDLSRNQLSGAIPVSIASLSGLSQMNFSRNQFTGDIPAGLGSMPVLTLLDLSSNKLSGGIPTSLGSLKINQLNLSSNQLTGEIPAALAISAYDQSFLGNPGLLAAGAALVVLIGALAFFVVRDIKRRKRLARTEPAWKMTPFQPLDFSEASLVRGLADENLIGKGGAGRVYRVAYASRSSGGAGGTVAVKRIWTGGKLDKNLEREFDSEVDILGHVRHTNIVKLLCCLSRAETKLLVYEYMENGSLDKWLHGNKLLAGGATARAPSVRRAPLDWLARVRVAVGAARGLCYMHHECSPPIVHRDIKSSNILLDAELMAKVADFGLARMLVQAGTPDTMTAVAGSFGYMAPECAYTRKVNEKVDVYSFGVVLLELITGREAHDGGEHGSLAEWAWRHLQSGRSIADAVDRCITDSGYGDDAEVVFKLGIICTGAQPATRPTMRDVLQILVRCEQALQNTVDGKVAEYDGDGAPFLPIRGGSRRKQLSDTKGIDDGNGSLDSIV

SEQ ID NO: 246 - protein, 69 aa, Oryza sativa
MADEEPVDPKKYLEERCKPQCVKPLYEYEKCVKRVEKDDTGHKHCTGQYFDYWSCIDKCVAPKLLEKLK

SEQ ID NO: 247 - protein, 1070 aa, Oryza sativa
MAEKLRDLSQPIDVPLLDATVAAFYGTGSKEERNAADQILRDLQNNPDMWLQVVHILQNSHNLNTKFFALQVLESVIKYRWNALPTEQRDGIKNYISDVIVQLSSNEASFRQERLYVNKLNIILVQVLKHEWPARWSSFVPDLVAAAKSSETICENCMAILKLLSEEIFDFSRGEMTQQKIKELKSSLNSEFRLIHELCLYVLSATQRPELIRATLATLHAFLSWIPVGFIFESPLLETLLKFFPMAAYRNLTLQCLTEVAALQFGDFYNVQYVKMYTIFMMQLQAILPPGTIPDAYANGSSEEQAFIQNLALFFTSFFKNHMRILEASPENRAALLLGLEYLIGISYVDDTEVFKVCLDYWNVFVLELFEAHNQMEPAASVNMMGLQAQMLPGVDGTITAVQQRRQLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSSLATTIGDLEPHQIHTFYESVGHMIQAESDNTKRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHIGKQFVPPMMDPILADYARNVPDARESEVLSLFATIINKYKGEMLEDVPRIFEAVFQCTLEMITKNFEDYPEHRLKFFSLLRAIGTHCFQALIQLSSQQLKLVIDSINWAFRHTERNIAETGLSLLLEILKNFQASGFQNQFYKTYFLNIEQEIFAVLTDTFHKPGFKLHVLVLQHLFCVVDGLTEPLWDASSVPYQYTDNAMFVRDYTIKLLGSSFPNMTPTEVTKFVDGLLSSKHDLPSFKNHIRDFLVQSKEFSAQDNKDLYAEEAAAQRERERQRMLAIPGLIAPSELQDEMVDS

SEQ ID NO: 248 - protein, 160 aa, Oryza sativa
MATPTAQTAALLAAAAALFLLASAALPVVRSDAGGDGDVTAYDELRHRGFPLGLLPANVRGYTLDSGSGDFAVDLASSCRIVLPAGSYLASFSDRLTGRLDDRRISGLSGIRVRAFFRWWSITGIRADGDELVFEVGSVSAKFPARHFNASLECPAKADS

SEQ ID NO: 249 - protein, 69 aa, Oryza sativa
MDAVDSVVDPLREFAKDSVRLVKRCHKPDRKEFTKVAARTAIGFVVMGFVGFFVKLIFIPINNIIVGSG

SEQ ID NO: 250 - protein, 259 aa, Oryza sativa
MSTAVADVPPAAAYGFPGSAKRGKPEEVVVLMGKRRNEGFFIEEEEEEEEVLTESSSIGAPSPASSSIGENSGEEEGGDDEEEVESKLKAEDEQVGLGCLDALEESLPIKRGLSNFYAGKSKSFTSLAEATASPAAAANELAKPENPFNKRRRILATWSRRASCSSLATATYLPPLLAPDHAVAEGDEGEEEDDDSDDDERQHRGKNGGRRESAAPPLPLPPPRLTLHTQMGGMVRRNGTFRSPRSLSLSDLQNSGGSC

SEQ ID NO: 251 - protein, 345 aa, Oryza sativa
MRPAVSRAAFASVLLAPRAVGVAARCASSSSSAASPSVAAATYDHASFIKEVAATDPPEHLSSLLNVLQARGEKLVSPGAKRGLIPLVVPLAESPAGNLTSLLRWPTAPSGMEMPVVEVRNHGLWLLAKNVNQYIHRVLVEADINGYADDLWSAVGDTGKKLYTKGDFKESQMADLDAYLLKKVGLFPDVIERKTSRHFEKGDYVSALITGEFYTRDQFPGFGRPFVFNAEILKRVGRTTEAKDSARVALKSPWWTLGCSYEEAAELAGWEDEQIEFIREKVSEEGKREDLKKGKAPEQVVLDEAAFLMDLASVDGNWDDVVDRIAGCYREAGLDDIAKFIAYRE

SEQ ID NO: 252 - protein, 322 aa, Oryza sativa
MTAKGGAAPSPGGAGGLPNGRFFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 253 - protein, 172 aa, Oryza sativa
MTPTVATTTPAAAAATTAAAAEVKPAKRSVGLGLPALPPLLPGLASHGQPRVASFCKRLARNVVAMAAGEAPAAPLAANAEITEFINALKQEWDRIEDKYAVTTLAVAASLGMWSAGGVVSAIDRLPIVPGLMEAVGIGYSGWFAYRNLLFKPDREAFFAKVREVYEDIISG

SEQ ID NO: 254 - protein, 164 aa, Oryza sativa
MALRLWASSAANALKISCSGATRAAPAYSISRYFSTVLDGLKYSSSHEWVKNDGSVATIGITDHAQGHLGEVVFVELPEAGAKVSQGGAFGNVESVKATSDINSPISGEVVEVNDKLSETPGLINSSPYEDGWMIKVKPSSPSELDALLDPAKYTKHCEEEDAH

SEQ ID NO: 255 - protein, 132 aa, Oryza sativa
MVVLQPDPFLSELTSMYERSTEKGSVWVTMKRSSMKCQARLKKMAAKGEAVEYRCLVRATDGKKNICTALSAKEYLKFQASYATVLKAHMHALKKRERKDKKKAAEVEKIPEKAPKKQKKAPSSKKSAGSKS

SEQ ID NO: 256 - protein, 328 aa, Oryza sativa
MVLPVLAPLAGATAVAFLLFKFATVDGDFTLVSRGAPRREKVDGKVVWITGASRGIGEVLAMQFASLGAKLILSARNKEELERVKHNIINKHPNSRVEVLPMDLSSGEESLKEHVHEAESLFSNAGVDYMIHNAAFERPKRRALEETEQGLKATFDVNVFGTITLTRLLAPSMMDRGMGHFVVMSSAAGKVPSPGQALYSASKHALNGYFSSLRSELCTKGIKVTVVCPGPIEAPQSSGATSSSQKPSSEKRVPVERCAELTIVAATHGLKEAWISYQPVLGVMYLVQYMPTVGLWLMDKVGAKRLDVAAKKGNAYGWNLLFGGKKSA

SEQ ID NO: 257 - protein, 459 aa, Oryza sativa
MATITTQLRSALLSPAASPSRRARRAPSSVRCDSSAASSLSASASLDADFDKKQFRHNLTRSDNYNRKGFGHKKETLELMSQEYTSDVIKTLKENGNQHTWGPVTVKLAEAYGFCWGVERAVQIAYEARKQFPDDRIWLTNEIIHNPTVNKRLEDMGVQNIPVDAGIKDFDVVEQGDVVVLPAFGAAVEEMYTLNEKKVQIVDTTCPWVSKVWNMVEKHKKGDYTSIIHGKYSHEETVATASFAGTYIIVKNIAEASYVCDYILGGQLDGSSSTKEEFLEKFKNAVSPGFDPDVDLVKVGIANQTTMLKGETEEIGKLVEKTMMRRFGVENVNDHFIAFNTICDATQERQDAMYQLVKEKVDLILVVGGWNSSNTSHLQEIGELSGIPSYWIDSEQRIGPGNKISYKLNHGELVEKENWLPEGPITIGVTSGASTPDKVVEDALQKVFEIKRQEVLQAA

SEQ ID NO: 258 - protein, 110 aa, Oryza sativa
MDANRRQSGIQQLLAAEQEAQQIVNAARAAKSARLRQAKEEAEREIAEYRAQMEAEFQRKVAESSGDSGANVKRLEQETAEKIAQLKQQAASISPEVIQMLLRHVTTVKN

SEQ ID NO: 259 - protein, 236 aa, Oryza sativa
MASSTSSSLAVATMVAVVLLLGATTQAARLLDELVPGIPMPTIPGVPAVGPTIPAIPTIPGVPAVGPTIPTIPTVPTIPGVPAVGPTIPAIPTIPGVPAVGPTIPTIPTIPTIPGVPAVGSTIPTIPTIPGVPAVGPTIPTIPGVPTIPTVPGVPELPVNPGGVVPTIPKVPLPPVNPGAVVPAVPALPVPPIPGAAGGVVPTLPVPPLPAVPGVPLPEVPGVPLPPVPSVVPPVP

SEQ ID NO: 260 - protein, 778 aa, Oryza sativa
MPHRRRLLNPAPSLPPPPAAAPAGFHHHLLAVDDTRLPLLADYALLQGDAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 261 - protein, 195 aa, Oryza sativa
MASMAFTLVGAFKGMSLSSPCHSSSSASFLRADRVSLSVGGGVGMGVPMTMPVRRLTIQMAHKKGAGSTKNGRDSPGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGIVEVQLVLAAADESPEVNADC

SEQ ID NO: 262 - protein, 291 aa, Hordeum vulgare
MGAGMVEVELGPGMGAAESVPPAKRRRVVALKTAASAAGRRPRRARRPSAIQRLFQACRAVFRGPGTVPAPAEVALLRAMLDRMRPEDVGLSSEMAFFRNRDAAAEGTPTITHTTIYKSEKFSMVLFFLPTNAVIPLHNHPGMTVFNKLLIGSMHATSYDWADPDDDPANESGASSADAQLRLAQLVVDDVFTAPCDTSVLFPTAGGNMHRFRAVAPSAFLDILGPPYSIEEDRDCTYYTDIPYSQHRMTGGELGGDEQEGRRLAWLKEVEMPRDLKMCSVRYGGPPISGR

SEQ ID NO: 263 - protein, 252 aa, Oryza sativa
MSMAREHFVLIHGEGHGSWCWFKLRWLLESSGYQVTCIDLAGAGVDPTDPNTVQSFEQYDKPLLDLISAIPEDEKVILVGHGSGGLSLIHAMHQFVDRIRQAIFVAATMLPFGLQTDEDKKDGLPTLPENEINLIFGTGADDPPTTAALRPEFQRERLSQQSPEEESVLASMLMRPWPVTAISTASFEGDDERLNRIKRVFIKTERDHMLDPQQQDSMIKKWPPSEVLEIDTDHSPFFSAPEQLFNLIVKSL

SEQ ID NO: 264 - protein, 708 aa, Oryza sativa
MATVTPGVLLKLLQAMHTDDRVAGDHRSPVLQVTAVVPALTASTADSLWPSNGFLLQLSDGLHSTYVQPSSADADALVSARPQLVGHLVHLDRLRFARPVPRAVGIRPVPSSRSVSFVGNPEPLVARPAACSRGYVIQPGSHSDSAPPLMPSSSGNAVQSDATDAVKRIVLAPKSVSEAAPPPAVSAAKRRFSSPAPSKQRDPSPSVKGGASRPSSPSVKGASRASSPAVRGTPRATSPAPSKCVVPSLVSAKEENRRTAREPAIIVPSRYRQPSPVGGRRGAASPAPGGRRASLSPSSRRLSGEGSSKKKVGVLVAGISKMTDLTNGSAVKPGRKSWDNTSIAAAAGSVMKSKVKVDKSTILRTQEAMARRLSDVTTELSSNDDDSSVDEKPKPRKKIESPAVKTKAMAPKIMLHDPKWTDGSIPLDGVSDVLSKMGKEATERRDAAAIAAADALQEALITESVIRNLSKFSELTSASKTSNPLPTVDIFLAVYEDTLKWKKIAESISTNRTETASWENSATHWVEAALATDLEVLKLMNKAPESLSRKRGADKPKAPSVVEAPRTTISKRQSHGTSAKVQSKVLPTSTASCAWNKTQGVNETAELATTLCREMHTWFLKFVDEAMDLGFHLFEDQNVASRGKQSSHITMVLSQFKKISDWLDGVGKIAEEATTKDKVEQLKCKIYGFVINHMGSAFDSSVSISSRN

SEQ ID NO: 265 - protein, 266 aa, Oryza sativa
MAAAAADPLVAGATVSSDSDSDSDDLHLLLPNLLPSAATAASDAQLHHFHLPALPSPITVRTLPSLGLTFQLWPSASTLLRVLPASPLLLSRAPTPESPLGILELGSGTGAAGLALAAALPAHAVLSDLPAALPNLRHNASLNAPLLDARGGSVSVVPLPWGDAAAMEAVAAPPPASRFDLVVASDVVYYEALVDPLIETMRFFVKGEVVFVMAHMRRWKRTDKKFFAKARKLFDVEVVHEDPPLEGWRHGPVVYLFTEKKRRDKK

SEQ ID NO: 266 - protein, 169 aa, Oryza sativa
MAAARFPLLVLCLLPIIVCSVVDAELTHLHFYFHEVDAGTPNATVVNVASLHRNSSTFGDVNVLDNALREGPDPASRLIGRAHGLAVHASLDETGGLTAINFVFSDYGAYSGSTLATQGHFITTGPSERSIVGGTGKLRFARGYMTSKLLSSTDTAIVVVFDMYFTLDH

SEQ ID NO: 267 - protein, 143 aa, Oryza sativa
MAKCSKIRYIVWLRQTLRRWRSRAAARAAAEAVPAGHVAVCVGGASRRFVVRAAHLNHPVFRELLRQAEEEYGFPSGAYCGPIALPCDEGLFEHVLRHLSSPSSAARFVTLEDIQSGALSCCCAAAGDALPLLRGIATDKAVW

SEQ ID NO: 268 - protein, 490 aa, Oryza sativa
MEPHVLLVSFPMQGHVNPLLRLGRRLAATGLLVTFTTVRLAAGGGRLRDVPEDGACADVGLGRLRFEYLRDDDDDGDERCQQLAPNDVLSHVTAVGPSALAEFIDGQADAGRPVTFVVNNIFVPWALDVAAGMGIPCAMLWIQPCSVLSIYYHFYESPEAFPTAADPDVPVELPGLPVMAMVELPFMVRPEYAQCLWGDTLRAQVGAIKRTVSWVLVNSFYELERSAVDALRAHTTVKLAPIGPLLEHGHDNGGGDDGAPAPALGAEDNDRCVAWLDAQPPRSVVYVAFGSLVNIGRDETAAVAEGLVATGRPFLWVVRDDSRDLVPEAVLAACRGDKAGKITAWCPQGRVLAHGAVGCFVTHCGWNSIMEALAAGVPVVGYPWWSDQFANAKFLVEDYKVGVRLPAPVTGGELRACVDRVMSGPEAAVIRKRAMHWKREAAAAVADGGSSDRSLQDFVDHVRRSKGPEELARLAQDIQIMNGPVNPVLV

SEQ ID NO: 269 - protein, 176 aa, Oryza sativa
MEEQQHLHPGGGGGKKSNKITEIVRLQQMLKKWRKLSVAPKDAAATAGNGGGGESKAKKFLKRTLSFTDGGASPGGTPPPRGHLAVCVGPTAQRFVIPTDYLKHRAFAALLREAEEEFGFQQEGVLRIPCEVPAFEAILKAVEKNKKDNAAAFCYCSYEYAADEVALGAPNNPLCR

SEQ ID NO: 270 - protein, 424 aa, Hordeum vulgare
MWDENEETDDEHGHDDDDVPSGSSEEGEPKFIEDKYRYSTVDEVITVLREAGLGSSNLIFGIDFTKSNDWSGKHSFGGESLHAISRTPNPYEQAISIIGRTLSPFDDDNLIPCFGFGDVSTCDHSVFNFYEEDRPCRGFEEVLDRYKQMIPYLDFSGPTSFAPLIYAAISVVERSNFQYHVLVIIADGQAATSKSYSILSPQEEETIQALVDASFYPLSIVMVGVGDGPWDEMKHVDDCIPDRAFHNFQFVNFTDIMSTSKDMEKKEAALAFAALMEIPAQYKATQCLQPPEWHEEMADPWMILPPPIEVLERDYAVAVSHFPAAPALSTGIGKDSSDEQVCPICLMNPKDMAFQCGHLLSLPSAALTGVGKGTSDEQLCPICLTNPKDMAFQCGHLTCKECGPTLSTCHLCRAPITVRLRLFS

SEQ ID NO: 271 - protein, 131 aa, Oryza sativa
MVSTMYKEAAATCGDGEHYSRLIRELCALLAAIISPSSSSSTAAAARSPGMSPAAAATMLLGASVALMLCGSVTFAIGLLLMPWVAGVALLFGLSAAVSTLSSGVFGKAAAAASSPVSHASSDNKPVLVVA

SEQ ID NO: 272 - protein, 469 aa, Oryza sativa
MMGSRRSRRVSWASGGNLCKVRLFLSEDSPSQAGLRPQDNLQAKGSWLLHAAGPSSDDSLPPGFESLPPSNDLKIDMSQIPLIRWKCPPHIVLEQDWHIVAGEESREIEIQNERINGALEAIYPRPSNIPPNPFLSLDVKDAHYDDSKTLLVPLIPLEDDDASDQLEGPTLDLPSHYNITGVSNTPVSAEQQPPCGGAISSGFTIEPQAAVSATVTAIMQTIQSNQNGSMADQNGSTIDQELLFKILSDPSQLQRLMKECGPVRHEQSASSSVVAPLVSIPPPQITASSPAPFSDHVGTFHGMNPTLPPPPPMMNRPPSTIPSVAMNHPPSSSPAMNFGSALPSSSPSVNFGSVPGRGVGYYKTLIHQHGGERLEQPFEQHGMQFGMYRQPGPPQNGGIDAMNGAAAMVSRDGKVRPMKPCAYFNSPKGCRNGASCTFLHDASAPTRKDHQKQKGSKRIKLDNTMGGRN

SEQ ID NO: 273 - protein, 570 aa, Oryza sativa
MTTTTTTTNHSAKSILLLALLLVPHLAAASSGDALISQRRRLLDYHGGGGGHGGGDVYVDPSYTFPNARLRDAYVAMQAWKRAVLSDPHNVTGTWIGPDVCAYEGVFCAAARDDPHLVVVASVDLNHADMAGHLPDELGLLADLAVLHANSNRFCGAVPSTLERLHLLHELDLSNNRLVGAFPDVVLRLPSLRYLDLRFNDFEGPVPAELFDRPLDAIFLNSNRLRFRIPDNVGNSPASVLVLANNDFGGCLPASVANMSGTLDEIILMNTGLKSCIPPELGMLTGLAVLDVSHNSLMGAIPGELARLENIEQLDLGHNRLTGDVPEGICHLPHLQNFTYSYNFITGEPPVCMHVKAFDDRRNCIPGRPDQRPAEQCQFQNTHHVNCDAFRCKKFVLPSPPPPPPSPPPPSPPPPSPSPPPPSPPPPSPPPPSPSPPPPSPPPPSPPPPSPSPPPPSPPPPSPPPPSPVYYSSPPPPYYEVSPEDRYLSPPPPPAYHEAPPPPYYEVSPEDRYLSPPPPPAYQETPPPPPQYEVSPEDRYLSPPPPSPVKWKLPVYEYSSPPPPAATWKP

SEQ ID NO: 274 - protein, 122 aa, Oryza sativa
MAKDPHVSISLTGLAMVVFLIFSSSFLQAAQGPDKKMVMKYDVPVKRLMYRPAAIGTEAAAYEPFELCMGCRCCASSNASSCVDTRCCYAIDCNIPGKPFGVCAFSPHTCDCGATNCTSQQP

SEQ ID NO: 275 - protein, 418 aa, Oryza sativa
MERRAQPVSAAVAPVTGRRKGAAASRKWMVVPAVGEERRVEFGKHQIMKMTGLPGRDLRVLDPVLSYPSTILGRDRAIVVRLQGVKAIITATEVLVPDHDDVLLASFLLDLRSRLSLPDAAPSTNPAAADRGNGTEQGDQGSVPGLAISGAGNAKIPPFEFKVLEVCLEHACKDLESQTRSLEKEAYPALDKLGSKVSTLNLDHVRNLKSRMVDLSGRVQKIRDELEHLLDDDMDMSEMYLTRKLSFQGLSGSLSRADSHKYASVDHDDDREEEDHDDETESGRESSVYVKPDIEELEMLLEAYFVQIDGTLNTLYHIREYADDTEDYINIMLDEKQNQLLQMGVMLTTATVVVTAGIVVVSLFGMNIHIDLMKDPETPEMVRMSNMHFWETTFGTVAGCIAIYLLAIYAGRKSKILQ

SEQ ID NO: 276 - protein, 233 aa, Hordeum vulgare
MAESNSYEEQRRRQIEENRRKLEELRVHHLSAAVREAAARPKPKPKPRPKPKAPEAGELRRSGRVASLPEQPNYLNDAEQRDYRGVYEAYAVRKGPTDEQRAGAIAKAEELRRRIHRSRCPAFVKPMSHSLAINEVHMRIPRDFRKYLPAAHGEAVVVVDEADDEFHMMYNAYKKRCHYLEKGWKGFAFDHDLVDGDCLVFHMTERAKFKVYIFRAKPDYKSDQTSDESGDEE

SEQ ID NO: 277 - protein, 219 aa, Hordeum vulgare
MAACAAPPYVRISCSTPSPTALRRPRRRRVPSARCSLAAAPGLRAPPELVDSILSKVRGTDRGVLLPEEGHQEVADVAQQLGKYCIDEPVKSPLIFGDWEVVYCSVATSPGGIYRTPLGRLVFKTDDMVQVVEAPDIVRNKVSFSIFGLDGAVSLKGKLNVLDSKWIQVIFEPPELKVGSLGFRYGGESEVKLEITYVDEKIRLGKGSRGSLFVFLRQD

SEQ ID NO: 278 - protein, 102 aa, Zea mays
MAASSKVVCACILIVLVISSHANARRLVAATCNGTEGGACKGGIFVQGYAGLSARQKMAATATSTEQVVGVGGEGMPATTTDSRPTAPGNSPGIGNKGKINN

SEQ ID NO: 279 - protein, 137 aa, Hordeum vulgare
MATLQLNHIARETGDVRRLAAFYEEVLGFERVPSHAYSGFQVAWLRLPASPDVALHIIERDPAVASPGAEGVPPSQLPRRHHLAFSVADFDGFLTGLRTRGTELFEKTQPDGLTRQVFFFDPDGNGLEVTSSSPGDK

SEQ ID NO: 280 - protein, 513 aa, Oryza sativa
MAAAAVARRVVLVLVLAAASLAAAPRGAAARSLGGREGPGEVDADAAVDLNATNFDAFLKASLEPWAVVEFFAHWCPACRNYKPHYEKVAKLFNGRDAAHPGLILMARVDCASKVNIDLCNRFSVDHYPFLLWGPPTKFASAKWDPKQENNEIKLIDDGRTAERLLKWINNQMKSSFSLEDKKYENENMLPKNASDPEQIVQAIYDVEEATAQALQIILERKTIKPKNRDSLIRFLQILVARHPSKRCRRGSAELLINFDDHWSSNLSLSSQEGSKLLESVAEENHWICGKEVPRGYWLFCRGSKSETRGFSCGLWVLMHSLTVRIGDGESQSTFTSICDFIHNFFICEECRKHFYEMCSSVSAPFRTARELSLWLWSTHNKVNMRLMKEEKDMGTGDPLFPKVTWPPNQLCPSCYRSSKVTDGAVDWNEDAVYQFLVNYYGKKLVSSYKETYMESLQQQEKKIVSEDSSISNAASVPIGAALGVAIASCTFGALACFWRAQQKNRKQRKNWN

SEQ ID NO: 281 - protein, 207 aa, Zea mays
MEGRRAAVSLVAAVSLLLACSRSPFPVVAADEGEPAVGAPDTNQLCVSKCGTCPTICTASPPTILPMTAPPPPALALLPLSAPPPPYLQLVLPPPPTGDVYDLLPPVTPLTSPPESPCTTPPSSSSSSTEPPPSPPSSSSPPSPPPPKSGGDGGSGSSSHFSSPPSSSNPYYYLYLSGGARARGGASSSACAALVLAAFLPAVALFK

SEQ ID NO: 282 - protein, 366 aa, Zea mays
MADRRSNGGSPPSWSFASQSSHYHLAAMRGSYAPQSLWRPSPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGLFNFNKDRDGYWRWFAGNIASGSAAGATSLLFVYSLDYARTRLTSDYRAAAKGGERQFTGLVDVYRKTLRSDGVVGLYRGFNVSVAGIVVYRGLYFGMYDSLKPVLLTEKLQDNFFASLALGWMITNGASLASYPLDTIRRRMMMTSGEAVKYKSSMDAFAQIVRNEGPKSLFKGAGANVLRAIAGAGALAGYDQLQLIFFGKKYGSGGA

SEQ ID NO: 283 - protein, 329 aa, Hordeum vulgare
MVWTTVQELAAAVEEPPRQYLVHEQDQGLLAADQMPEPIPLIDLSRLTADDEADKLRAALQTWGLFLLTNHGIEESLMDAMMGASRDFFRQPSEEKQKCSNLVDHGKKSELEGYGNDKVVNQDEGLSWNDRLHLRLEPEDERNFTKWPTHPASFRDVLLEYASRTKRIRDLVFRSIAKILDLDEDYFLNQISNKDPGFARFNYYPPCPRPDLVLGMRPHSDGGLLTIVFVDHDVGGLQVERDGKWYNVPAKPYSLVINLADCMEIMCNGIFRSPVHRVVTNAEKERLSLAVFYAVDGETMLEPAPGLLDDRRRPRYGKFKAKDFGLSLD

SEQ ID NO: 284 - protein, 351 aa, Oryza sativa
MPPVNSDGAGPSSGEDGSAAAVKKRNRPKYHRFTQQELQACKPILIPQTVILVLVFVGLIFIPIGLACIAASNKVVELVDRYDTKCVPRNMLRNKVAFIQNSSIDKTCTRVFKVPKDMKKPIYIYYQLDKFYQNHRRYVKSLNDMQLRNPKKVADTQYCSPEATANGRPIVPCGLIAWSLFNDTYSFTRGHGNETLRVNKDGISWKSERNRRFGKNVYPKNFQNGTLIGGGQLNPSKPLSEQEDLIVWMRIAALPTFRKLYGRIDMDLQAGDRVEVTMQNNYNSYSFNGKKSLVLSTAGWLGGKNAFLGRAYAIVGLACFLLALLLALLYFVFPMREEHLSLHYTPARLVR

SEQ ID NO: 285 - protein, 712 aa, Oryza sativa
MSDPGEPSKHSQWMSHWTKGSSSAEPQVGRSNDSPEDAKYDICEDNSGPSNFEIMKSRLFERLMVGISQERASLEHGQKLNSNMKVVVKDARRHAVQNQIDQGDGPIQKSVMQKDVLYAKAVVSKSLSIQKLSELSVDCQKLAGSDDLSSEWNHFPMLAINRKIDSILNPKRKSAKSTGPNDVFVPKQTLKLNMTTANLMAFSSQEYELHSHRTTDETMDHCKHAGGIVSRLEDHAGVMLNPAEQKLKGQLLPATSCSCSKDDSNSSDSLLDEQHTSRYIADSDQEPTCRSREKRLKSSENNDTNCKIGSCSQNQKSRAPGHHKHKGSAGVMFRTSVPGKEFEAAEINCSDKINQRHLNTQRIVSAANVTGSCIPDPAADISTVNGRGEAVTQPSSISGDSTKRKAPYLFEMLTIPSKAQNMNPEDSLPSGNSTAFGVHMYGTNIGSHLFGANNKSSTETEILSGDSQHVSKSSAGIASLLAQKAKSEQLATLYMKGASGCNVNEHQGVSSKAIVANKQQCYNPRTARMDLDLMQFQLSRMRNQESQARTEPGDRWLKRLQIDSKDPHHLPCSKRSKAGDGSGRPVTGGASSMAPRCDGSNDDDDIVDRDHKEEQGLDEGVEIQGGREASPVPAKSDDRWIGRWCQGGVPVYHEDDHDQRKEVTKPDLAAGDSGGLEGQFPSIKAMAMMGRAMSKVRPCQEERRGSFMVWKA

SEQ ID NO: 286 - protein, 175 aa, Oryza sativa
MSPMPSLLLVFLVASSAAGVAAGGGGGELKHIHLYMHETFSGPNATEGGVVASPFNTTFGQVAVFDNELRTGEDRAASPLVGRYQGFIVGTGRSSPGYLTSATVAFTAGELNGSTLSLEGPFFGFAGTAERSIVGGTGKLRLARGYYLLKLIGKTSPETAVSEIDFFVLMYSSTH

SEQ ID NO: 287 - protein, 331 aa, Oryza sativa
MASKQMEEIQRKLAVLAYPRANAPAQSLLFAGVERYRLLEWLFFRLLGDRSPFTQQNWQGDSLDRDEENSRIQHLAEIANFLGITPSVDTEAIQGRGSYDERVELLCLIVDLVEASCYADNPEWSVDEQLAKDVLLVDSIAEKQAQIFSEECKLFPADVQIQSIYPLPDITELELKLSEYTKKMSNLQLMVQELASKYDYNPNEDYAETELKLREHLQSFLETVKSFNMIYTKEIHPWTHMMEVPQLHGFGPAANRLLEAYNTLLKFLSNLRSLRDSYAAMAAGSLSASNEPSSVTKIISDCESALTFLNNSLSILSTSVAREQGETLNSQ

SEQ ID NO: 288 - protein, 297 aa, Zea mays
MGQRLLDRLAGFLLVVVVVVVLYGGTEQRIAEAADGANPHRLLATVSVSKPSYPTVVTTPMSAYGADPASKPSYSTFPSLATGNGGAGAGAGAGGGGAAAGSGGGGGTWCVASQSASPTALQVALDYACGYGADCSAIQQGGSCFNPDTVHDHASYAFNSYYQKNPAPTSCDFGGTATITNTDPSSGSCQYPSSSGGGGAQNMVPPPSPTTTMPPTVPSTVPMTPTPTAPDTGTPVYGLSPPDYSGSTSPPGYGSTSPPDYNDVSAAAARVRQQGGAALALTLLCVVVATVSLRVSK

SEQ ID NO: 289 - protein, 530 aa, Zea mays
MAAAAWWETLVVAAAADGTGGSSTTVVSICMFTTVLCLCLVAGHLLEENKWVNESITALVIGCIIGVIVFLLTKGKHSHILRFDEQLFFIYVLPPIIFNAGFQVKKKQFFHNFMTIMSFGVFGVFISGAIVSAGCYWLFPKVGFGELGAVDYLALGAIFSSTDTVCTLQVINQDETPRLYSLVFGEGVVNDATAVVLFNAIKDLDISRLKGGVVLKVIFDFLYLFATSTVLGISIGLVTAYVLKALYFGRHSTDREVALMALMAYLSYMLTELLELSGILTVFFCGIVMSHYAWHNVTESSRITTKHIFATLSFIAETFIFLYVGMDALDIDKWRTSKESFKTSIGIFGILILLILLGRVAFVFPISILSNIMSGSSERTPITFKHQVVIWWAGLMRGAVSIALAYNQFTFSGVTSDPVHATIITSTIIVVFFTTLVFGFLTRPLISGMLPHQSRALSRGHSTGSNSPKDDFTLPFLSGDEGASGSGIVLEQAKRSLSMMLERPVHTVHIYWRKFDDRFMRPIFGGPRSH

SEQ ID NO: 290 - protein, 288 aa, Hordeum vulgare
MVSAFFLFCGCVEQANVAVVEKWGRFLRLAEPGLHFFNPCAGELVAGTLSTRVQSLDVRVETKTKDNVFVQLICTIQYRVVKENADDAFYELQNPQQQIQSYVFDVVRAIVPRMELDSLFEQKNEVAKAVLEELEKVMSDYGYSIEHILMVDIIPDAAVRRAMNDINAAQRLQLASVYKGEAEKIHLVKKAEGEAEAKYLSGVGIAKQRQAITDGLRENILNFSHSVSGTSAKEVMDLIMVTQYFDTIKELGDNSKTTTVFIPHGPGHVKDIGDQIRTGMMEASSSGL

SEQ ID NO: 291 - protein, 244 aa, Hordeum vulgare
MCTLEQRGRVFVLTLTGDGEHRLGHPLIASIRSALASVLAAAQAQPQGPGAALVTVAEGRFFSNGLDIGWAGASRARLGELVDALRPVAADLLALPMPTVAAVTGHASAGGFLLALCHDYRLMRADRGVLYMSEVDIGLPLPPYFVHVLRAKISQAHALRDVVLRGKKLRAPEAKEMGVVDVVCPGAPETATEALKLAEQLAARKWDGAVYASIRMSMFPDACRAVGIAVESDEEKSKHFASRL

SEQ ID NO: 292 - protein, 237 aa, Hordeum vulgare
MAQCLRGKGGAAAVGEALRKVAPWRRAASASYHHTIQAVPRETAGPRAAARERRNGNVPAVLLTLAGPGPGEGVAHRKLLTTDKKQLAEMLKQSPYFLSTPVRLQVRAGERSTAVVHSGTVLPIKVQTDESTGNILNLVMVEADEGTMLKVNLPVVFKGEDVCPGLKKGGFLQKIRTSLVYLCPAEHIPPKIEVDLTNVDIGDRVLMQDIPVHPSLKLLSKNETMPVCKVLSSKPAE

SEQ ID NO: 293 - protein, 335 aa, Oryza sativa
MAMATAACRRPAVMLMAFAMAAAVTMSSVPPASGTTTLQYDFYSSSCPKAEETVRNVVEPMIFNDPTMGAAFIRLFFHDCFVRGCDASILLDPTSRNTQPEKTAIPLRGYDAVNKIKAAVEAVCPGKVSCADILAFAARDSAVVNGNFAFAMPSGRRDGTASSASDVARFIPSPAFHLQDLVDSFAAKGLTADDLVILSGAHSFGLTHCAFVTGRLYPTVDPTMNATFAAALKKLCPPPASGGGGRAVSNNQVTDPNVLSNQYFKNVAAGEVMFTSDQTLTSRDDTKAMVDDNAANPVAWMARFAAAMVKMGGVEVLTGNAGEVRKVCFATNTAS

SEQ ID NO: 294 - protein, 82 aa, Arabidopsis thaliana
MEGLIPLVYKAVMQIRYGNESQQLSSSYYVRLPGDSGRFVRSDLDVSGPGSNSSNRASSSTSTTTFAVYAGVQSPVSRQVVT

SEQ ID NO: 295 - protein, 108 aa, Arabidopsis thaliana
MATNNIVRLIAPSRSVSSRFLEPVSRFLSSGTPPPPQAPSPNQDLNRDVKPDQNLQQNLQMQKEEEEEGEGGGGGEFVNEDTGEIGGPRGPEPTRYGDWEQRGRCSDF

SEQ ID NO: 296 - protein, 202 aa, Hordeum vulgare
MSAKKGLSSTLRNLKFMQRAAVAQKVEDKADVEVEEVAAEVEVVMTPAANGGGVGSSVQVARKCVVVMEGNPHPGAVKGRMSFQNFNPSIDKLNDEASGRPTQSASPSNSQQDSANTSRVDDVSASRFRSFNVDSSESISLNELKRKEPELEMETPPLRKLPKTTGQNVDGRGSSQSNGRGSGKSNKHEKLDFNLLRKRKSK

SEQ ID NO: 297 - protein, 95 aa, Hordeum vulgare
MAATTAEAALLVLLLVTLGGAAKAQPPRGTCGAQLSQLAPCARYSVPPMPGQALPAPGPECCSALGSVSRDCACGAIDIINSLPAKCGLPRVSCQ

SEQ ID NO: 298 - protein, 110 aa, Hordeum vulgare
MEPASASLVSLRASTATNRSCFLCRQPVTPKTRMLPAMASKSGARLVASGCKTCRGKGAVECEGCKGTGRNKKNGNIFERWKCFDCQGFGMRKCPTCGKGGLTPEQRGER

SEQ ID NO: 299 - protein, 289 aa, Hordeum vulgare
MSPPPPLRPTPTYSLLLLLFFSLTASAAQPKGVCVSPGGRFPAFSSEGKPPGKAAKGRRDLALCRIFRQNTCCDVTQTFPALLSVRKLSSTGEGSGECLHLWELLECSVCDPRVGVRPGPPVICASFCDMVFKACSEAYFSIDMKTQALSPCGLGDILCGKAHKWVSNGTELCRLAGFSVQVSDASLSEVDETFCYGGKASLDSISDTWTSSKDRPALHGMPSWDLEDFQRWAKEMPVGERISWAVGGMVLTAGLIFISKREGYSRRRKQASVAQTVRKKWNRELTRSN

SEQ ID NO: 300 - protein, 339 aa, Hordeum vulgare
MGGGIFPLLEPWFVSLAVLGAVYSTAVVLRLLSHLTLLLRRPRNPRRRYGAWAVVTGPTSGIGQSMALELARLGLNLVLVGRDPAKLQDISETISKTHAVQTKTVLFDLALIATPQGDEAVRRLREAVEGLDVGVLVNNAGVAKPCALYLHEVDVEAWVKMMRVNLWALTEVTAAVLPGMVQRGKGAVVNIGSGSSEAIPSFPLYSVYAASKRYVAQFSRSLYVEYRSKGIDVQCQAPLFVQTKMTSIVAGSGKRRRGVLPRLMVPTSDEYARAAARWIGHGPICMPNLGHRLQWCLCRVVPDRLLDALRLRENLRQRAVFQRLRSPRSPSHANGGKQS

SEQ ID NO: 301 - protein, 369 aa, Hordeum vulgare
MELIESGLALMDISMGESSTKTRMKSIREAELTNLRRIRESQERIRRRQEQLLRDPQPPLRYEFEEEEEKAPTDEQETEEYRRMWEMCFRNNFGSIDAETSLGPIYCTGTSPADALPESCMQIFSIKVTDLNNGLSLPLEVHGFVAARDSVDHKRNYLFRCTRDNCQILTPKDPFLHLTGPSRAVLLIARVAIEVELKVKGKKESEDEVLAFKWFYFHEGYHLEDGIRFRIPSKRCMLEFALAVLPMSVEAIVGIRVVDGSWPDHCRGLVVCSTNSVKKGKVVLLDFQNGELPTKSDGVVELARSVVSIDYPEGELTVSVEASRDRFSARGTVGFGMKVPRGSITRTCDMVFCKMKVSVSWSLVSCYRV

SEQ ID NO: 302 - protein, 260 aa, Oryza sativa
MAAESSLVPQTSSESIAQKMGFFRVPDLLVKLSSKCLIELDAVRSPTSPLDLIFFPGLGAKSPRSSFLGDRVGLGLVDSLTDDSSTPLGSRKVLLGSEMRITDNVTSKNSFTAPVEAGVVDQKDESMCDDLKGSFMSLDDIVNSEDYTRVVCRGPNPRTTHFFGDHVLEFEGEQLMPDESKSEESLPPRLEEGMMSFCYFCGEKLEEGKDIYVYQGDKAFCSMECRENFMEDEMEEGEPDLSAPPSSPVANDGCIFQLIQ

SEQ ID NO: 303 - protein, 189 aa, Zea mays
MTTTRDRGAGGGSASRVGDGDVDLGEGWDWGAIPRLLSSACLFLCSGGCFGCCDKTVKQLGELSRNLITQDQITIGEPFWSTTTIEVEPADLSGVTSVNTSNLASGTGSSHNLPGLGNNGLVLWEHTRQEWTETRSLRLKVKQVREPVLSWNAAYESLLGSNKPFPQPIPLHEMVDFLVDIWEQEGLYD

SEQ ID NO: 304 - protein, 338 aa, Hordeum vulgare
MATTGSRSTLVLVYLTVAVLVSPALSAPLDGAGFHSATCPQLESIVFSSVQAALQREVALAAGLLRIFFHDCFPQGCDASVYLKGRGTEQAMGPNTTLQPRALQLVEDIRAKVHAACGPTVSCADISALATRDAVVLSGGPNYTVPQGQFDSLAPASQNVVNGLPSPATSSVSALARAFSGKGLRDLADLVALSGAHTVGRTGCPFFRDRAQRMDDAFSRRLAANCSAAPNRLQNLDVVTPDLFDNGYYKALVNSQGVFTSDMVLIKDRTTAPIVQQFARNKDAFFAQFAKSMAKLATAPRPGGNVGEIRRNCFSPNALRAIDTVVDAGEEEGFTASA

SEQ ID NO: 305 - protein, 144 aa, Hordeum vulgare
MAQGTLEVLLVGAKGLENTDYLCNMDPYAVLRCTSQEQKSTVASGKGSDPEWNETFVFTVSENARELVIKLLDSDGGTEDDSVGEATIPLDGVYTEGSIPPTVYNVVKDEEYRGEIKIGLTFTPEEARDEDQPEENYGGWNQSS

SEQ ID NO: 306 - protein, 240 aa, Zea mays
MTGYRSRSPSRSYSPRRRYSRSPPRRKRYDDPRDRYRWAGAGGGGDRRGYGRPLAQSGLLIRNISLTARPEDIRATFEQFGPIKDVYLPRNFHTRELRGFGFVKFRYPEDAAVAKREMHHQVIGGREISIVYAEENRKTPQEMRMRTRTSGRYMDERYTRLSRSPRSRSHSYSPPPSPVRRDFRGRERPDSYSPQYSHSPRPRDSRHHRSDGRSPTPSLDDHKPKATPVNGGHGPAVASR

SEQ ID NO: 307 - protein, 433 aa, Zea mays
MGRRKMSAAAPPSRSWSNVGGSVIPELLAKHKMDLENLTLTKHPIRTLHFFLLAMLQYLKRLATYILRKSGLFFLLIVLVVASGILLSISDGLHKKHVQEFLNYAKFVLWWISLGVASSIGLGSGLHTFVLYLGPHIALFTIKAVQCGRIDLKTAPYDTIQLKVGPSWLDKKCSEFGPPVYPASAHSVRIPVFDLLPQIQLEAVLWGIGTALGELPPYFISRAARLSGSKSKAVKELDAATSKEDGTVASTLDRSKRWLLSHSQHLNFFSILILASVPNPLFDLAGIMCGQFGVPFWEFFFATLIGKAIIKTHIQTLFIVSLCNNQLLYLMEKELIWIFGHIPGFSATLPSVIAKLHAAKDKYLSPPTPVSASSQMEEKSWNLSFTLVWNSIVWLVLLNFSVKIITSTAQDYLKKQQDMEMERVSDSPPPEQN

SEQ ID NO: 308 - protein, 369 aa, Zea mays
MLRSTGDRVVVVGGGIAGALLAKTLQNHADVVLIDPKEYFEIPWANLRAKVDPAAVERTVIAHSDYLTHAKVVTASAVGLDDSVVLTSIGRAVAYDFLVVATGRTCNRPQKRSDRLEMFQRDKDRIDAAESVLIVGGGPIGVELAAEIVMKSPEKRVTIVHGAPRLLKVMGARASAKALEWLRSKNVTVLLDQTVDLASATPDTRTFTTSAGETLEADCHFVCTGRPVASGWLGGTILGEHVDEEGHLRVDDHLRVGGLRNVFAVGDITDVPEAKQGNLAQRQAMVVSRNLRLLVKGAPREEKLHRYKPSPRTSMTVTLGQRDALAELPFMTLIGHIPGAVKPRDLFITRTRRMMGIKSKPYGTMPHVM

SEQ ID NO: 309 - protein, 192 aa, Oryza sativa
MAATTTGRVVALGAVAVVVALTFLAGGADADCYDFCFKDCMARENNMVDYCSYACDKTCQPDKPTLYSSSSSSRLAGDMECQLSCALGSCHRLLPDGKGAVEACFGQCYDGCKTTAAARLPRPLRAGHYVLSSPPDDVDHDPDHRYVFSSPHDDVDHDPDQVFASPPDDIDRHVFAAPPDVLAALPGEPDHA

SEQ ID NO: 310 - protein, 395 aa, Oryza sativa
MEGAEAEERRLAASLTARYSDWVVEALDELPGSFILTDPAMPGHPIVYASRGLASLTGYPPREVLGRNARLFQGADTDRAAVAGVREAVRGQRPHQVSILNYRRDGEAHWVLLHLAPVFHASDGRVLHFLAVQVPIAPPASRRRTPPCRAARPFVVFAACREEARVEEECPCASHAGEVFVDVDKRGQDAEEPRVASEHEKEKALSTANSIFSALNRYSKLTGLVVCGKRCDSVGIPALSSSLNLSLGRIKQSFVLTDPHLPDMPIIYASDAFLSLTGYSREEILGCNCRFLNGPGTSVEVLEQINQHICSEQACTVHLLNYRKGGSSFRDLLHISPIRNASGKVAFHVWVHLDEGAKYDFNGLTPEVWQLGAVGAVRVAVRSLSASGSLLRPSQ

SEQ ID NO: 311 - protein, 289 aa, Oryza sativa
MGRAPCCDKASVKRGPWSPEEDEQLRSYVQSHGIGGNWIALPQKAGLNRCGKSCRLRWLNYLRPDIKHGGYTEQEDHIICSLYNSIGSRWSIIASKLPGRTDNDVKNYWNTKLKKKAMGAVQPRAAASAPSQCTSSAMAPALSPASSSVTSSSGDACFAAAATTTTTMYPPPTTPPQQQFIRFDAPPAAAAAASPTDLAPVPPPATVTADGDGGWASDALSLDDVFLGELTAGEPLFPYAELFSGFAGAAPDSKATLELSACYFPNMAEMWAASDHAYAKPQGLCNTLT

SEQ ID NO: 312 - protein, 381 aa, Oryza sativa
MRETGATDEGHACEVVVAGGDGKAAAARRRRRLELRRLGLAAEDDAAAKRIRSVKDGSSSDDSSTEVVPRSWPACVSHGSVSVIGRRREMEDAVAIERTFMASTGDGAGAIRGGGEGEEDFFAVYDGHGGSRVAEACRKRMHVVLAEEVSLRRLRGQSASGGDVRWKEAMLASFARMDGEVVGSVAAAAPRVDGTEPSGFRTVGSTAVVAVVGRRRIVVANCGDSRAVLSRGGVALPLSTDHKPDRPDELERVEAAGGRVINWNGYRVLGVLATSRSIGDYYLKPFVSAEPEVRVVERTDKDEFLILASDGLWDVVSNEVACKIARNCLNGRAASMFPESVSGSSAADAAALLAELAVSRGSRDNISVVVVELRRLKSRAA

SEQ ID NO: 313 - protein, 533 aa, Oryza sativa
MSSNMFGKKGWDSNGMDTSGSVCRSSSDINYINQRARLKSASLNCVGSPPRKNNNATQYRMFVATWNVGGRTPNKRLNLQDFLQVEESPDIYVLGFQEIVPLTAGNVLVLEDNEPAARWLALIHQALNMPQEPADGDEPSPLTPPPSSSTTTSESSNGARTRRRDAVSRSASGNLFFHTPSLKMLSNSYRVDSALVKTCNCSPEHSSVRRRAAEVRESVYLADAPAPAGETAAPAADEDDAPTTEAQCEAGCGGGGGMSYCLIASKQMVGLFLSVWVRKELVEHVGHLRVDCVGRGIMGWLGNKGCIAISMTLHHTSLCFVCSHLASGEKEGDELRRNADVAEILKSAHFPRACRPAPAAARRVPERILDHDRMIWLGDLNYRMSLSYDETRTLLEDNDWDALLEKDQLLIEREAGRVFRGWNEGKICFAPTYKYTHNSDAYAGETAKSKKKRRTPAWCDRILWQGDGIEQLQYLRGESRFSDHRPVCGVFAVEVDGGDGDGGGAAGKIMKGYYSLNARIGGDRSQCHQGDVS

SEQ ID NO: 314 - protein, 252 aa, Oryza sativa
MASRAAAVAVLLLAVAAAPLFAAASAHGRGYLGAKSWPPDGSLSSSSSGEAAAADVDDGHTDWKCYSSCMSKCCHRHDDDDDDKANAKANATAGAAAVGLDDDYKCKKQCLGNCFKDVPAVCYHKCVDDWCAKLPPYSSAKVQCYKKCGDKCFHHGPKPGPKPKPKPSPPKPKPGPKPKPPKPGPKPKPPKPGPKPKPKPPKPGPKPKPKPPKPGPKPKPGPPQPWWPIPFPKPPCPPGADGSSSAVDDKNN

SEQ ID NO: 315 - protein, 422 aa, Oryza sativa
MGTRPCAGVASAVAAAVAVLLLAVSCFAAAATTTQKHGRMSGKGGDVLEDDPTGKLKVFVYEMPRKYNLNLLAKDSRCLQHMFAAEIFMHQFLLSSPVRTLDPEEADWFYTPAYTTCDLTPQGFPLPFRAPRIMRSAVRYVAATWPYWNRTDGADHFFLAPHDFGACFHYQEERAIERGILPVLRRATLVQTFGQRHHPCLQPGSITVPPYADPRKMEAHRISPATPRSIFVYFRGLFYDMGNDPEGGYYARGARASVWENFKDNPLFDISTEHPATYYEDMQRAIFCLCPLGWAPWSPRLVEAVVFGCIPVIIADDIVLPFADAIPWGEISVFVAEEDVPRLDTILASVPLDEVIRKQRLLASPAMKQAVLFHQPARPGDAFHQILNGLARKLPHPKGVFLEPGEKGIDWDQGLENDLKPW

SEQ ID NO: 316 - protein, 342 aa, Oryza sativa
MTMRLAAAVVVMVVVAAAAMSVEAELSVDYYKKSCPGVENVVRYHVAKALKANRKEGAALVRLIFHDCFVRGCDASVLLDPTAENPHTEKTAPINIGLAAFELIDEIKAAVEERCPGVVSCADIVIYAARDASILLSNGHVHFDVLAGRLDGRVSRAADAQRDLPDSTFTISELIRNFRRKNFTIEELVILSGAHAVGVGHCSSLRARLTAPPEQILPGYRSLLAGKCAAGEDPIVPNNVRDEDPAAVAATIPSFLPKLRKFEFLDNSYYHNNLARIVTFNSDWQLLTEKKARGHVHEYADNGTLWDEDFSDALVKLSKLPLPPKAKGEIRRHCRRVNTHHY

SEQ ID NO: 317 - protein, 422 aa, Oryza sativa
MVEGPKFAGMMGGVVGGAGGHDDIGGNFCDMAYYRKLGESSNMSIDSLNSLQTSTHGGGSVAMSVDNSSVGSSDSHTRMLNHPGLRGHVAANYSVGHSIFRPGRVSHALSEDALARALMDPRYPTETLKDYEEWTIDLGKLHMGMPFAQGAFGKLYKGTYNGEDVAIKLLERPEADPERAGLMEQQFVQEVMMLATLRHPNIVKFIGACRKPMVWCIVTEYAKGGSVRQFLMKRQNRSVPLKLAVKQALDVARGMAYVHALGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPVLSEIMTRCWDPNPDVRPPFTEVVRMLEHAEVVILSTVRKARFRCCISQPMTTD

SEQ ID NO: 318 - protein, 365 aa, Oryza sativa
MSAKVPRRLEANSVGMADWAGLQTDILGVIVKKLAVPDYLRFRAVCTSWNHLCRDVFNCPRIDPWLMLPTNALNDSKFLCVPERKNQTIRLPSTVTIFGSTWIPVGSSHGWLIFYSPSHGTMQLVNPISGMQFNLPPIGRRAFSKAMLLDMNDTNFTVAVILRDQKGYKVTRKGSNSWSSVESKHDLVDIFKHRRQLYTVDIYGTVQLWAEPPRSWPDEDAPQVNDPYHNLIHYPHQHGKLNCLVESPAGDLMRVKRQSNDKFVVWILDKGTFSWEKVDNIGDFALFVSYYSSVCYRAKDHLNLKSNCVYFIDSYSNLCAFNLENRTKELVEALEPAHAHGHPEPHAVRRRPEGQRYMWLIPSLR

SEQ ID NO: 319 - protein, 424 aa, Oryza sativa
MLQDIMNTKKIKLHDCHFGSPLCDPSPAPHLLSSAAAAGLSFHPGLVSSAAQHQQHGAGGWLHEEYYAPRSSPPSSLLAQTCVGSNATAFYAAENLPQFDFPALGTAAAAAAKAPFRSSESELYRPVDPLLLRADHSVRTYYVRPQKRDSGERTPLPPPSQQQHQDRIHGLFAGAPTTRLLSGEPKIHSFPPQVAAKPILPAMDAPSLQNQMENQLTRNCIGAATPVTPTGNLAGSGAPSKTRIRWTQDLHERFVDCVNQLGGADKATPKGILKLMNSDGLTIYHIKSHLQKYRIAKYMPASSEGKQLEKRATGNDMQNLDPKTGMQITEALRVQLDVQRRLHEQLEIQRNLQLRIEEQGKRLQKMFEDQLKASRSVMEPQELDDVVAFAAGDGDDDAFDDVDVQLLAVAGSGYDDAGFQSKIS

SEQ ID NO: 320 - protein, 807 aa, Oryza sativa
MKGGSSATAASGGGGNSLAIVERQKPATSCVASLFQMLAKKKLFSSSSKKTKLLPPVRTQKFSPGRPPAGGEKTPAAKMRTLLLDAPYYPNEVTTRLPPPGQDNKSSEMCTPGVVARLMGLSAMPATSHQKAVKTMDASELGGHRSECSYGSIYNSHQKQQKPGHIRDGRHDNGNQLDADAQPVWSRKHAAHKLASPIKSPRSVSSRNKVRLIEAAVKVLEPGLQSRHHHQARRQARLEYRCNSSDVQSAAEAMHDFSDQFAREMCDVDASRSGAQNVGATSLHNSTSNQWSEEDTMRNVSVRRPNQNISCQAQSEGNHKGQRNGFKDSGQRTSDDVLVSSQGVQKIQPKNISRENVDCRPLKQNNLKQNALPETYRAADTGHMVQRQKHRAKEQNVANTANDFVCSNRGMNNSASLRSKGKVKDKIGMPHGSAENRNLSTKCHRTSGLHGDCSNKQISKTATLKATEKDMIIAKGAGLVSEKPKSTSPNSVRNDSRRKVESRIASRGNNSGIISISSNSPRKAVLALLNGHTKGSDSVVLGSPTGSCPKRDYRRDCQNISSERELVLSEALQGISSLESAESVCFNRNELRNREILDDRVMSSLFRKTSAINVMEESPSDEFLWQCNFLDSLTFGFREVPRSGKLRETHKKHEVTTNASDPSYYADDECFSGSLLKTAASEAGFRDRRRSENCTMQQDGTNKRNSRCSETNFGQDSSNLIHPGEVAATVELLLTNVRRSTSTTPPRRRRRRRRTGSASTPASSRPQKGRRAGARWEASRSIPSWSAWTRCSPSSATQDTGRSRGFP

SEQ ID NO: 321 - protein, 152 aa, Hordeum vulgare
MAPKAAVAKKGDAKAQAAKVAKAVKSGSIKKTAKKIRTSVTFHRPKTLSKARDPKYPRISTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 322 - protein, 369 aa, Hordeum vulgare
MGMEMITNVSEYERLAKEKLPKMVYDYYASGAEDQWTLNENREAFSRILFRPRVLIDVSHINMATSILGFDVSMPIMIAPTAMQKMAHPEGELATARAAASAGTIMTLSSWATSSVERVNSVGPGIRFFQLYVYKDRNIVRQLVKRAEMAGFKAIALTVDTPRLGRREADIKNRFILPPHLVLENFAALDLGKMDKTDDSGLASYVASQVDQSLCWEDVKWLQTITSLPILVKGVMTAEDTRIAIEYGAAGIIVSNHGARQLDYVPATISCLEEVVREAKGRLPVFLDGGVRRGTDVFKALALGAAGVFIGRPVLYSLAVDGEAGVRKVLQMLRDELELAMALSGCASLRDITRAHVVTDGDRIRRARL

SEQ ID NO: 323 - protein, 642 aa, Oryza sativa
MKGHHSLPPSTPPKRRCTALAAAVPALVVCSILLPLVFLLGLHRPGHGSEERAAVVISTELGFSKHKHLDGRMKHKLLKDVSRKKIPGSDGILDEKSGSRSKSKSVSTKSKEKLKGVFSLVQLKNETRKNKELHTQRRYQLKDLSWRSKDTTIDKKENQDQEVEHENPRSCELEYGSYCLWSVEYKEVMKDFIVKRLKDQLFMARAHYPSIAKLKNQETFTRELKQNIQEHERMLSDTIADADLPPFFAKKLEKMERTIERAKSCEVGCTSVERKLRQLLDITEDEAYFHTRQSAFLYHLGVQTMPKTHHCLNMRLTVEYFKSTSIHTVQSNKQKLEDPTFHHYVIFSKNVLAVSTTINSTVMNSKDSGSIVFHLFTDSQNFYAMKHWFDRNMYLEATVHVTDIEDHQKLSKDVDFHDMKLLRPAEEFRVTFRNHYQSFQKQMKTEYISTFGHSHFLLPDLLPSLNRVVVLDDDLIVQKDLSSLWNLNMGGKVVGAIQFCEVKLGQLKAYTEERNFGTNSCVWLSGLNVVELKKWRDLHITSRYDQLLQKLQKDSVTSFPLKVLPISLLVFQDLIYPLEDSWVQSGLGHDYGVSQTDIKRSVTLHYNGVMKPWLDLGIHDYKGYWRKYMTNGERFMTECNIH

SEQ ID NO: 324 - protein, 215 aa, Hordeum vulgare
MSKEKHHRHEHHLRRCCGGFAACLLALVVVVAFIALVVYLALRPTKPSFYLQDLQLRSINLGDPSLSATAQVTLASRNPNDRVGIFYRRLDVFVTYRDEPVTVPVSLPPMYQGHRDVTIWSPVLSGESVPVAGYVAEAMKQDIAAGYVSLLVKIDGRVKWKVGSWVSGSYHLFVSCPAMLAAGPGGMPLGGGLNGTGGAVASLKFTQPTGCTVGT

SEQ ID NO: 325 - protein, 381 aa, Oryza sativa
MATGYYRGGGGARDHADEPDDFDEYDPTPYGGGYDLFITFGRPLPPSDETCYPCSAPSTSYDAPHYSADEPSPYAHHSKPQPAYGFRPQHEQQQQPSYASSGYRPQHEQQQSYGSSGYGSKPQPAYGFRPQAEEENTYGSGYGSGYGGGGRKQQEEESYGSGYGRKPQVEESYGSGYGTKPQQEESYGSGYGSGYGTKPQQEESYGSGYGRKPQQEESYGSEYGSGYGRKPQAESYGSGYGSRPQQGGEEYGSGGYGRKAQEESYGSAGYGGRKTEEESYGGGSGYGYGKKAQEESEGTYGSGGYPKPKPYSQEETQGSYGYGYGEKPAYESGGYNKPSYGGGDEYQGGYGRKKHDDNDSDDEKKQRYQKHHHHRRQEYDD

SEQ ID NO: 326 - protein, 1214 aa, Oryza sativa
MATPLADEGSIAAAVMPRSPSPPAAAAGSAAEAPMLIFVYFHKAIRAELERLHAAAVRLATERSGDVGELERRCRFLFSVYRHHCDAEDAVIFPALDIRVKNVAGTYSLEHKGENDLFAHLFSLLKLDVRNDDGLRRELASCTGAIQTFITQHMSKEEEQVFPLLIKKFSHEEQADLVWQFLCSIPVNMMAEFLPWLATSVSSDEHQDILNCLHKIVPDEKLLQQVVFAWIGGEAVKTISHDFCSPCSKSNVRCKDAIDQTDKYGCSHEHFKTGKRKRAESSYSQLVMHPIDEILCWHNAIRKELSDIVEETRRIQQSGDFSDISDFNVKLQFIADVCIFHSIAEDQVIFPAVNDQVSFEQEHAEEERRFNKFRCLIEQIQITGARSTAVDFYSELCSQADQIMEKIERHFKNEETKVLPQARIHFSSEKQRELLYKSLCVIPLKLLERVLPWFVSKLNDQDAEAFLQNMFLAAPSSEAALVTLLSGWACKGRSKGTSNSGKFICLTPRALSSPLDENGFKDCQLCPCSLQSDICSRPAKKWNDTESSNISNCSQTADIALTCKNRPCHIPGLRVEISNLAVNSFASAESFRSLSLNYSAPSLYSSLFSWETDAAFSGPDNISRPIDTIFKFHKAIRKDLEFLDVESRKLIDGDESSLRQFIGRFRLLWGLYRAHSNAEDEIVFPALESKETLHNVSHSYTLDHKQEEELFKDISTILFELSQLHADLKHPLGGADAVGANHIHPYNRIDWSKKNNELLTKLQGMCKSIRVTLSNHVHREELELWPLFDKHFSVEEQDKIVGRIIGSTGAEVLQSMLPWVTSALSLDEQNNMLDTWRQVTKNTMFDEWLNEWWKRSPTSSGPSSDASHPEEDHFQEKFDQSEQMFKPGWKDIFRMNQSELEAEIRKVSRDSTLDPRRKAYLIQNLMTSRWIAAQQKSPQPQSEDRNGCTVLPGCCPSYRDPENQIFGCEHYKRKCKLVAACCNKLFTCRFCHDKVSDHTMERKATVEMMCMQCLKVQPVGPNCQTPSCNGLSMAKYYCSVCKFFDDERSVYHCPFCNLCRLGQGLGIDFFHCMKCNCCLGMKLIEHKCREKMLEMNCPICCDFLFTSSAAVKGLPCGHFMHSACFQAYTCSHYTCPICSKSLGDMTVYFGMLDGLLAAEELPEEYRDRCQDILCNDCERKGRSRFHWLYHKCGFCGSYNTRVIKIDRADCSTSD

SEQ ID NO: 327 - protein, 274 aa, Oryza sativa
MSRLMAAMLLGGARVAGNTTTAVMALHHPRPSYFLPPRPRLAAASWSRLRLQTAPRSSQAYDNSPADDRRDVGDRYRDAAEEAKEATGDAKERVKGMAGEAKGRAADIAGRAKDETKDTASRAADAASRATDRAKHEAADKAADVKDRAKDAADMAQGTARAVRDKTAETAEGAMDRAGEAKDRTVEGTKHAGEKVAEMTKEGASKVVETAQAIGEKAKQAAQGAWGATKEAAQGVKDTVAGGDVDADAAMKEQDRIAQEEKKRQAREKGAGLP

SEQ ID NO: 328 - protein, 271 aa, Hordeum vulgare
MSLLSKLRLVTVDVTGTLLAYKGRLGDYYCMAAKSAGKPCPDYDRMHEGFKLAYTEMARKYPCFGFAAKMPTIEWWRICVKDSFVKAGYDYDAETFEKVFKRIYSAFGSSAPYSVFPDAQPFMRELREKGITVGIVSNAEYRYKEVILPALGLNQGSEWDFGVFSGIVGVEKPDPKIYKIALEMAGNVAPEEALHIGDSYRKDYVPARSIGMHALLLDRFKTADAESWRKSGAPVLPDLEATKAWLAKNPTEEPAEEPLGAALLRRMAEKL

SEQ ID NO: 329 - protein, 316 aa, Hordeum vulgare
MEGKHTDQANVKAKHSKVICCKLYISESRNAAIVDAISRIGQKNPEVVLLSKFDDKYYNRVRYTLVSYITSESSAGEAVFGPIRKVLLEMIEAAFSAINLQAHSGTHPRIGVVDDISFHPLSPAATMEDAAQLAKLVASDIGNGLQVPVFLYAAAHPTSKSVSAARRELGYYRPNHKGVQWAGQVLPHTLPVKPDVGPAHVSRERGATMVGATPFVDNYNVPIFCKDVPTVRRITRRVTGRSGGLPTVQALALFHGDNCTEIACLLDPDHVGADQVQWLVEQIAEEQGLEVDKGYFTDLSKDMMLERYFEMISAAD

SEQ ID NO: 330 - protein, 120 aa, Arabidopsis thaliana
MGVFSFVCKSKGGEWTAKQHEGDLEASASSTYDLQRKLVQTALSADSSGGVQSSFSLVSPTSAVFVVVIGGGGGGGFAAGGGAAAGGGGGGEAAAATKEEEKKKEESEEEEGDFGFDLFG

SEQ ID NO: 331 - protein, 65 aa, Oryza sativa
MEVRPMVALRAALVGGVAAFAKIGAAMKAAGGAKVGAAAAAMTAAATAAVSSKDTNKDNPKTETK

SEQ ID NO: 332 - protein, 305 aa, Hordeum vulgare
MIRAMLVVVSGESRRAAVAGAGFVGHCGYSTASSSQRLAGKVAVITGGASGIGKATAAEFVRNGAKVVLADVQDDLGHAAAAELGPNAACYARCDVTDEAQVAAAVDLAVARHGKLDIMLNNAGIVGSLARPRLSDLDLADFDAVMAINARGVLAGVKHAARVMAPRRSGSIICMASVAGVLGSVTPHPYSVSKATVLGVVRAVAGEMARSGVRVNAISPNYIPTPLVMRILEQWYPKASAEEHRRIVEGDINEMEGAVLEPDDIARAALYLASDEAKYVNGHNLVVDGGFTVGKAPNMPPAPAL

SEQ ID NO: 333 - protein, 118 aa, Hordeum vulgare
MAAVRCAARRLGGALLQRTQAEEARLLAPSRLMRSRHLSTKVSGEARNIQKKGDDIWAGFKETVKRVSERPPEKKPNVLLQRMMLIEQVTKSVVYGAFRVTVVYATAAAAFGGSWLEN

SEQ ID NO: 334 - protein, 78 aa, Hordeum vulgare
MEGLIPFIYRAVAQYRKEGQVSLADLLFDDPSSSPTATSAYFRLPGDSGRHQLFSADYGTAARRSPAHRRLTMEHGSW

SEQ ID NO: 335 - protein, 115 aa, Hordeum vulgare
MAANHHLRRLASASAPALSRLSKPAPSPLLRSAFSSSASPADQPPAAAAQKGEAQSAVKEADEAQGGGGSGATKAAEEDDGGLDINEATGEIGGPRGPEPTRYGDWERGGRCSDF

SEQ ID NO: 336 - protein, 636 aa, Hordeum vulgare
MSNYYSSPGDERDPQTMYSPETGSASYPVPSALGNLLYSNNASSGPYTEFSGIIQPQQNFMELHGHPSEHSSSREPNMVTSLAEQSSFAPVKDMRNEMLMHFMDGAHSGGGDLIHNDAHSSAQLEFGLLNNPSSAIVPSAPGQGLSLSLNTHILAPSYPYWSPKPDLLTTQSYQGDENGMKNMQSEASRAIRNSKYLKAAQELLDEIVSVWKSIKQNAQKDKVEAGKMDGKDADEVLKSEGVSSNPQESAANAEAEISAAEKQELQNKMAKLLAMLDEVDRKYKHYFHQMQIVVSSFDMIAGSGAAKPYTAVALQTISRHFRCLKDAINDQVNVIRKKLGEEDNSSGREGKLTRLRFIDQQLRQQRAFQQYGMLQQNAWRPQRGLPENSVSILRAWLFEHFLHPYPKDSEKLMLARQTGLTRSQISNWFINARVRLWKPMIEDMYKKETGEAELDSNSSSDNVPRSKDKMASCEDREDQKCSMSQGQAYQTSEFKANVGMVGLTGGPASFHNEASSDDGFMNLLLKDQRPGEADGGLLHGDESARFMAYHLAELGGYQNSNVSLTLGLQHTENNLSAPNNTHRPGFTVGGEGDIYNTTAAHPGGGAAAASPDYESTNQLDQRQQFEPSPLLHDFVA

SEQ ID NO: 337 - protein, 111 aa, Zea mays
MRESINRPPTPSAVEDRDKEPSLVEIINIKFVESGEKEKLTELLRERLVECGWMDEMKAFCRDYVRKKGRNNVRVDDLIHVIVPKGRASVPASVKAELLQRIRSFMATTLR

SEQ ID NO: 338 - protein, 324 aa, Oryza sativa
MAKKQSLLLAMMLVVAGLAVSAMADRKLMSLVKPQPNQLTYHNGAVLSGDIPVSILWYGRFTPAQKAVVTDFVLSLAAPLQAAPAPSVSQWWGSIHRLYLSKAVAVGKNGGAHGGGGGGRAKNARVVLSGQVSDEGCSLGKSLKLSQLPTLAARARPGKGGVALVLTAQDVAVEGFCMSRCGTHGPVSRAGAAYAWVGNSATQCPGQCAWPFHQPVYGPQAAPLVPPSGDVGMDGMVINVASMVAGAVTNPFGDGFYQGERGAALEAATACTGVYGKGAYPGYAGALLVDKATGASYNAHGAHGRKYLLPALFDPDTSACSTLV

SEQ ID NO: 339 - protein, 249 aa, Zea mays
MARRIAVAAAFLALAVVAPAALAQAPGPAATPSGPPNVTAILEKGGQFTMFMRLMKETQQDTQLNSQLNSSYASSGGGYTVFAPTDNAFNNLKPGTLNSLTQQQQVALVQGHVLPQFYSMDSFQTASNPVRTQASGRDGPYTLNITATANNQVNVSSGVAEVTINNALSAVKPLAVYSVDKVLLPLELFGAKAPAAAPAASQGKPKKGGSSDAPSGSAGSDDAAPTGAAGARVVGWSFAGLAAVLGCLL

SEQ ID NO: 340 - protein, 321 aa, Triticum aestivum
MTDAVLRSGCVWLMGVPAGFKLNTELAELLGMISLNAIQIYSTLWFMVGGFLRHIIQGLAFSGILLGFTVPVSIFIDIIQLATLHVTMLQWLISLIYSRQIQTVTSLWRLFRGRKWNPLRQRLDSYDYTVEQHVVGSLLFTPVLLLLPTASIFYIFFSILSSTIICLCIVLETAICIIHSTPYAAVILWVTRRQRFPAGLMFLPMSSSSVSTDDDAPSVEYRSTSLSGERKTDEPIHVHSVPLVSELNCNYNTLGQVIGPHYQKVFNGIALPFCKQLAHGILRGTRIPTTLHLPSSPLPWMHIGIREYWMLCRRATKWGRN

SEQ ID NO: 341 - protein, 213 aa, Oryza sativa
MEVKLWNDKRERELLESLADLYAIIKATEKLERAYVRDLVSAADYEAECLKLISQFNSLSSSLAGVVTIPRFVEAYRLDCPAALNRLVQSGVPATVELRAAASSSAPASSAASAAAIAQCVQSFITAMDAVKLNMLANDQVRPLLHDLSTSMGKLGPVLPPDFEGKVKVSEWLAKLNKMGAGDELTEQQARQLNFDLDSAYSAFMASLPSTGL

SEQ ID NO: 342 - protein, 368 aa, Oryza sativa
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIHVTEESSS

SEQ ID NO: 343 - protein, 631 aa, Oryza sativa
MDNSFVDIPNQPPMNNPFVLMEPSAQSYMVNLGKSTPHMDCLGSAMANYGHGNQNIQCIDSITTRDDGCRLVLGLGPTPNFYSAECQPTGVDKLKEAPSLSGQGLTITDPGTLRLGLQMDVSQTIQPLQAPDGTVHSFTVVDEASASPSVRSIGGYMPSLLFAPRSGSSAVNETHEAETQDSLDLTHSDNDNTQHVQHHLQLSPEPSAMTDTSFGVSSDVVTATTTSEQRNHPRHPKKCRFKGCSKGARGASGLCIAHGGGQRCHKPGCHKGAESSTAYCKAHGGGRRCEELGCTKSAEGKTDYCIAHGGGRRCEHDGCPKAARGKSGRCIKHGGGKRCTVQGCIRSAEGKAGLCISHGGGRRCQFPDCSKGAQGSTLYCKGHGGGKRCIFDGCSKGAEGSTPLCKAHGGGKRCMFEGGGVCPKSVHGGTEYCVAHGGGKRCSVAGCTKSARGRTDCCVKHGGGKRCKVDNCSKSAQGSTDFCKAHGGGKRCTWGTGCEKFARGRSGLCAAHGTLAAKQQERDAANNGAGMIPPGLFSGIVTVAATSSMTNEYSSSGISTASDCDGTVRSQAMMIPPQVLVPRSMMPSSSSEPTVHGGREGGCAVPEGRVHGGGLLSLLGGSFRNADMDKL

SEQ ID NO: 344 - protein, 229 aa, Sorghum bicolor
MGTCASVHKDPEYPKKQFLDSPTKAKTANGKGGGGGVAPVGDGFGDLKSKVDAEQQRAEFNPKSPDSGSKDEVFFESRAWLDSDCEDDFYSVNGDFTPSRGSTPIYQPRAQTVMSNIFQPDTHSSKSPEPSPTGRRKLAELLQEAMQDGPEESTDEQQQLQSVVADGKPVSESTSSSACSTVPTPTAVDKSRKEKAWYTGRCCLPSFVHSLTLDESERGQKMSSRQCAV

SEQ ID NO: 345 - protein, 404 aa, Oryza sativa
MAAVFFHHVVGDLTVGKPEVVELHDTDTLDAAARAIAASPEGAVPVWRPRAAPDEPPSGARFLGMISALDIATFVAASGVGDRAMAAVVGEVVQPNPGLLREVDPGTRLIDALDLMKQGVKRFLVRKNGAWRGISKRFSVLYNGKWLKNMEATSPTSASSSRELSSSTSSTYKFCCLSREDILRFLIGCLGALAPIPLSPISSLGAINPHYCHVDASVPAMEAIQKVPPDPSAVAVVETTPDGTRKILGDISAYKLWKCDYVAAAWALINLSAGQFVIGADDNESTPISAIPVPPISSSLVEEIGPGRSPRAKKFSSRSIGFLNSQAHQMAFGRMRSMYRGRSAPLMCKSTSSLAAVMAQMLSHRATHVWVTDAESEEDGVLVGVVGYTDIFNAVTKSVYPAAS

SEQ ID NO: 346 - protein, 399 aa, Oryza sativa
MNGSSGSQGHNVNGGQKKVQHASPLTLNNGSKHRPLTPMRRCRGVACVVIILSTAFTLIVFIAPITTFLVRLVSVHYSRKATSVLFGMWLSLWPFLFEKINKTNVVFSGESVLPKKRVLLFANHRTEVDWMYLWDLALRKGYLGYIKYILKSSLMKLPVFSWAFHIFEFIPVERKWEIDEAIIQNKLSAFKDPRDPLWLAVFPEGTDYTEKKCIKSQEYASEHGLPILKNVLLPKTKGFLCCLQELKSSLDAVYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSSVWFKVYVLLSCAYLTFVTYFSIQPPQLICSSEGGTHAKKVL

SEQ ID NO: 347 - protein, 376 aa, Hordeum vulgare
MSSLCPFAKATTGGVCPMKSDKKPDKSGGAAACPVTGKTHGGEDKETGADRAAAGEEGAEGDPRLVPAKCPFGYDSNTFKLGPLSCMVCQALLHDASKCKPCAHKFCKACISRFKDCPLCGADIEGFEPDAELQALVDRFIDGHARIKRSLAGGDGQAADGKSKVIYEDVSMERGAFLVQQAMRAFRAQNIESAKSRLSMCAEDIREELKSSEDNLDLCSQLGAVLGMLGDCCRTLGDAPSAIKYYEESAELLSKLPKKDLELVHTLSVSLNKVGDLRYYDGDLQSARSYYARSLDVRRNSVKEHSAVASQVIDLATSLAKVADVDRNLGNEDAAVEGFEEAIKCLEKLKLESEQAGLEQRRRSVLDFLQKQLHEK

SEQ ID NO: 348 - protein, 362 aa, Zea mays
MPEAEWNDEHTRIVCELFEEQVRAGNRPNTHLNNIGYRQVAAKFQQRTELLYTKLQLKNKWDKFKNDYITWRKLLVVGKGLPWDTAKGTFVADEEWWKKINKELPGARKFRHGGLHHEDKLNVMFDYITSNGVDPSPPAPESPKNGVNHSPPAATGLPSAPDCALNGVDHSPVTAHGLPSGPYSPMNGMDQLPLPAHDLRSVQEIPMNGVNLDGLDNNTEDNDDIYQEPVFQYTSNRKKRPISFSATKKNKKNKAETALLMQAHLYRITELAQKAQDTFKKFSSQADLVPWPSIQDVMTLVWECGARCGSNEHFIATELFVSREQREMFLTMETAEERFQWLRRKYIVKYLSGTTGTNLGTR

SEQ ID NO: 349 - protein, 578 aa, Zea mays
MASNGMSLVHRAAEAVRRTPRWKKRLVLFAVGASTLTYACQDNRVLQICDGTGNKKKVVILGTGWAGASFLRNIDTSLYDVHVVSPRNYFTFTPLLPSVTCGTVEARSIVEPIRNIVRKRNGSFRFWEAECIKIDPRNKKVHCRSDVGTNINGNGEFVVDYDYLIVSIGARPNTFNTPGVTENCHFLKEVEDAQKIRKSVMKCFERAALPNLSEEERKKNLHFVVIGGGPTGVEFAAELHDFVNADLAKLYPDVKKYVNISVIEAGGHILTMFDKRITEFAEEKFKRDGIDLKTNFKVVKVSDKDITMTNPATGEVAVPYGMAVWSTGIGTRPIILDFMKQVGQENRRVLATDEWLRVQGCEDVYALGDCATIAQRKVMEDVASIFRVADKDNSGTLTVKKIKDVLGDIYERYPQVELYLKSNQMKSFHELLKDSDGNSKELKELNIEQFKKALAQVDSQVKMLPATAQVAAQEGSYLADCFNRMKTCEQYPEGPIRIRGAGRHRFKPFRYRHLGQFAPLGGEQTAYQLPGDWVHVGHSTQWLWYSVYASKQFSWRTRMLVISDWGRRFIFGRDSSSI

SEQ ID NO: 350 - protein, 694 aa, Zea mays
MSPDVDAAVATAVAPGGGCGGDGEAGAGTSSSPASAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQKGAVDFLVKPVRKNELRNLWQHVWRRHAMNCQTNGSENNAASNHISANVANGSKTGENSDEESDAQSFGSKRDTEIHSVEAVQDIRRDEVAGSSKNNELQNKSYDGVNTKVDVSKYTNGAPSGSEKNVRSKCLNGITSAKVAEQIMDNALRITDASSRRPTNLGNGLAMTEPAADRKCQSSVMENNAVTENNPGDKSKGAAIGHADSCPSEFMVTNLGKEHHLNGYKNQEFREKDIFNHSNSSAFSRYGNKRIEPSGEIQFFPSPCVIGQGHVNGKNPVFQPNGVLLPPNEHNTGESTRQARISLDSRTEGAAILCSTSAREDAGANSSSHRKDSMSHPSYGFIPVPIPVGATMPYHYGAILQPVYYPQSPLMHCDSAGINKAAIQHASGQPNYHEAPGKPSHVLIEHKQSEENHQLHHSRQILRESGEPIDMARAHVDRANQTASCSQGICKGSGCTCSGEADINANTMVALESGNESGIQNGDRSRREAALMKFRMKRKDRCFEKKVRYHSRKKLAEQRPRVKGQFVSQKLNSATTTDAEADS

SEQ ID NO: 351 - protein, 1269 aa, Zea mays
MAEGSSSHRRSTFSPGLAVLLSGDEAKISSQKSHLVSYHDEIGHQAVERTIEHIFDLPHKSVVRPPGPIDIGFVRSVVRNQARKFDLDWENCIRGYHRSVFIVDKGAGQRKVALDDSSICGSFRNVRGPSLVESSAPFSSARANACVWKGKWMYEVTLETSGVQQLGWATLSCPFTDQKGVGDADDSYSFDGRRVTKWNNDPKPYGQPWAVGDVIGCCINLDAGEISFYRNGTSLGVAFDGIRSVEPKKGYYAAVSLSEGERCHLNFGSHPFRYPVDGFDPLEAPPRSWSFVTYLLRCLFRLLEVHNLEKSESAYFEKLRRVKKFAPLQELFGPISEGICAEIFSAIEASQGCLEYIAWGSLITLLLDVFRTREPHDFSCLDQVLDLFLRFPGCTSLFQELIVALSCMCKVAPLVLTECPYSGSYPFLALVCHLLRHKDVMCLWWKAEDFVFSFEGFLTRKIPNKQDLQCLVPSVWWPGSSEDEVSMTLTMTTLSDAIKKIEEMHRELCSLVICFIPPMSTPQPPGSVFRSFVQSLVLKARGGDHRMVVNGTFNNTVLVSLYTVILHLLSEGFSMDSAGSASSSKANFGNGVGFLHKGGKRKFPTQLFFRNDAYHSVIPRIGGPPSILMHHQFDAVENEVQWDEGCMNDEETRVTHTTAQKPCCCSVTDVAVGLRYKETAKYVPSTSKGSCKPMPERSPHVAAECNGRGLSDEIEDKPSTSAQSEIEYGYQSLHSLENMPMATQSSSETLKEEELLDVMLLLYHLGISPNFRQAFYFMSQQSQSISLLEETDRQIREKSCSEQVRRLKEARNSYHEDLVDCVRHCVWYRATLFSQWKQRGMYATCMWVVELLLVLSNSNSMFHYVPEFYVESLVDCFHALRRSDPPFVSPALFLMQGLASFVTLVVKHFDDTRIVNPDLKDLLLQSISVLVQYKEFMLVFENNREAINKMPRSLLSAFDNRSWIPVTNILSRFCKGSGFASYKNGESASSATFQVLLRETCIHEQELFFSFLNRLFNTLSWTMTEFSMSIREMQDKNQVADLQQRKCSVIFDISCSLARILEFCTREIPCAFLMGPDMNLRRLTELVVFILNHIISVADAEFFDMTLRRPGQHQEKTNRTMILAPLVGIILSLMECSSTSERRELNDVIAVFASMDCPATIHFGLQYLLSYNWSNVLRGDSSLAKLAQLKEFSHYFRRITASVDGEEEDHSLNAGDEDDDHTCCICYNCDSDATFQPCHHRSCFGCISRHLLNNQRCFFCNAVVTSVTR

SEQ ID NO: 352 - protein, 274 aa, Zea mays
MVADTESSDSLPGSSNAASEMPANGSIHRKSQEKPPKKTHKAEREKLKRDQLNDLFVELGSMLDLDRQNTGKATVLGDAARVLRDLITQVESLRQEQSALVSERQYVSSEKNELQEENSSLKSQISELQTELCARMRSSSLSQTSIGMSDPATHQQMQMWSSIPHLSSVAMAARPASAASPLHGQEGYSADAGQAGYAPQPQPRELQLFPGSSASSSPERERSSRLGSGQATPPSLTDSLPGQLCLSLLQPSQEASGGGGGGVMSRSREERRDG

SEQ ID NO: 353 - protein, 418 aa, Zea mays
MEVCDELRSFEATGVYRLNGTCTSAGATYLDPVRLLNASYQRFRIVPSAYYSRSFGPQHQEGEPEIERPEKRRKRKRNQKPKPRELNPMERIAEARHQEAKPLLLNAHESLVKAKHLLEYISKTIKGNEHTLDAGSGSENNFVELGTSWRAPFYEITICFRNPHVLGNEEGFFHAQKTSFPLFNSLISVEGTDEAEGEFRNRRYILPRGSCFLMADFKRVRDLIPCSPNQGYNLIVVDPPWENGCVRQKEVYPTLPNKNFLYLPVQQLAHPTGALLVLWITNREKLRAFVEKKLLPSWGVEDSTVFYWLKVKPDGSLIGDLDLFHHRPYECLLLGYINVNANAKKGSNFKLLERSQVIMSVPGAHSRKPPLEKLLSEYIPGPKPSRCIELFARELFPRWTSWGNEPLHFQDTMYFSEK

SEQ ID NO: 354 - protein, 68 aa, Zea mays
MEGAAGQMLVPILGIVAVAAVTFYTVSFMEMRDKSFEELDEKYSDFDESGGRQRRSRRRAERDRKKSK

SEQ ID NO: 355 - protein, 715 aa, Zea mays
MAGAPSSLARLLLLLLLAAGCLLPLVADAARLTLSLAPAADALLRLKAGIKDDGGALGSWSPDTSPCADGGPNWKGVLCNKDGVHGLQLEGMGLSGTLDLRALTSLPGPGLRTLSFMNNEFAGPLPNVKELSGLRAVFLSENKFSGVIPADAFAGMGSLKKVVLSNNDFTGPIPASLADAPRLLELRLNDNKFQGKIPDLKQEELTEVNLANNELEGEIPASLKSMTSDMFAGNKKLCGPPLGAKCEAPPTPSPKAHPQASVKEGTTPSQAAADTVASTGASSADDPKQDEGQEPVEGSISFGVSAALLGTLLIAGVAFIALRRRRGYKTKNFGPTASSSRPSGPPRVEPHPPAAKAPAAAGGVAHGGGAARKAEQGRLTFVRDDRGRFFELQDLLKATAEVLGAANLGVCYRATLTTGQSVVVKRFKEMNRVGREDFEEHMRRLGRLSHPNLLPLVAYYYRKEEKLLIHDYVPNRSLANLLHGGGESGGMKKAAVHWAARLKIVKGVARALSYLYDELCMLTVPHGHLKSSNILLDAHHGPLLTDYALVPVMNQSHAAQLMVAFKSPERKQFGRSSKKSDVWCLGLLILEILTGRPPTYDPPKAAAPSGELSSSQQKPGPAAGNTDLVTVVGSTPEGEWLNTVVDRDLRGEEEEDKEEMVKLIRVGMACCESNVDNRWELKTAIERIEELKAKERPDEEQATVIDEDYSDVALN

SEQ ID NO: 356 - protein, 248 aa, Zea mays
MAAAEAIARGALSRSRVVARGLVHAAQVVGLAVFLRAFAEFPWTAAAAPPILRAAASFLAPPRLYFLAANVIVVALATLFRRDAASSSPPGSSGGDAQHPFLAFLGPALPPITEAEEPSGQEAPPEVVFEDKEAVHVRTLRAQPPRRSMSEKTGGGGGGGAAGSAASPELRRAKSENGRRRQRRSSSSAAAAAVAELGVDDGEAFRLAVEAFIAKQQTWFHREESLVARADAGGEDGPAIAGAAVAVQ

SEQ ID NO: 357 - protein, 491 aa, Oryza sativa
MSDHQFAGQPDVQCLVCTRPFTLDAQVTDTFEALAICRDCKATVLNDVERDEITSTSHHTRRRRQRSRTASIDSLEDAFSQEFSQLIDLARRQGRETDIDSSSVLPQHASYNATPSHSQRWHASDDESDGLNYVDSVFGEIESTISFGDYGADSDTSIEEHSVSARRRISIQLDNGSYMNTDTDIDPMNARLDQWDSDDQEDVEESGFDETINTMTQHQQQSHDIQLSGLSEDESEDGVWNWSVAVRQRANVTNLLEDMEGPEMRTTFVGNPDDYVDARQFEMLLEQFAEDNSSRRGAPPAATSFIENLPSVIISTSHQINDDVICPVCKDPIPTRARAKQLPCMHLYHSSCILPWFSSRNTCPVCRYELPTDDAEYERSKQATTNVRDIQVVEENSDEQEVQVTRQMAVGAIEETNTSEHNVRVDEQPSSARRRSGWLFIAAAPVVSLIGFALVLCFTNPARSGRRQLYCRSPSATEVHVGTKKSWWSMF

SEQ ID NO: 358 - protein, 661 aa, Oryza sativa
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVGCDIQKDSVVLKSSEHIGPAEIGLLATVGVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 359 - protein, 2137 aa, Oryza sativa
MAAALAWRFNGTNGGADLEHKVQESEPPTPVSVMRMVKNRANVEDEETLSSVAQCIEQLRQGSSSTQEKENSLKQLLDLLETRDTTFGAVGSHAQAVPILVSLLRSGSSGVKMLAATVLGSLCKEEELRVKVLLGGCIPPLLALLRSKSAESQTAAAKTIYAVSQGGIRDHVGSKIFSTENVVPVLWEQLKVSLKNESLVDGLLTGALKNLSKNTDGFWSATVQCGGVDILIKLVASGQANTLANACNLLGALMMEDSSVCSKVLSGETTKQLLKLLGPGNETYIRAEAAGALKSLSAQSKEARRQIANSNGIPALINATIAPSKEFMQGESAQALQENAMCALANISGGLSYVISSLGESLESCSSPAQIADTVGALASALMIYDTNSESISASDPLVVEKTLMKQFKPKAPFLVQERVIEALASLYSNPVLCRTLADSDAKRLLVGLITMAGTEVQDDLTKSLFALCKKDCDLWQALQGREGVQLLISLLGLSSEQQQECAVALLALLSKENDESKWAITAAGGIPPLVQILETGSPKAKEDSATILGNLCNHSEDIRACVESADAVPALLWLLKNGSDNGKEIASKTLNHLIHKSDTGTISQLSALLTSEQPESKVYVLDALKSLLSVAPLNDILHEGSAANDAVETMIKILNSPKEETQAKSASALAGLFHCRKDLRETHIAVKTLWSVMKLIDVQTDKILMAASSCLAAIFLSIKQNKDVAAIGRDALAPLVSLANSTVLEVAEQATRALANLFLDHELSLQVSFEEIIFPITHVLREGSIDGRTHAAAAIARLLQCRPINQPLSDTINRSGAVLALAGLLEAANGEAAATSEVVDALVLLSKPKVSSGHTKAPWTVLAENPHTILPLVSCVADAAPSLQDKAIEVLSRLCSDQHDIVGGLVSEIPGCISSVARRVIGSNMLKVKVGGCALLVCAAKEHCQKQIEILSDSSLYIQLIHSLVSMIHMTNLPSENGSGENISDIKISRHSKENNNSDETVCRTAVISGNMIPLWLLAVFARHDSKTRAEILEAGAVEMLMEKISQNAFLYVGEEDSTAWVCALLLALLFQEREINRSNAALHSIPVLSNLLRSDEQAYRYFAAQALASLVCNGSRGTLLAVANSGAATGLISLLGCAEVDIADLLELSEEFMLVPNPDQITLERLFRVDDIRVGATSRKSIPLLVDLLKPIPERPGAPFLALGLLTQLAIDCPPNMMLMAEAGILEALTKYLSLSPQDATEEATTDLLGILFSCAEIRHNEAALGTVNQLVAVLRLGGRNSRYSAAKALESLFIADHVRNSESARQAIQPLVEILSTGMEREQHAATSALVRLLSDNPSRALTVADVEMNAVDVLCRILSSDSSAELKGDAAELCCVLFANTRIRSTSAAARCVEPLVALLVCEANPAQLSVVRALDRLLDDEQLAELVAAHGAVIPLVGLLFGKNYTLHEAVARALVKLGKDRPGCKLEMVKAGVIESILDILHDAPDFLCIALAEMLRILTNNASIAKGPSAAKVVQPLFSLLSKADIGPEGQYSTLQVLVNILEHPECRADYNLTPRQTIEPVISLLNSSPPAVQQLAAELLSHLILEENLQKDTITELAIPPLIQVLSSGLPNLQQRAIKALANLALAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRSHQCEEAAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTEPATLCIPHLVTSLKTGSEATQEAALDSLYLLRQAWGACAAEIFKAQSVAASEAIPLLQYLIQSGPPRFQEKAELLLQCLPGTLTVTIKRGNNLRQSVGNPSAFCKLTLGNNPPRLTKIVSTGATPEWDEAFAWAFDSPPKGQKLHISCKNNSKFGKKSFGKVTIQIDRVVMLGSVAGEYTLLPESKSGPNRNLEIEFQWSNK

SEQ ID NO: 360 - protein, 629 aa, Oryza sativa
MMSRFMQIGKSRKLVHDVLVNSKPNSFTAHNIGSNFAFGLAHTGRACLHGKVPHGPGTSSMLGRAKESLYRNPAARNFSVLSTCSQNAFHGQLAWKQLMTIGSHVPKASPILSRVACAISLAATRSNLVPYLFAFVAGEIMLAQKTSADGEYLPIRDSLYTRAQDGRIYVTSLIFSAVELVIIIFRSIYLALLFTPSILMAPFADTLGSKYRKTWLRLVHRTLEKAGPAFIKWGQWAATRPDLFESDLCAELSKLHTKAPAHSFAYTKKTVEKAFGRKLSDLFENFEEEPVASGSVAQVHRAGLRFRYPGQHIKRVTVAVKVRHPGVGESIRRDFTIINAVAKISRYIPTLNWLRLDESVQQFAVFMMSQVDLAREAAHLSRFIYNFRRWKDVSFPKPLYPLVHPAVLVETYEQGESVAHYVDDLDGHDRIKSALAHIGTHALLKMLLVDNFVHADMHPGNILVRVIQPRNSNNTLLKSRPHVVFLDVGMTAELSSNDRVNLLEFFKAVARRDGRTAAERTLRLSKQQNCPNPKAFIEEVERSFSFWGTSEGDAVHPAECMHQLLEQVRRHKVNIDGNVCTVMVTTLVLEGWQRKLDPDYNVMKTLQTLLFKEDWAKSLQYTIEGLMAP

SEQ ID NO: 361 - protein, 972 aa, Zea mays
MRPLALLVLAHLAALAAAAEAKGGVAGAGLGDDVLGLIVFKADVSDPDGRLATWSEDDERPCAWDGVTCDARTGRVSALSLAGFGLSGKLGRGLLRLEALQSLSLARNNLSGDVPADLARLPALQTLDLSANAFAGAVPEGLFGRCRSLRDVSLANNAFSGGIPRDVAACATLASLNLSSNRLDGALPSDIWSLNALRTLDISGNAVTGDLPIGVSRMFNLRELNLRGNRLTGSLPDDIGDCPLLRSVDLGSNSLSGNLPESLRRLSTCTYLDLSSNEFTGSVPTWFGEMTSLEMLDLSGNRLSGEIPGSIGELMSLRELRLSGNGFTGALPESIGGCKSLMHVDVSWNSLTGALPTWVLSSSVQWVSVSQNTLSGDLKVPANASSVLQGVDLSNNAFSGVIPSEISKLQNLQSLNMSWNSMYGSIPASILEMKSLEVLDFTANRLNGCIPASKGGESLKELRLGKNFLTGNIPAQIGNCSALASLDLSHNSLTGVIPEALSNLTNLEIVDLSQNKLTGVLPKQLSNLPHLLQFNVSHNQLSGDLPPGSFFDTIPLSCVSDNPGLCGAKLNSSCPGVLPKPIVLNPNTSSDPISPTELVPDGGRHHKKTILSISALVAIGAAVLIAVGVITITVLNLRVRAPGSHSGAVLELSDGYLSQSPTTDMNAGKLVMFGGGNPEFSASTHALLNKDCELGRGGFGTVYKTTLRDGQPVAIKKLTVSSLVKSQVEFEREVKMLGKLRHRNLVALKGYYWTPSLQLLIYEFVSGGNLHKQLHESSTTNCLPWKERFDIVLGIARSLAHLHRHDIIHYNLKSSNILLDGSGEAKVGDYGLAKLLPMLDRYVLSSKVQSALGYMAPEFACRTVKITEKCDVYGFGVLILEILTGRTPVEYMEDDVVVLCDVVRAALDEGKVEECVDERLCGKFPLEEAVPIMKLGLVCTSQVPSNRPDMGEVVNILELIRCPQDSPETELG

SEQ ID NO: 362 - protein, 229 aa, Zea mays
MAWRGPLGAGEEALDSGLELSLGLPAYFARPSGLDAAREEPAEASAYAIQAASGSNVSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 363 - protein, 930 aa, Hordeum vulgare
MAEVSAAAAPVPEGVLHRRIEFHPARRPHAAVAVGGGGFQMETLNPDAADGAAAAAGGAARGEAEARRPEKAEALGLDPELTVARIYLGRIGAGLQNLGNTCYLNSVLQCLTYTEPFAAYLQSGRHESSCRTAGFCALCALQNHVKTALQSTGKIVTPSQIVKNLRCISRSFRNSRQEDAHELMVNLLESMHKCCLPSGVPSESASAHEKSLVHKIFGGRLRSQVKCTRCSHCSNTFDPFLDLSLDIGKATTLVRALQNFTEDELLDGGQKQYQCERCRQKVVAKKRFTIDRAPNVLTVHLKRFSPFRPREKIDKKVDFQPVLDLKPFMSDSKGANYKYSLYGVLVHAGWSTQSGHYYCFVRTSSGMWHNLDDNQVRQVREPDVLKQKAYMLFYVRDRIGNTLGCKDNITPNLPVNKVIPGKISSINGAIRSGVMEAKSSGLTSPYANKKLQSTSNAHSSVSNMTLVDHCSTNDGKAETAAAPQNSVLPAAQKALGPQNDGVTLSTKSKQVASSNHKETSSSGQPASSNQTMAKMSLQEPKAGGAFAKLGNNTSIVSSMVSGPAGLSETDKQTSCAQTCSKPSLNLVGTITGFTTQTFQTKDAVVSNGVIPSTSGGGPVSSEKMKDLTGSLKQDDHTVKALTTSKEKTLLPGLEQVDVGKQISSQVSTKVVPGDSCNGRMTKRVDWKSKKLVRYPVIKLWLRPRQLPLKQQKKKHKRTKKHAIVKDTTSVDCSGDNSSEQQTSTSATVPPKTAESTSRKRKHSHASVSSENDTKAFKDSQQVVGASSAGAGDHNMDTRNSKSGTSASTGLPKLGSSSSANQAHSRNNGDAKRQVVIHTEDLRAEVTVPCWDDVAVPNTETIEYRSSGKKSIGYVLDEWDEEYDRGKAKKVRKAKEDEDDDGTNPFQAEANHVSARKEKQRPWSKPARPRR

SEQ ID NO: 364 - protein, 292 aa, Hordeum vulgare
MPPLLLLLLAALAPVLSHAAAGGSYDPARVAQISWRPRAFLYSGFLSHAECDHLVELAKGRLEKSMVADNDSGKSVMSEVRTSSGTFLSKREDEIISGIEKRVAVWTFLPEENAESMQVLHYEVGQKYDAHFDYFSDKKNVKRGGHRVATVLMYLTDVKKGGETVFPVAEGRDLQHKDETWTECARHGLAVKPRKGDALLFFSLHVNATTDPSSLHASCPVVEGEKWSATKWIHVRSFDNPPDVMTDAPCSDANEQCPRWAALGECYKNAKYMVGTKDTLGSCRKSCGVCDA

SEQ ID NO: 365 - protein, 474 aa, Hordeum vulgare
METPTVVLLPVWSAGHLMSMLDAGKRLLARSGGGLSLTVLVMQAPAANDRAEVAAHIQREEASGLDIRFQHLPAVEPPTDCLGIEEFVSRFVQLHAAHVKAAISGLACPVAALVVDFFCTTMLDVSRELVVPAYVYITADAAFYALLLRLPALHEEVAVEFEEMEGMVGVPGLPPVPPSSLPVPVMDKKNPNYTWFVYHGRRITEAKGVIINTVTELEQSVLAAIGDGRCTPGIPAPTVYPVGPVLSLTPPAEETHECVRWLDAQPPASVVLLCFGSMGFSTAPQAHEIAHGLERSGQRFLWVLRGPPAAGAGPGQPSDADLGELLPEGFLERTKEKGMVWPTKAPQKEILAHASVGGFVTHGGWNSTLESLWFGVPMVPWPLYAEQHLNAFTLVAYMGVAVAMEVDRKRNNFVAASELERAVKVLMERDSEEGKRAREKAAEMKAACRKAVEEGGSSYSALGSLSEEIINGAN

SEQ ID NO: 366 - protein, 491 aa, Hordeum vulgare
MAAATPTPTLVLVPEWGAGHLMSMLESCKRILLCGGGRAFSITLLVMRPPTAEATSQVEEHVRREAASGLDIRFHRLPAVDLPSDAAGVEEFIARYIQLHAPHVRDAVAGMSCPVAALVLDLFAAPMVDVARELRVPSYVFMSSTGAMLALMLHLPVLHHVVTVEFDEVEDGEVHVPGLPPIPPESMPCPVVDKKSPNYTWFVRLGDSFMDATGIIANTADGLEPGPLAAVADGRAVPGRPAPPVYPVGPVLSLGSSKKDSPEPPHQCVAWLDAQPPASVVFLCFGSMGWFEPAQVAEITAALERCGHRFLWVLRGPPSSQSGAGAPDGSEHPTDADLDELLPEGFLRRTEGKGLVWPTWAPQKEILAHPAVGGFVTHGGWNSVLESLWHGIPMAPWPLYAEQHLNAFELVADMGVAVPLKVDRRRGNFVEAAELERAVRCLMGEEGRTAREKAAGMRDVCRKAVDKGGSSDAALQRLSEALHHGAVAPTI

SEQ ID NO: 367 - protein, 89 aa, Hordeum vulgare
MPDVVLKGVIGDDEYGCPPRSNGSAPFEHISFRELAARGTSKMDMTSITCCEENNIPVVIFNMLEPGNMSRAICGDQVGTLVDQSGRMT

SEQ ID NO: 368 - protein, 490 aa, Hordeum vulgare
MEIAGPLAPGERPHAVMIPFPAQGHVTPMLKLAKLLHARGFHVTFVNNEFNHRRLLRSQSADTLRGLPAFRFAAIADGLPPSDREATQDIPALCYSTMTTCLPRFKELVFKLNEEAEASGGALPPVTCVVADSIMSFGLRAARELGLRCATLWTGSACGFMGYNHYKDLLHRGIFPLKEEAQLSNGYLDTTIDWIPGMPKDMRLRDLPTFLHTTDPDDIMFNFFVHETAAMSQASAVIINTWDELDAPLLDAMSKLLPPIYTVGPLHLTVRNNVPEESPLAGIGSNLWKEQDAPLRWLDGRPPRSVVYVNFGSIAVMSKEHMLEFAWGLANTGYAFLWNVRSDLVKGDDEAALPPEFSTATEGRSMLSTWCPQEKVLEQEAVGVFLTHSGWNSSLEGICGGVPMVCWPFFADQQTNCRYKCTEWGIGMEIGDDVKRTEVEALIREAMEGDKGREMRRRVLELWESAVASARPGGRSMRNVDRLIHEVLLA

SEQ ID NO: 369 - protein, 842 aa, Hordeum vulgare
MSSGLKNNKKKGHEWDLNDWRWDGSLFLAAPSSNADAPSGCGSRELGRAEEGGSFGAADKSSRRRRRRVSTVDNPDELPHERIAVRRGQIGEEERPANATAGASSSSAPSCLVDGCHADLRDGRDYHRRHKVCEVHTKSTLVRIKNIEHRFCQQCSRFHLVQEFDEGKKSCRSRLEKHNGRRRKAQAQAVSSSSENQSLTNTLLLLLRQLAGQDSAASSSEQINGPNFLVNLLKNLAAVAGTQACQDMLKDATSSNAGNYVGNQSGPPVPAEEPPMKRRARNFDLNDTYVEEDESRTDKIVFKLFGKQPNDFPADLRTQVLNWLSHYPSDMESYIRPGCVILTIYLRLPNWMWHKLNVDPAPWIENLISISTHGFWETGWLYARVQDRLTLSCNGRLTLVCPWLPVIGDKHQILCVTPIAASCKSTANFSVRGFNIAQPTTKLLCIFGGKYLVQEATQKLHDDTAVQQGPQCLAFSCSFPSTSGRGFIEVEDYDQSSISFPFVVAEESICCEIRMLEEKLNIFAFANVLEGREDLMASRSQALKFLHEIGWLLQRSHSRATSSKAPQQHRVVGFLAARFRWLLSFAVDQEWCGVVKMLLDTLFQGNIDVPSPVEFVLGESLVFKAVNKRSKPLVDCLLRYTTNSAPVGGGAVATPARFVFTPDMTGPSDITPLHSAATISNAAAVLDALTDDPQQLGIKAWKNARDATGYTPEDYARRRGHTSYIQMVQNKINRGLPAAHVSVSMTTTGITEEHADAGRPKSTDQTIFDVEKSLPGCRQCVQLQHIAYRPCPNRFLSNRPAVLSLVAIAAVCVCVGLIMQSPPVVRGMPGPFLWNRLRWGPT

SEQ ID NO: 370 - protein, 545 aa, Hordeum vulgare
MPAAAFASALASPPPPWAPRPSPRHASLRLPPPRSSGGGGDKPTTSWVSPDWLTSLSRSVLGRGNDDSGIPVASAKLDDVQDLLGGALFLPLFKWFREEGPVYRLAAGPRDFVIVSDPAVAKHVLRGYGTRYEKGLVAEVSEFLFGSGFAIAEGALWTVRRRAVVPSLHKRFLSVMVDKVFCKCAERLVEKLETYALSGEPVNMEARFSQMTLDVIGLSLFNYNFDSLTSDSPVIDAVYTALKEAEARSTDLLPYWQIDLLCKIVPRQIKAEKAVNTIRNTVEELIIKCKAIVDAENEQIEGEEYVNEADPSILRFLLASREEVSSLQLRDDLLSMLVAGHETTGSVLTWTIYLLSKDPVALRRAQDEVDRVLQGRLPRYEDVKELKYLMRCINESMRLYPHPPVLIRRALVDDVLPGNYKVKTGQDIMISVYNIHRSPEVWDRADEFIPDRFDLEGPIPNESNTDFRFIPFSGGPRKCVGDQFALLEAIVALAIVIQKMDVQLVADQKISMTTGATIHTTNGLYMNVSLRKVEQEADLALSPSG

SEQ ID NO: 371 - protein, 568 aa, Hordeum vulgare
MGRSRGVPNSGDDDTNHRSKRRRVASTGDASDSLSAACGGAGDGKKALYHCNYCNKDLSGKIRFKCSKCPDFDLCVECFSVGAEVQPHRSNHPYRVMDNLSFPLICPDWNADEEILLLEGIEMYGLGNWAEVAEHVGTKSKAQCIEHYTTAYMNSPCYPLPDMSHVNGKNRKELLAMAKVQGESKKGIPLLSGDLTPKAESPFSPSRVKMEDALGEGPASRSPSHIPGGANKKASTAGHFKDNSNLSKVEDGHMDRSIGVKKPRYSADEGPSLTELSGYNAKRHEFDPEYDNDAEQALAEMEFKETDTETDRELKLRVLRIYLSRLDERKRRKEFILERNLLYPNPLEKDLTNEDKEVYHRYKVFMRFLSKEEHEALVRSVIEERKIRRRIQELQECRSAGCRTLAEAKIHIEQKRRKEYEANALKAKESGQLISNSKSGHKTNRPMKVETDGSLDLKKGSAILDAGGRDSPKSTGPTSAKQWDDWDIVGLPGAELLSVSEKLLCCQNRLLPSHYLRMQEVLMQEMFKGNIVKKEDAHVLFKVDPAKVDTVYDMVTKKLGNNEEAPMV

SEQ ID NO: 372 - protein, 491 aa, Hordeum vulgare
MKEANQGAGDRESRRTVVMYPAPGAGHLIPTVEFARLLVSHGLAVIVVQRGLPAGNATVPASSLYGNGDASASPFLSFHYIPEPPLPHGMPEGDHVGKVFELSRASNPELRDFLRATAPAALLLDFFCYSAADVAAEIGIPTYFFFLGCTASLAVLLHLPVIHGQNAVNLGDLGGEPVKVPGVTPIPAHDLPAAFLDRSSVSYKHFLAVSQQLGQSHGVIVNSRRSLEPRATDAVAAGLCAPPGRTTPPLFCIGPVVKSEEVAEKQGEECLAWLDTQPEASVVFLYFGSMGRFSAEQIKEMAAGLEMSGQRFLWVVRSPAGGNGNGNEHPGEPELDVLLPDGFLDRTKDRGLVVMSWAPQREVLAHGSVGGFVTHCGWNSVLEAVMAGVPMLGWPLYAEQRMNKVLLVEGMQLGVAVERGEDGFVTAEEIERKVTWLMGSDGGRELRERTLAAMRGAREALSDGGDSRAALLQLVQRLSAPDVTEESVCQL

SEQ ID NO: 373 - protein, 524 aa, Hordeum vulgare
MTMVALGLCSSFFSVMVMLAVMYVVRRLGSKWTCSSAPGALPPGPCPWPVVGSLPELKLFNKLPAFRWIHQVMEKMNTDIACFRLGGVHVIPITCPRIAREVLKKQDEIFASRPETFASCVASGGYVEAALAPFGVQSTKMRRVLTSDIISPSRHKWLHDKRVEEADNISWYMYNLTGGEEGGNVDVRHLSRHYCGNVIRRLLFGTRYFGEAGHGGGPGKLEMEHMDASFAAQGILYSFCVSDYLPSLLGLDLDGHEKIVKDANAVLDRLHDGVIDERWKQWKAGERGEVQDFLDVLITRRDPRLTMEEVKAQAKLINLAAVDNPSNAAEWALAEMVKNPELLGRAAEELDRVVGRERQVQESDIPQLNYVKACIREAFRLHPIAPFNVPHVALADTVVAGYRVPKGSHVLLSRLGLGRNPAIWNDPLRFNPDRHLEGAGGNLELTENELRFISFSTGRRGCVAPMLGTAMTVMLFGRLLHGFTWSKPAEMPDIQLTESHNDLSMAKPLVLHAKPRLPLHLYRP

SEQ ID NO: 374 - protein, 549 aa, Hordeum vulgare
MAPSEECGWLLYVSLAAKCCANGDGEPYRVVSFVAVLLAAFVVTSLLHWSSQGGAAWGRYWWTRKGLGIGEARVPGPRGFPVIGSMGLMTGLAHRKLAVAASGNVRRRRLMAFSMGETRVVVTADPDVARELLASPAFADRPVKESAYGLMFHRAIGFAPYGAYWRTLRRVSSSHLFSPRQVAASAAQRAVIARQMVDAMRPVGSAGIKHVEARRFLKRASLHNVMWSVFGRRYELDEVEREEAAELKSLVDQGYDLLGQLNWSDHLPWLARFDLQKIRSKCSALVPRVNRFVGRIIDEHRAARNDADADAVVDFTDVLLSLQGSDKLSDADMTAVLWEMIFRGTDTVAVVIEWVLARLVLHQGVQARVHEELDRVVGPNRAVTESDAASLVFLQAVVKEVLRLHPPDPLLSWARLATSDVHVGGLLVPAGTTAMVNMWAITHDPAVWAKPGEFKPERFLAGPLSADFSVTGSDLRLAPFGSGRRSCPGKSLAMATVGFWVATLLHEFEWTPPPPSSAGPGGVDMSEVLRLSCEMAAPLEARLRPRRTV

SEQ ID NO: 375 - protein, 536 aa, Hordeum vulgare
MSMQQQQQQPTSANLLGAMPASSMISIAFTAAVATAVLFVAVAVARYNRKYRGLRLPPGPPVWPIVGNLFQVAFSGKLFIHYIRDLRREYGPILTLRMGVRTLVVISSAELVHEALVEKGPEFASRPAENTTRNIFSSNKFTVNSAVYGAEWRSLRRNMVSGMLSTSRLREFRPARLRAMDRFVARMRADAVASTDEASVWVLRNARFAVFCILLDMTFGLLDLDEEHIVHIDAVLKRVLLAVGVRMDDYLPFLRPFFWRKQRLALAVRREQIDTLLPLIDRRRAILRDMQRSPPDPNVAAPFSYLDSLLDLHIEGREGADDELVTLCAELINGGTDTTATAIEWAMARIVDNPSIQARLHEEIMQQVGDARPIDDKDIETMPYLQAFVKELLRKHPPTYFSLTHAAVKPGSKLAGYDVPTDANLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 376 - protein, 400 aa, Zea mays
MLRVRNRLLPLLGAASPLPSPIHIHLRVCRLLSTSTSTATVPAPFSLENYLVAACGFAPAQARLVSKKAFNELSRESKRSSEEHSCRRLISASNPDAILALLSGAGLSRADIAAVVFADPLILRASVSKIAPRLVALRDRVGLSTPQIARFLLVGSRALRRCDVVPKVEFFLSFLGSFDRVLAVAKANLGIFNANLEKVIKPNIDLFRQRGVRNVPKICLHRPRTLSFNLERVKEFLLRAEELGVPAASPLFMQAVGVVTSFPPEKVAAKLDFFKRTLGCSESEVSNAVSKMPQILALSEATLLRKIEFLVNEGAIEPQYIMQRPILLAFSLEKRLVPRYRVIKVLQGKGLLNSNMSLSSLASLAEETFKSKFVDCHKDCVPGLADAYAAACASIVPSTV

SEQ ID NO: 377 - protein, 520 aa, Zea mays
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWAALHLQETAATLLTASLATRNSEPVNSATTVLPAQGGSSTLENPSDLSSQSPDVSGASEVAHSTDLVSQIPNSTALYEPLEINEKEGSKSNSDDKTVEKLGSTSTEFDCDLLDSSRKSNTVSSADSKGEDITPSAKRKNKDDGSHTSIPLEDTPSTLTNKGVSSQSRVEQDKATSFVSVKSDDIQLSIRMPSGNRLEIKLTKQDVLRKVKNFVDENQGNGLGSYDLSLVYPKRVFFEQDMEATLSELGIQNRHAMIVVPHRQSGQVSRRHSSASYDMGVNSGADDVGGNSGAGGYFGYLRTVLSYVNPLSYLRGNTNSSNTELQSNEGLRQLRHGSGPWSEPRPLGNRGHEVTDADSANTLRRRPRPFGANIHTLGSEDHGPSDERNVFWNGNSTEFGGDDRK

SEQ ID NO: 378 - protein, 410 aa, Zea mays
MASASRALLLSRALQAGASRRVPALLRPVAAAASLLPAVAGPAGAALGARVRCFATQPATSSLRDSSPNWSNRPPKETILLDGCDFEHWLVIMEPPPGDASNPDITRDEIIDSYIKTLAQVVGSEEEARQKIYSVSTRHYFGFGALVSEELSYKLKEIPKVRWVLPDSYLDVKNKDYGGEPFINGQAVPYDPKYHEEWVRNNARANDRNRRNDRPRNFDRSRNFDRRRENMQNYQNRDGPPAQGFNGPPPPPGQNQMPSHHSQGNMSPQPPHAGGGQPNYQPQMQNPQTGYNPGGAPHYQQGAAPGYQGGPPGYQGGYQGNPGPAYQGGNTGYQGGNPPPPYQGSNPPPPYQGGSPPGPPPPYRGGSPPGPPPPYRGGNPNVPPYSGGGNPGYPGGSPGYQGQGGNSNFQ

SEQ ID NO: 379 - protein, 559 aa, Zea mays
MELAVGGGMRRSASHTSLSESDDFELTRLLSKPRINVERQRSFDDHSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFVGNVSPARMDFRWFALGNMIAILSSLATPEQSNAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSITGYLVAKMLLEDPSHLGMIALEEDKAMLKPVLKRSASWTN

SEQ ID NO: 380 - protein, 186 aa, Zea mays
MAPSTALAPVAFRSAFSTPLASKPTRNRMNIEGAFCLPCSTRKRASYRPFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 381 - protein, 459 aa, Zea mays
MAASCGGRVVVFPFPFQGHFNPVMRLARALHARGVGITVFHTAGARAPDPADYPADYRFVPVPVEVAPELMASEDIAAIVTALNAACEAPFRDRLSALLSAADGEAGEAGGRVRCVLTDVSWDAVLSAARGLGVPALGVMTASAATFRVYMAYRTLVDKGYLPVREERKDDAVAELPPYRVKDLLRHETCDLEEFADLLGRVVAAARLSSGLIFHTFPFIEAGTLGEIRDDMSVPVYAVAPLNKLVPAATASLHGEVQADRGCLRWLDAQRARSVLYVSFGSMAAMDPHEFVELAWGLADAGRPFVWVVRPNLIRGFESGALPDGVEDRVRGRGVVVSWAPQEEVLAHPAVGGFFTHCGWNSTVEAVSEGVPMICHPRHGDQYGNARYVCHVWKVGTEVAGDQLERGEIKAAIDRLMGGSEEGEGIRKRMNELKIAADKGIDESAGSDLTNLVHLINSY

SEQ ID NO: 382 - protein, 489 aa, Zea mays
MGSLPPVDGQRRPPHVVMIPYPAQGHITPMLQFAKLLHTRGFHVTFVNNEFNHRRHLRARGPNALDGTDGFRFTAIDDGLPLFEADATQDIPALCHSTLTTCLPRFKDLIARINAEAEAEGQPTVTCVVGDSTMTFALRAARELGLRCATLWTASACGFIGYFHYRHLVERGMVPLKNEEQLTDGYLDTIVDWIPGAPKDLRLRDFPSFVRTTDPNDVMLNFFIHETEGMSQASAVVINTFDELDATLLAAMAKLLPPIYTVGPLQLTVRNNVQANSPVAAIGSNLWKEQEAPLRWLNGRAPRSVVYVNFGSITVMSNEQLVEFAWGLANTGYYFLWNVRPDLVKSGDSAGLPPEFSAATEGRSMLSTWCPQAAVLEHDAVGVFLTHSGWNSTLESICGGVPMLCWPFFAEQQTNCRYKCTEWGIGKEIGDDVQRGEVESLIREAMEGEKGQEMLRRVTELRDSAVAAAGPDGRSMRNVDRLIEEVLLA

SEQ ID NO: 383 - protein, 511 aa, Zea mays
MSGMSDSAGGVRAGAELMVQQFHLKVLHAVLAVRTPRPHAFAAPAAASFRRRDRWFHLPLHDPPPPPEAADRLDELVPGEPLVVDVLLSPAGSVGARGEVVERWTVACEPWPDAAGGEEVAVNRAYKHCFTLLRSVYAVLRVLPAYRIFRLLCANPSYNYEMGHRVDTFAEPFSRPQEAAMRSQRFVPVETQLGRLVVSVQYLPSLAAFNLEITSLSPSKIIPDYVGSPAAEPMRAFPASLTEATGSGFPPSNQQQRPHSWASPVFWSHTPAHQARFSPPPVFYASPTPSPPHFPPRLMRWESAPMPIPQVSERRSPAHRQNMLPPPSTRRGDMRAAGALQSPSESGRLIGRMEELRIADPYVTSSPRHKGKDTKDGSGRFSALSSCDSPRQDDLDDVDYHFDVDDVDTPVSQPRRIDGKETGDQVGSSSHKSQDAQVGSLVNLLRNASPLRNPSNSSQISRAESSEVASASSVTSRRTSDALEELQSFKEIRERLLFRSSAKHQEPPGKP

SEQ ID NO: 384 - protein, 177 aa, Zea mays
MSAPNSDSNMQQLVPIAPPGKASGGDSEKGLVVVDLAGKRSGGVKLREDEEDLEVKLRRIMENVPVRVSNTSGSSAGSGSGDFHQYRQMRRREQDRLARMDADYQKRKKMAEFELRREERMKAAEERTAKKRLKRQKKKQRKKEKRAKTGNNGGDEPNRVESSDDDHGSDDDDESKQ

SEQ ID NO: 385 - protein, 362 aa, Zea mays
MVAAAAAAAAATATATATATAAALLAPGLKLCAGRARVSSPSGLPPRRVTAMASAPNSSFRPEEARYPPALELPIPRLSKFKVALCQLSVTADKSRNIAHARAAIEKAASDGAKLVVLPEIWNGPYSNDSFPEYAEDIEAGGDAAPSFSMLSEVARSLQITLVGGSIAERSGNNLYNTCCVFGSDGQLKGKHRKIHLFDIDIPGKITFKESKTLTAGQSPTVVDTDVGRIGIGICYDIRFQELAMLYAARGAHLLCYPGAFNMTTGPLHWELLQRARAADNQLFVATCAPARDTSAGYVAWGHSTLVGPFGEVIATTEHEEATIIADIDYSLIEQRRQFLPLQHQRRGDLYQLVDVQRLGSQ

SEQ ID NO: 386 - protein, 624 aa, Zea mays
MDNGFMDIPHPPLVNDPFVLVGCPAPASTMENMGQSTICMDGLNPAMVSCSHVNGNTHIMNGLTARDDGSRLLLGLGPTPNFYSAVSTGSKQAQRLSGQSSTSIDSGMLKLGLQTDDREAIQYLQQAPNGALHSLDIVDEASTSAAVRNMGGYMPSLLFAPCSNSIANETQVENQDSLDLTHSTSNSQHLQHDLQLSPEPSATTESSFGMSSDVVTATTTSERSHSRHPKKCRFKGCSKGARGASGLCIAHGGGQRCHKPGCHKGAESSSAYCKAHGGGRRCEELGCTKSAEGKTDYCIAHGGGCRCQHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVVHGGGKRCSVPGCTKSARGRTDCCVKHGGGKRCKVDSCGKSAQGSTHFCKAHGGGKRCTWSTGCEKFSRGKSGFCAAHGTLMARQREEEVVKNVGSMIGPGLFSGIVASSATAASSMTNEHSASGVSTASDCDGTVRSQSMIPPLVLVPRSMMPSWSTEPVDGGREGGHVVPEGRVHGGGLLSLLGGSFRDADVEKL

SEQ ID NO: 387 - protein, 407 aa, Zea mays
MAAVFFHHVVGDLTVGKPEVAELHDTDTLDDAARAIAASPEGAVPVWRPRAAPDDPPSGARFIGMISALDIAAFVASAGVGDRSMRAVVGEVVQPNPALLREIDPGTRLIDALELMRHGVKRFLVRKSGSWKGITKRFSVLYNGKWLKNMESTSPSAASSSSTQLSPRSGSAEKFCCLSREDVLRFLIGCLGALAPIPLTQISSLGAINPQYSYVEASAPAMEAIQKIPQDPCAVAVVETMPDGTRSILGDISTYKLWKCDYVSAAWALANLSAGQFVIGADENGSTPISVFPEPPISPSSPVEEISPGRSPRAKKFSSRSIGFLNNTQMSAWRTRSMYHRGRSTPLMCKTTSTLAAVMAQMLSHRATHVWVTDAESEEDGVVVGVVGYTEIFNAATRSTCPSPTAS

SEQ ID NO: 388 - protein, 239 aa, Zea mays
MGCEEEERLLFPSFVFPESFAEAATPGSGGEQKKARQRRRRKPRPAEGGEGADEQARKRRLSDDQARFLELSFRKERKLETPRKVQLAAELGLDAKQVAVWFQNRRARHKSKLMEEEFSKLRAAHDAVVLHNCHLETELLKMKDRLAEVEEEKTKLVAAAAAAAGGAAGAGSSSPSSSSFSTVTHHPAAALQVGQFGVEPEEAADLAYMTEYAYNSYMNMMDLAPAYFGGVVYDYDHFN

SEQ ID NO: 389 - protein, 427 aa, Zea mays
MAAADSSPLHIVIFPWLAFGHLIPGLEFAERLAEHGQRVSFVSTQGILRRLRPVAPALASLIDLVALPFPRIDGLPDGAEATSDLPPGTAELHVQAMDRLAPAFSAFLGAACADGSDRKVDWVLLDNFHASMADVASEHKVPCILNMPYSAATTEDFGIPDPSVLPMFRPFVETFKRCKVIAARSSFELEPESLPLMTKILGKPVIPVGLLPPAPAGGNTQRDDSAALSWLDEQPSKSVVYVAFGSEYPMTVKQLHEIARGLELAGTRFLWALKRPSVAHPDEDLLPPGFEERTRGRGSVVTGWVPQTSILGHGAVAAFMMHCGWGSTIEALQYGHPLVMMPVLVDHLSTARVMEQRKVGVKVRKEKSDEAFLGDNIATAIRAVMCEEESKRIFVANAKRMQEIVADDECHKRYIDEFVQSLRTYKN

SEQ ID NO: 390 - protein, 482 aa, Zea mays
MAPPPAMQSPGELNDGAYDAPHILFIPSAGIGHLTPVFRVIAGFSSRGIDVSVVTVLPTVSAAETDYFNGLFADYPAVRRVDMHLLPLDASEFTREDPFFLRWEALRRSVHLLRPIITNAAPRITAIITDITLTSCVIPIAKELDVPCHVLFPTAATMLSLNAYYPVYLEKLKGGPEPGVIGDAVDIPGVFRVPRSALPPALLDVNKLFTKQFIDNGRAIVKADGVLVNTFDAVEPAPLAALRGGKIVPGYPPVYTIGPLKSHATKAGDKPGDALLDEWLGKQRARSVVYVAFGNRSAARLDQIREIAAGLEDSGYPFLWVLKTTKVDREDDAELAEVLGDGYLERVKGRGIVTKGWVEQEELLKHPAVGMFVSHGGWNSALEASSAGVPLLVWPQLGDHRVNAMAAVRAGIGAWAEHWSWDGEDTLVTRQEIADKVKEVMADGKLRASVAVAREEAAKAVAEGGTSYRNMHDFIAKLKGGA

SEQ ID NO: 391 - protein, 510 aa, Zea mays
MGIVRVADDVEARLVVGAGGGGGAATTTTEPLLRHCHGGRKEEDDQGSKIRDSPEAEGASDCGRTDGGSLRMVLVSTAVAVCGSFEFGTCVGYSAPTQSGIVEEVGLSISEFAIFGSVLTIGAMVGAVTSGRLADFLGRKMTMRISATICIFGWLSIHLAKSAIMLYFGRTLLGFSTGVLSYVVPVFIAEIAPKNLRGGLATSNQLLICSGSSATYIIGALVAWRNLVLVGLVPCVLLLAGLFFIPESPRWLANVGREKEFHASLQKLRGEDADVSEEAIEIKEYIESLYSLPKARLRDLFLSKNIYAVIVGVGLMVFQQLGGINGVGFYASYIFSSAGFSGKLGTILIGIIQIPITLFGAILMDRSGRRVLLMVSASGTFLGCFLTGVSFYLKAQGLFSEWVPTLALSGILVYIGAYSIGMGPVPWVVMSEIFSINMKATGGSLVTLVSWLGSFAISYSFSFLMDWSSAGTFFMFSSASLITVLFVAKLVPETKGRTLEEIQDSLNTRR

SEQ ID NO: 392 - protein, 499 aa, Zea mays
MDRAAKPHFALIPFTGTISHVIPMADLGCLLAAHGAEVTIITTPVNAAIAQSRVDRAQSHGATTTITVTAVPFPAADAGLPEGCERMDLLRSQAEVPRFFVANKGFGEAVSRHCLGEALRRPSCVVSGACQTWTLGLARQLEVPCYVFHGFGAFALLCIEHLYRHRPQEAAALADDELFDVPALPPPFRLRLSRRQLPPHFMPTTSVAGKALQGIRDFDVAADGFVVHTFEELESGSTALLAEATGKKVIAVGPVSLCCAPSLDPRLVSNDDARRCMAWLDAKAPKSVVYVSFGSFGRMPPAQLMQLGMALVACRSPVLWLVKGADSLPDDVKDWLRENTDADGVAGSKCLVVRGWAPQVAILAHPAIGGFVTHCGWGSIMEAVAAGVPMATWPFFAEQFINEQLIVHVLGVGVSVGVTKPTENVLNATTDAAGGSQGEADAEVGMEQVKKAMDTLMDQGPKGEERRRKAHELKLKAKSALEKGGSSYTNLDNLILSFL

SEQ ID NO: 393 - protein, 588 aa, Zea mays
MVLARVLPLPAPSSAPHRRLLLPTQAAPAPARVLTVRAVACRAANAMAAVALDPPAVAPSPAEVAAVGVGEELPEGYDQMMPTVEPSRRRRAGLLLHPTSLRGPHGIGDLGDEALAFLHWLRDAGCTLWQVLPLVPPGRTAGEDGSPYSGQDANCGNTLLLSLEELVKDGLLMSDELPDPVDTEYVEFDTVANLKEPLIAKAAERLLLSHGELRTQYDCFKKNPNISGWLEDAALFAAIDKSINAFSWYEWPEPLKNRHLGALEEIYEKQKDFIETFMAQQFLFQRQWQRIRKYAQKLGISIMGDMPIYVGYHSADVWANRKSFLLDKNGFPTFVSGVPPDAFSETGQLWNSPLYDWKAMEADCFSWWIKRIKRALDLYDEFRIDHFRGLAGFWAVPSDAKVALVGSWRAGPRNSFFDTLFKAVGRIDIIAEDLGVITEDVVQLRKSIGAPGMAVLQFAFGGGSDNPHLPHNHEMDQVVYTGTHDNDTVLGWWQNLPEEEKKIVIKYLPEAENIDITWTLITAALSSVARTSVVTMQDILGLDSSARMNTPATQKGNWRWRIPSSVGFDSLSPEAAKLKELLALYNRQ

SEQ ID NO: 394 - protein, 511 aa, Zea mays
MPISAMRPSPSSVASSGDTAAPRMYFIPFPTPGHALPMSDLARLFASRGADTTLVLTRGNAARLGGPVARAAATGLRIRIVALTLPAEAAGLAGGHESADDLPNRELAGPFAVAVDLLAPLFADLLRRQPADAIVFDGVLPWAATAAPELGIPRYAFTGTGCFALSVQRALLLHSPQNGVASDTEPFLVPGLPDAVRLTRSRLAEATLPGAHSREFLSRMFDAERVTAGWVVNSFADLEQRYIEHYEKDTGKPVFAVGPVCLVNGDGDDALERGRGGDSSTAAEAARVLRWLNTKPARSVVYVCFGSLTRFPREQVAELGMGLADSGANFVWVVGDKDAPQLPDIDGAAPGRGLVVRGWAPQVAVLRHAAVGAFVTHCGWGGVTEAAAAGVPVLAWPVFAEQFYNEALVVGLAGTGVSMGAERGYVWGGEALGGVVVGRAAVAERVRSAMADEELRGRAGRVGERARRAVEAGGSSYEAVGALLEDVLRPQRQVQDLDAVRETRRDAEIFN

SEQ ID NO: 395 - protein, 483 aa, Zea mays
MGKLQERKPPACKTAARPRVLLLCSPCMGHLIPFAELARRLVADHGLSTTLLFASATSPPSEQYLAVAAAVPDAVDLIALPAPPPDALPPATAARERAELAVASNVPRVREIARELGAAAPLVALVVDMVGAAAARDVAAELGVPFYAFFTSPWMTLSLLLRLPEIDATRAGEHRDAAEPIRLPGCVPIHAHELPTSMLADRSSSAYAGFLSMAKGVAGVDGVLVNTFRELEPAVGGDGRLQLPVYPVGPLVWTRPAGVDTDHECMSWLDGQPRGSVAYVSFGSGGTITWQQTAELALGLELSQCRFIWAIKRPHQSSTIAAFFGTQRGDEHSPLDFLPEGFMERTRGMGLVAQSWAPQTAILGHPSIGCFVTHCGWNSVLESVINGVPMVAWPLYAEQNMNAAMMEVQVGVALRAKVGADRFIRKDEVANAIRRAIVGEEAERLRKRSSELRRQSAQALSKDGCSTRALAQIANAWKRASRK

SEQ ID NO: 396 - protein, 302 aa, Oryza sativa
MDGGGGMLGAVVCLLLVFAIFPLLLWRRRSDAAHRLPPQPLQDERVLRGGPAPGPAARRMRRRPLSTSADASTSRDRDVDDADSDLEEEIQDVPRGSKKKEKKRQDREAQRQAEEAARDSRRTKQDRYAEMRRKKDEEREAQERLMEEEARARKAKEEEAAALEFEKWKGAFSVDAEGTTESDTQDDGQGLLHNFVEYIKNQKCVPLEDLAAEFRMRTQDCINRIITLEGMDRLSGVMDDRGKFIYISTEEMKAVADYIRKQGRVSISHLASNSNQFIDLEPKPQYNEESNLDENAAAGTEL

SEQ ID NO: 397 - protein, 509 aa, Oryza sativa
MASDAKPDSPPAGVDPPPPKEEAKAEKEGEGEEPQSGGRKRGRRKKGEAEKEKEKPPPATPTIERPSRERKTVERYSELAPRVTPAKKSPAILQGSGSKLKDIPNIQFKLSKRKADENLQSLHVLMYGRKSNVHFLKRNISQFSGFVWTDNQEKQRTRIKEKLDKFNKEKLLDFCEILDIHVSRAATKKEEVSAKLLEFLESPCITRDVVLTDDKKGKKRGRRSKGNGQATAEGASDGKKRRKSRKQSTEAAKENDDEDDEGPADSEDASMGEEDDEDSEAKDNAGSDEEPDEPPAKKKATDDKQTKKAKEKDATAKKASTRPAKGVSKPSQDTEEDDEPEVELESKKVVKKVSKSSKESDVTVDKTTKKASKSKKDEGKDGQNNNSGALNNKARKKDAAKTTNKNKGKGKGSTEAGAAPTTEELHAVVSDILKEVDFNTATLADILRQLGTHFKMDLMDRKSEVKHIIEEVINSMSDDEEGEEDNAEDDKDKNAKEENSKEDADGDEK

SEQ ID NO: 398 - protein, 209 aa, Oryza sativa
MGGGAAASRVSSAMAVAVAAAAALVVMWAGTATAAAAVYEVGDKTGWTIMGSPNYTAWAASKKFHLGDTVVFTYNKQFHNVMAVSKSDYKNCDTSKPIATWSTGNDSVVLNATGHHYFLCGFPGHCGIGQKVDIRVAASGHSSAAPSMAPAPASGSEAPVAPGGGGGGSSGHAAAAAPSPHGNAAVGRSVFTAIAVSVLSVAAAGLKLI

SEQ ID NO: 399 - protein, 412 aa, Oryza sativa
MASTKIKVANPIVEMDGDEMTRVFWKSIKDKLIFPFLELDIKYFDLGLPYRDQTDDKVTVEAAEATLKYNVAIKCATITPDEARVKEFSLKSMWKSPNGTIRNILNGTVFREPIICKNIPRLVPGWTKPICIGRHAFGDQYRATDAVIKGPGKLKLVYEGKDEEIELEVFNFTGAGGVAQSMYNTDESIRSFAEASMATAYEKKWPLYLSTKNTILKKYDGRFKDIFQEVYEAQWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAAN

SEQ ID NO: 400 - protein, 480 aa, Oryza sativa
MEADPNPMVVLHACLGVGHLIPMVELAKLLLRRGLAVVIAVPTPPASTADFFSSSAPAVDRMAAANPSISFHHLPPPEYPDPDPDAFLQMLDTMRLTVPPLLAFLRSLPSVAALVLDLFCVDALDAATAAGVPAYFYYTSSAGDLAAFLHLPHHFATTEGSLKDMGKTPLRFPGVPPIPASDMPHTVLDRADRTCATRLGHYGRIPEARGILINSYEWLEARSVRALREGACIPDRPTPPVYCIGPLMAKGEEAANGERHACLSWLDAQPERSVVFLCFGSLGAVSVKQLKEIARGLENSGHRFLWVVRSPPQDPAKFFLPRPEPDLGMLLPEGFTERTRDRGMVVTSWAPQVEVLRHAATAAFVTHCGWNSVLEAASAGVPMLCWPQYAEQRMNKVLLVDGMQLGVVMDGYDEELVKAEEVEKKVRLVMEFEEGKKLRDRLTMAKEMAAKALADGGSSSLAFTEFLKDLNFGNTTKEKA

SEQ ID NO: 401 - protein, 711 aa, Oryza sativa
MENGDKDEKNVAVTEGSTNSEEKDQDEDLLRRTEMLNAKEAINSSNENSGNDSEAQIHVRDDSQKEFNEKMNKEGSSDPMEPTDSSQTEEDILAEDKSEEPVFDGTEVAEMEDLRRSSNQSVELDSDAHGSVLNERATAIKNFVKEKGAIAVSTFIRRLSGKKDENEFSVEDEKNEGSESISSGNIGSDAEPKSKEVQPKSEERTTWNPLNLIKIGRDFDTFMTGEAGHENVPDLIEQPTGKGRIIIYTKLGCEDCKMVRSFMRQKMLKYVEINIDIFPSRKMELENNTGSSTVPKVYFNDLLIGGLTELKKMEESGILDDRTDALFKDEPSSAAPLPPLPGEDDESGSGKIDELATIVRKMRESITLKDRFYKMRRFSSCFLGSEAVDFLSEDQYLERDEAVEFGRKLASKYFYRHVLDEDVFEDGNHLYRFLDNDPIIMSQCYNIPKGIIDVEPKPIVEVASRLRKLSETMFEAYVSEDGKHVDYRSIQGCEEFKRYVRTTEELQRVETHELSREEKLAFFINLYNMMAIHALVTCGHPAGPLDRRKFFGDFKYVIGGCAYSMSAIQNGILRGNQRPPYNLAKPFGQKDQRSKVALPYAEPLVHFALVCGTKSGPALRCYSPGNIDKELVEAARDFLRNVGIVVDPEAKVASVSKILRWYSTDFGKNETEVLKHAANYLEPAESEQFLELLANTQLKVLYQPYDWSLNI

SEQ ID NO: 402 - protein, 149 aa, Oryza sativa
MAMAAAEARVRQEKVKKFEDFVDRRLKPDLVNTIAQRDKVFQQQKTFLDLKRNIENLEKNGVTSMRSMVNLGSEVYAQAEVPDTRHIFVDIGLGFHVEFTWQEALQFISVRESRLARQIDEYTHLIASIKAQIKLVCEGIRELLELPAE

SEQ ID NO: 403 - protein, 542 aa, Oryza sativa
MAMEAEALLPEPEPESPPLLAVDHLGGPASRGSSGRWPAAFFLIGAEVGERFAYSGIMGNLVIYLTGPLRQPTAAAAAAVNVWMGTSMLLPLLGSAVADSWLGRYRTIVCASLLYILGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSKLPDSSDELLPSSSSEGDVSNSSSEFVPKEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKVISVQ

SEQ ID NO: 404 - protein, 505 aa, Oryza sativa
MYRAASGLGAIKRHGLDGQMLNVAIRCASTSVAQRSSGGFWTWLTGARSNALPPPDFTLPGVTIPPPLPDLVEPGKTKITTLANGVKIASETTPGPSCSVGVYVNCGSVHEAPETLGATQLLKKMAYTTTTNRSHLRVVREIEAVGGNVKASANREMMSYSYAALKTYMPEMVEVLIDCVRNPAFLDWEVKEQIMKLKAELAEASSNPETFLLEALHSTGYSGALATPLIASESSVSRLNTNVLEYFLAENYTAPRIVLAATGVDHDELVSIAEPLLSDMPGVTGPAKPKSTYVGGEYRRTADSSNTDVALAFEVPGGWLKEKEFVTVSVLQTLLGGGGTYSWGRHGKGLHSSLNHLANEFDQIRSIAAFKDVHSNTGIFGIHTSTDAAFVPKAIDLATRELTSLATPGKVDQTQLDRAKATAKSAILMNLESKASATEDMGRQILAFGERKPVEHLLKAVDGVTLKDITALAEKIISSPLTMASHGNVLNVPTYDSVSGKFRSK

SEQ ID NO: 405 - protein, 416 aa, Oryza sativa
MERDFLGAIGKDEEQRRHAEERKESDYFGAGGGAAAAAMDWSFASRAALMSFRSSSSAAAAAAREETRELAFPHFSALDGAKMQQASHVLARQKSFGAESHGIPQYAAAAAVHGAHRGQPPHVLNGARVIPASSPFNPNNPMFRVQSSPNLPNAVGAGGGAFKQPPFAMGNAVAGSTVGVYGTRDMPKAKAAQLTIFYAGSVNVFNNVSPEKAQELMFLASRGSLPSAPTTVARMPEAHVFPPAKVTVPEVSPTKPMMLQKPQLVSSPVPAISKPISVVSQATSLPRSASSSNVDSNVTKSSGPLVVPPTSLPPPAQPETLATTTAAAIMPRAVPQARKASLARFLEKRKERVTTVAPYPLAKSPLESSDTMGSANDNKSSCTDIALSSNRDESLSLGQPRTISFCEESPSTKLQI

SEQ ID NO: 406 - protein, 478 aa, Oryza sativa
MKKTMVLYPGLSVSHFLPMMKLADELVEHGYAVTVALIDDPLQKQIAFTATVDRVISSKPSICFHRLPRVDHLPAVTTNDGEFYLPGYLDLVRRHNEPLHGFLSSHFRGGIQALVVDMMSVEALDIAERLKVPGYLFHPSNASLFAFFLQIPSICAESKRSFSELGDTPLEIPGLPPMPASHFIDNRPEEPPESEVYKAVMDLVRRYTNKCSNGFLVNTVDSLEARVVNTLRHARRQGGRALPPFYCVGPLVNKAGERGERPERHECLAWLDRQPDRTVVFLCFGSTGIGNHSTEQLREIAVGLEKSGHRFLWVVRAPVVSDDPDRPDLDALLPAGFLERTSGQGAVVKQWAPQVDVLHHRATGAFVTHCGWNSVLEGITAGVPMLCWPLHSEQKMNKVLMVEEMGIAVEMVGWQQGLVTAEEVEAKVRLVMESEAGVELRARVTAHKEAAAVAWTDVGSSRAAFTEFLSNADSRQTS

SEQ ID NO: 407 - protein, 354 aa, Oryza sativa
MATDGDALESQAAAAAEAARELREAAASLVARRSADEDALRRRATALDADLRRLQASLSTLAPTTLDKVEEELERARVTISDSDVAAFLPSKRNGKFLKTFVGPVNVRVARKEDKLRVKDEYNNYRDRAAYMFLLFPSILLLLRWWIWDGCLPALAVQMYQAWLLFLYTSFALRENVLIVNGSDIRPWWIYHHYLAMLMALVSLTWEIKGQPDCSSKQRGVQLFLRWAIMQGIAMHLQNRYQRQRLRTRIALGKAKRMDVVAGETAGVEGQLLLLYPVLFTLQVFEGYVGVLLLKTALHGLASEWQVVVCGILLVVMAVGNFVNTMETLMLKLRFKAKMKRAKSRQDLSRQHQN

SEQ ID NO: 408 - protein, 1146 aa, Oryza sativa
MASSAEPPPKKRRLVEVHVPSPAPSPSSSSAPAPASPRSPVPPPPGVPPPPPPPPQTLAAAASPRPEEAVRKRRNREELRGLFECYRRIRLCVERKDARLLPELEQVYLSLIASSRGCTSVQRILADLIPQYASYCPTALEAATKVSINMYKWNLAIVTRGEDVDGVAYQTARACILGLTDICSTASCEAPKSSVLTGICSAVYITVLTFFISTFDGKDIYHIGSRKLLNLQDPVELLDILKQDSGGDNQQADDCLVELRALSLLCIFLLFPENILDACFALIASAEDVNGEGLYFLKQLTCHLNSGIITDALDVQGDGISQCTGMDVDHPSTKESVDSNLSSHSVGVSGSSMLQPNECYMTMAISRHPSLKGWILLRYKKLCDSCRTDVVSEVSSCLNVLGSLTQLEDNKSHMGSESSVLDKIDENSGGYLQPNKLACSYEQRMLLKTDIADRYGGKTVQNKNAQMVHTDEVKTEKLADVKLDVCKQGNVISDAGHQAARLDMHTPKSTHDSAGGAATLTSPGQNFGKAKHSYSEPSDLYGAHFSRDVISVSKELWIGSLGNSAAESLVRSKFEEFGPLANFLFYPPKNFALVEYGNIMHAVHAYGCMQGSSVWGGGLQIRYLDRLIGSKGFASGIAVGESRHIYVAKVKNKKDKDEVFDELKAAGLKRPCSFTDISSENALLLEFETATDAAAAKAHIRRQLHPDVCSQDKNTSGHELFVRNIDNSVPDMEFINAFSRFGEVIRWQFNKLDGNCLIDYRSPNAAATAKSHLHGARFGLKSISVESRSVHDKTLSPSVPMLAPSVSDSSHHEIRNPRVSGYNAGFTVPTERPIYGPSAPRAPQGILPCPPVSAHRGPVIPPPPIQTSFVRPVYPGPGSPWENTTPNPSFSHASPRMMPGSSFRMNPPAPLPFIPSSVTPLTQFPGGSAQQSEKRPPPPPPPPNVAPPPFTRQDIPPPPPSPPPLPITQPPSVPPPPNSPPPLQPATDPSDSQKQRSHPRWQGSLSKSGLHYCSIYASRIELDACRYEHAVSEPTGWPSRLDVTKRTDYQHVKTTFSNTPPSKREVCRLLPCSNGDQKGFRDFISYLKQRECAGVIKIPSVKPLWSRLLFILPPTPEACGMLELPPHPTECLIALILPKETTAEAT

SEQ ID NO: 409 - protein, 700 aa, Oryza sativa
MLRVGDDPLPAGRLLRPCSPRCAAMARRWPPLVVGLALLLLLSVAASSVVAKTDQPDVAALNVMFESMNKPSELLGWKASGGDPCGDDDEWKGIECSDSSVTEINLSGLGLSGTLGYQLSSLKSVTKFDVSKNNLNGEIPYQLPPNVVQLNLRGNAFSGGVPYSISQMTDLETLNLGKNQLSGQLTDMFSQLPKLTTMDLSFNSFSGNLPPSFQYLKNLKTLDVESNQFSGHINVLAKLSLEDLNVKNNKFTGWIPSKLKSIDNLETGGNSWSSGPAPPGMEKESSAGSSNGRDDSGINGFAIGAMVIAVLLAALILLSVLRRNHSSPVSSHYYTDESGRRNSSAVNMKSLEHSPSMGCKTPPAVPRKSMSDNEFENKLNHSRRSTDPISLMNHSSSDLQAATGNFSSNRQLGQGTTGCVFRAKYADGRVLAVKKFDPLSFSGSSDFMDTVNGIAKLRHTNISELVGYCSEPGHYMLVYDYHMNGSLYDFLHLSDDYSRPLTWDTRVRIAACTAHALEYLHEVCSPPVLHKNIKSSNVLLDADLNPHLSDCGLSFFYEDASENLGPGYSAPECSRPSAYVMKSDVYSFGVIMLELLTGRKPYDSSKPRTEQCLVKYVAPQLHDSDALGSLADPALRGLYPPKALSRFADCIALCVQADPEFRPSMSEVVQSLLRCVQRTISNRGMAGYLSNSQRSDISDW

SEQ ID NO: 410 - protein, 161 aa, Oryza sativa
MIHFVLLISRQGKVRLTKWYNPYPQKERSKVIKEVSTLVLTRGPKMCNFVDWHGYRVVYKRYASLYFCMCIDAADNELETLQIIHHFVEILDRYFGNVCELDLIFNFHKAYFILDEVLIAGELQESNKKAVLRLITTQDNLVEAAKEEASSLRNIIAQATK

SEQ ID NO: 411 - protein, 333 aa, Oryza sativa
MMRGLGPAAAAALGGRSAARWCTYRRVTVAVCLGNLVAVLLVVRSLYSAPGYFASAPRRVAVKYSEEQIRLVEESIRIRRAAVSVELVEAVKKLEKVFAREEKRRKELPLELKQKVSYEILERMRDLGENSNTTEQREALESWRLEKLKDIRSASAQNLSMSDLSNEESRMLKRALELNWRMLMDDIGLWIPVSVWHTEHDDKPENEPEEEEIIAGPPLPPECNAQVHTDYGGAAVRWGLTHHKESAADCCQACLDQAKRARPGALKCNIWVYCPSEYGCYSPDKYEHKHQECWLKQADHPKLNFKDRYSESYRDAHPSAPVVVPWMSGVITV

SEQ ID NO: 412 - protein, 232 aa, Oryza sativa
MAPGLQRFTDIAGDGGPRLDAASGEELLRMDRAASVALGRRAPEPPGTLFVTTRRVIWLSETEKGQGYAVDFLAITLHAVSRDLEAYPSPCIYTQIDAEDGSDEEAGGSDFEANGDLQLAKVSEMRIILSDPGQLDALFDVFCHCAELNPDPNAVRNEENGWSGGENMAEGGWIHGDEDMIDGNDLEAHMFFTNLIGQNGLHDLGRSVRELQIDDQRFEDAEEEDEIQENGH

SEQ ID NO: 413 - protein, 330 aa, Oryza sativa
MARGVARAASFGGRAATARWCSYRRITVAVCLGNLVAALLVLRSLTSLAPTPPKREEVVEYTEEQIRKAEESIRIRREAEPVELVEAVKNLRKIFRREEKRRKELPLELKQKVSYEIVQLLLDLGDNSSFAQQREAVESWRFEKLKDIKSASIQNSTKLDLSNEEARTLKRALQFNWHVLLEDIGLWIPSEVSHTEHDDKPENEPEEEEIIAGPPLPSQCNAELHTDYDGAAVRWGLTHPKESAADCCQACLDQAKNARPGELRCNIWVYCPSEFGCFSPDKYEHKHQECWLKQADHPKLNFKDKYSESYRDSHPTAPVVVPWMSGVISA

SEQ ID NO: 414 - protein, 781 aa, Oryza sativa
MVMLFPSPATAALLVLVVLLLQLQLWSAEAQVAVGSGPPAGCPDRCGNVSVPFPFGIRTGCSLEGFGLTCNTTSNPPRLMIGNSTLQVVSISLANSTLRAVDIAGAVNITYDVVSGTTGNGTWGGVAATSTNPYVVSGELNQLLVTACNIQVTLVGSGGNVITGCSSFCSINDKYTGGVFRSPGNKCAGISCCQTPISIGRPSYSVKVTIMDNEYRGEVPEAIRIAELGWFDGLAANLLKKPAANDTSLRTPVPVVLEWAVASTGLDVTLDAGLNNQAANNWSCPTPGEARRSACISNNSYCHNVTDNYRSGYVCRCDDGYDGNPYVAGGCQDINECERPKEHGCFGECTNTPGAFLCRCPHGARGNYSIPNGCTKSNLGLTIGVGIGSGAGLFILALGAVFLTRKIKQRRARTLRQKFFKQNRGHLLQQLVSQKADIAERMIIPLAELEKATNNFDNSRELGGGGHGTVYKGILSDLHVVAIKKSNVTVQREIDEFINEVAILSQINHRNVVKLFGCCLETEVPLLVYEFISNGTLYHHLHVEGPTSLPWEDRLRIATETARSLAYLHSAVSFPIIHRDIKSHNILLDGSLTTKVSDFGASRCIPAEQNGVTTAIQGTLGYLDPMYYYTGRLTEKSDIYSFGVVLMELLTRKKPHSYRSAEDESLVAHFTTLHAHGNLGDIFDAQVMEEGKKEVNEVAVLAVACVKLKAEERPTMRQVEMTLESIRSSSLQQEVLHSVSTKKSKELHVSWSHAISEGTSLDSTRQYSLEEENLLSSRYPR

SEQ ID NO: 415 - protein, 477 aa, Oryza sativa
MKKTVVLYPGLAVGHFNPMMVLADVFLDHGYAVAVALINPSVKDDDAAFTAAVARAVSSKSSATVSFHMLPRIPDPPSLAFDDDKFFTNYFDLVRRYDEHLHDFLCSVQGLHAVVVDASCGFAIQAVRKLGVPAYELYPCDAGALAVNIQIPSLLAGFKKLGGGEEGSAPLELLGVPPMSASHVTDLFGRSLSELISKDPEATTVAAGARVMAEFDGILINTFVSLEERALRALADPRCCPDGVVLPPVYAVGPLVDKAAAGAGDETSRRHESLVWLDGQPDRSIVFLCFGSIGGNHAEQQLREIAAGLDKSGHRFLWVVRRAPSTEHLDALLPEGFLARTSGRGLVVNTWVPQPSVLRHRATAAFVTHCGWNSVLEGITAGVPMLCWPMYAEQRINKVLMVDDMGVGVEMEGWLEGWVTAEEVEAKVRLVVESEHGRKLRERVEAHRDGAAMAWKDGGSSRVAFARLMTELDNAQR

SEQ ID NO: 416 - protein, 957 aa, Sorghum bicolor
MEEEVTGSGGGIGRKMAAGEVELKEKSGTAWSHSYLNQKPWHPLSYPNQRRKWIAEQVHANRARRQEEVQREFAQEQEFFRQTALFSKKDKEKMEVMKAVSFMYVRPPGYNAESAKAAEIEDEKKRSDPSDMAQGTASATTSSIPDKGPEKTQSGTDKKNRPKDVFGRPLATEQEFEVLKNAPRLDTGAPARIKPFGVEVRNVRCLRCGNYGHQSGDRECPLKDVIMPNEESRLKRDDPLTTIMAQTDSSEPLKWELKQKPGMSPPRGGFDPDDPNQQIVAEDIFDEYGGFLNCDIPALISSFSASKSKKRSKKKSKHKQAKSAVHEDSGRHESSYHLSSDSENEKRNKASRSKRKKTNCSDSSYSDSEIDARKGKSKSKHRHKKKYQLESSSDSEFEVREDTRRHLKREHVKEKRDVSPLSFSKDQGDTESKRHSRRSREKRRYSYSSSSSERGRHSLRHKEKQYYSDSSSDLSHRHSRRSREKRHDRESNSPDAIRRSRRSVEKQRHSDTSPRHTNRHSKRLSGKQDYTECSHYETSRHSRRSREKQHYPDSTTTPKSPKPEGNARGEESSSGSGSGRPAAERERPTQHPQAKMLSSSTSTLRLHQPTRPHRHHPPAPAAGGATHLASPRRWRGHAPGASSPPALRARAQRIRALDAAQPFDFESRAAGLLEERQRLKIAIVGFGNFGQFLARTFARQGHTLLAHSRTDHSALASTLGASFFTDPHDLCECHPDVVLLATSILSAEAVLRSLPVHRLRRNTLFVDVLSVKEFPRNLLLSSLPPDFDVICTHPMFGPESARDGWDGLPFVFDKVRVGDCPARRARAEAFLNIFEREGCRMVEMSCAEHDAHAAETQFLTHTVGRMLAMLELRSTPINTKGYETLLRLVDNTCSDSFDLYNGLFMYNKNSTELLNRVEWAMDSVKKKLFDGLHDVLRKQLFEGSPHAPNVSSSNVRK

SEQ ID NO: 417 - protein, 377 aa, Hordeum vulgare
MAKEGAGGGPDWNGLLKWSLAHGADGTNPPRALSEEDRKWFMEAMQANTIDVVGRMKEIAQVMKTPDDVLQSHGVTPGNIEDMLDELQEHVESIDNANDLHSIGGLDPLLGYLKNSHAGIRAKAAEVVSTVVQNNPKSQQLVMESNGLEPLLTNFRSDPSTTARTKALGAISSLIRNNQPGLAAFRLGNGHAALKDALGSDDARLQRKALHLTQYLLNNKADRSVAEEIGLPNQLIHLASSEDSGVREAALGGLLELARDKAPVARNALPDQDKLKDVLRSRIEGISTMDADDLQAAREERQLVDSLWKECYGEPSSLREKGLVVLPGEDEPQQPPPDVAGKMFEPPLRAWAAPRPSSAEDSDSASGKKDPPLLLGP

SEQ ID NO: 418 - protein, 472 aa, Oryza sativa
MTTKTFVMYPSLGVGHLNPMVELAKHLRRRGLGVVVAVIDPPNNDAVSADAMARLAAANPSITFRLLPAPDSPDVGAHPIKRSHDTLKLANPVLREFLRSLPAVDALLLDMFCVDALDVAAELAIPAYFFFPSQASALAVFLHLPYYYPNLPTFMEMGKAALLRFPGMPPIRTVDMPAMLRDKDSEATKVRLYQFKRMTEAKGVLVNSFDWLQPKALKALAAGVCVPDKPTPRVYCIGPLVDAGRKSRIGGERHACLAWLDAQPRRSVVFLCFGSQGAFPEAQLLEIARGLESSGHRFLWTVRSPPEEQSTSPEPDLERLLPAGFLERTKDRGMVVKNWVPQAEVVQHEAVGAFVTHCGWNSTLEAIMSALPMICWPLYAEQAMNKVIMVEEMKIAVSLDGYEEGGLVKAEEVEAKVRLVMETEEGRKLREKLVETRDMALDAITEGGSSEMAFDKFMRDLEESSLENGVRS

SEQ ID NO: 419 - protein, 506 aa, Zea mays
MVSGQKGTGFSVPVAVVTPLSAPAEERCARRETREGEGRRRGGVVVKSMPPPSPLLRSSAFVVLLLLVCRPLLVANGRATPPSPGWPPAAQPALQPAPTASGGVASVLPSAVAPPPLGVVVAERHHHLSRELVAAIILSSVASVVIPIAALYAFLLWRRSRRALVDSKDTQSIDTARIAFAPMLNSFGSYKTTKKSAAAMMDYTSLEAATENFSESNVLGFGGFGSVYKANFDGRFAAAVKRLDGGAHDCKKEFENELDLLGKIRHPNIVSLVGFCIHEENRFVVYELMESGSLDSQLHGPSHGSALSWHIRMKIALDTARGLEYLHEHCNPPVIHRDLKSSNILLDSDFSAKISDFGLAVTSGNHSKGNLKLSGTMGYVAPEYLLDGKLTEKSDVYAFGVVLLELLLGRKPVEKMAQSQCRSIVTWAMPQLTDRSKLPNIIDPMIKNTMDLKHLYQVAAVAVLCVQPEPSYRPLITDVLHSLVPLVPTELGGTLRIGPESPYLRY

SEQ ID NO: 420 - protein, 512 aa, Zea mays
MADSAPSIPGVIASLQAYSTALSAFTAAWRAVETHASTLDSALAARLAGFSELELICSAMDGAGLRAYLTEHRDELKDPTRALDAALQVAPDPGLLVLSAAASFCRTLPEVAKSDGSVKASCRLLIALLDRLRAIGVKPSPEAREEARAVATDWKRGKRIGTETMFKQETFAFLHLVGVFGLVEDVGGTSEVLDLVVSISGRERAVDAFVVLGLDLDQHMPILIQKMVNKNKQLEAVKFIQALNIAHKYALLPIMRSYIDHAAVAGKMIRIRGDDLATQNAADAKERTLIGTLQKFIKEQKLEELPIFEEANKRMAHLDQQSAERKRTAAAAAAAARKVSKNIEEQQKRIQELMQPAKRPRSENVVKGSSGQNVNFAGTSTQQFKPQQSIHKAGVSNQYQAALTQNVLPAIAQISQLVAGSHRPVGIPNQALAVPPQYGSGSANYYGVTSTRPYRPITLPPGPGALNGPSAQASSRSRLYSGDPLAAVSRSSDKKGSSYKYSLSSMSTYDRK

SEQ ID NO: 421 - protein, 308 aa, Oryza sativa
MAIISDFQEEEAPPRQQQQPASVAAAAGSGDEVLAAELERRGGAIPFLQAAIDVARRRSDLFRDPSAVSRVTSMASAARAVVEAEERKAREAKRKAEEAERKAAEAERKAKAPAEPKPESSAGKDSMEVDKKEEGNVRKPNAGNGLDLEKYSWIQQLPEVTITVPVPQGTKSRFVVCDIKKNHLKVGLKGQPPIIDGELFKPVKVDDCFWSIEDGKSLSILLTKQNQMEWWKSVVKGDPEVDTQKVEPENSKLADLDPETRQTVEKMMFDQRQKQMGLPTSDEMQKQDMLKKFMAQHPEMDFSNAKIA

SEQ ID NO: 422 - protein, 244 aa, Zea mays
MQAPREGYGLATMDFEYVPASPGSSRWAGESAARRRQRRLSSPSLRTYLTPAFDAVAGGEGGVSGYSSSSSSGGLELGFDASLLRYRRSCLAASADLDSRVLLYSPQSLPPPPPQMRAAYMPADDEVWAPGVSHYGSKHEAGRLTGAPGFQDSENRIAFVSPSRTSSNLHTTVLGASTPVKLPAELQLPEGSAELPTPKPEATPSALKLSADPEPDVDADEITEALYGGSGHRRLPIFREICPE

SEQ ID NO: 423 - protein, 258 aa, Zea mays
MVPWEGYVSDETMGTFSPIVLYWLYAGGYQLILHRRPLERYRLHTRDEEEEKNLVSLSTVVRGVLLQQLVQAIVAMILFMVTSDSSITVVQPPIVVQIFQFLVAMLVMDSWQYFVHRYMHQNKFLYRHIHSQHHRLIVPYAIGALYNHPLEGLLLDTLGGAISFLVSGMTPRTAMFFFCFAVLKTVDDHCGLWLPYNIFQHLFQNNTAYHDIHHQLQGTKYNYSQPFFSIWDRMLGTHMPYDLVSRKEGGFEARPSRD

SEQ ID NO: 424 - protein, 1625 aa, Oryza sativa
MENDHGDLDDVGSGWLEVKKKHRSSSKFTLQRSSGGSNDNKISNSSSQSQTNFGSDSAKWCDRLQCSPQITKVNVCVNEPGSVVTMVVHGEECAHADASNLKSELSVSASDHAIEKPKKLLVTEEISEPPNVGKIDCADSPTPHQSSNCSSGLAKSSGFYDHVKGPPMTDSIGVLSNTSVRFGDFDEVPGLALPADACRNNSSSQKHIHIGDATEFINECKDESELKTEPNSCKTIVETSPVIIQGAETPTEDESKVLDICEITDNRLDVSGSPSLDDTVSLSCANNDLEVPVKSSSVASTESQTVLHAPTSADFGGETAGSKERFRQRLWCFLFENLNRAVDELYLLCELECDMEQINESILVLEEAISDFQELKSRAEHFDNTKKSTALPKEGMPMAVKADHRRPHALSWEVRRMTSSPHRQEILSSSLEAFQRIQLELARKQAGITTESFASSSSGEVSGSSSKLTTASATVGSISLKVESQVKLSDTEKKIAGERQSKDTIKSGRSPPQNMPSSSAKSRKGSLEPISEVEKHNFRKDKELPENKFDKLRSTDTAKRTTVHTEKEKQNAAPRKSLDAWKEKRNWEDILKSPVRSSRVSHSPGVGRKVPERARVLHDKLMSPEKKKRSALDMKKEAEEKHARALRIRSQLESERVQRLQRTSEKLNRVNEWQAVRSSKLREVMNARHQRSESRHEAYLAQVAKRAGDESTKVNEVRFITSLNEENKKFLLRQKLHGSEMRRAEKLLVIKTKQKEDIAREEAVLERRKILEAEKMQRLAEIQRKKEEAIIRREEERKASSAAREARAAEQQRRKEIRAKAQQEEAELLAQKLAEKLRESEQRRKYYLEQIRERASMDFRDQPSPFQRRFPSKDNQNRSSSANSGEDSQIISSANAAESGVKSFNSTQMKRRIKKIRQRLMALKHDFVEPLIGENTGIVHRSALGTAKAKLSRWLQDLQRLRQARKEGAASIGLIVSDMTKYLEGKDLELHASRQVGLLDFIASALPASHTSRPGACQVTVYLLRLLRVLLSLPANRTYFLVQNLLPPIIPMLSVSLENYIKVAASNSGSSNIQSSKTSTEYMESVGEVLDGFFWTVTVIVGHVYLNDQQLQMQGGLIELIVAYQIIHRLRDLFALYDRPQVEGSPLPSSILFGLNLLAVLTSKPGNFSTIDWESCKCRTLAGNLVQEYEYLCSQDIGMGNQLMISDQSGDVKLSSTKSDLLKCDECDPSELIKENKSLDHHKFNIPGDNMSVYEASKDSGSMPEMQSSDTLEVHSVIPCQGDAADGTLERKKGSTTCLHDSPGKDNEINLNQPVVLVLSAMAETGLVSLPSLLTAVLLQANNRSSSEQASAILPSNFEEVATGVLKVLNNMACLDITLLQCMLARSDLKMEFFHLISFLLSHCMNKWRVPNDQVGLLLLESLLLLGYFSLFHAGNQAVLRWGKSPTILHKVCDLPFVFFSDPELMPILATALIAVCYGCDQNRSVVQQEISTEMLRSLIKSCKTPGLAASDSILLDGWGTNSSSDNTQILLDTRNPQGDISIRSNRKSARPVLGKGVSGVIRLSRNKGQRDGRGARIGDDGPLKQRAGETSSNFMLHRKIPASFLDKAEEFFCSENDTAANITN

SEQ ID NO: 425 - protein, 291 aa, Oryza sativa
MAGSGGGDRGSPEAELRRGFKTLAVTRPDPSAAVYEVRLNRPTRLNALSPDAFAEIPRAMALLDRAPAARAVVLSAAGPHFCAGIELGSPGSPATAPSGDPAPAAAEGLRRAILEMQAALTAIERCRKPVVAAVHGACVGGGVEVVAACDIRCCSKDATFVLREVDMAIVADLGALQRLPRIVGYGNAADLALTGRKITAMEAKEMGLVTRVFNSKQELDAGVAKIAKEISEKSAWAVMGTKAVLLRSRDITVEQGLEHVATWNAAMLRSNDLEEAIQAFLEKRKPVFSKL

SEQ ID NO: 426 - protein, 141 aa, Oryza sativa
MENGGEEDDRASRCKRITRESDATKNGAATKLQALRLVEDLSLPSVQVVVMSANMGCSHCRQRVTKVVSKMNGLLDYMVDFGKKEVTVRGTMVHTKKKRKQHKKKHEENKKGIAANWEKKSSSQSNDSARTLAWFLRCYSS

SEQ ID NO: 427 - protein, 490 aa, Oryza sativa
MNAGFSPQILAQKLLKLNNSRQSIETLSHWCVFHYRHCRQVVETWESDFHSAPRERRVSLLYLANDIVQNSKKDSGRYVNEFWRVIPAALNDVFVNGDDFGRNVVQRLVDIWEERNIFGSHGQSLKEDYSRRFKEFKSKSRNSSGELLEKVISCYKHMLNAHVDDDTLMRKCQNALSFVDNLSNEYENNSILDCSNGSGFVEELQEQHNILRDSIEQFKTSELLRGNLISCLKEALHEQEFKMERARSQIKEVQSRYKKADDLCQKLGIHVERQEQPNHGPKNSGSEMHGSFGPDSANASSFEKGQSSAVMYSQENGGEHEIPNGVFSSRATKDNIEQKLEEHSTNKRQKLQNDVYVSRPQSPPPPLPSDAFEQPPPPPEHPPPPESTSPPPPPTSDPPPVPPPPPTTGSFMPIPSAPFAGLPVPAGPMTAVPYNSYPVFPPMNYPMVNIPPPFPSAPNTPPGFQGLAGPFYGPPYPAPPPPPPPPMNRK

SEQ ID NO: 428 - protein, 84 aa, Hordeum vulgare
MAKCLAAALLLLVVLAYCDGRELNQKDQALATARGAGAGAGGGVGEEKILGLPELPLVGTVTGTSTVTGPVVVLPALPGIPAHP

SEQ ID NO: 429 - protein, 664 aa, Oryza sativa
MDIDDDARHRRVIMSRDCRSRTPSSRTQDKNRSLLLDKVRASHAEALERLRPAADLDAGLCFGLLDPVSNAIVNAAVFAEAEDGNDRTGRSLDGAVTFLTTFFPHLPDWEAVRYLLDADADVLVAARLVVRDRGLRRFGFASDTAGAAVRLALRCAALAVKHPHPDRLVHAWLSLSRRLDEAVSALANHDVRGLVALVVDEAEAPAAANMERAWELAASRFLGRDNGIAAPPYRHAMPLQRTLLYAIQGFYLRALARLPSGELRSHYHRSLVKAGHCYGPMDPVSNIILNVVWYDAAHPPVEELELAMIPPKSMSSIATRSFLGLVSFLCTRYPNLGLHDAIRCLLDFDGDLNAAAREADRRQHRPSCTIQESYAAAAAAARHPKPDEQVEFLSSSRAMTTPLLLQNGGQLSSEDVRRLAAALLPPTPSAAVSPMQRKPTKPRRRRQLKLKAQIIRDQNKICRKVKAALDRYALQNNEPGGYELHVICGMNNCVSGPVYCTDDDIVSYTPLIYFRCHVNFLARRRDSDPSAIAGEGALQLFFAECGNYRLNHDGICCPVTISPPCSEQVRCLYCEHEGVGIMHPSIENFHGREVDFEKMVCGEDTCGDEFDPEIDEEPFYTNDGIVNSLKVNILSGLEEEFIYRNSDEGTDEEEGDSDDDIDFV

SEQ ID NO: 430 - protein, 608 aa, Oryza sativa
MKYVLVTGGVVSGLGKGVTASSIGVVLKDCGLRVTSIKIDPYLNTDAGTMSPFEHGEVFVLDDGGEVDLDLGNYERFLDIKLTRDNNITTGKIYQAVIDKERRGDYLGKTVQVVPHITDEIQEWIERVAMNPVDGTDEPADVCVIELGGTIGDIESMPFIEALGQFSYRVGAGNFCLVHVSLVPVLNVVGEQKTKPTQHSVRGLRGLGLIPDILACRSTQPLEENVKVKLAQFCHVPISNIVNLHDVTNIWHIPLLLRDQKAHESILKVLDLQCVGKVPRAPKLTEWTERASKFDKLKTPVRIAMVGKYTGLSDSYLSVLKALLHASVALDRKLVVDWVPSCDLEDSAATETPDAYEKAWDLLKGAHGVLVPGGFGDRGVQGKILAAKYARENNVPYLGICLGMQIAVIEFARSVMKLRGANSTEFDPATTTPCVIFMPEGSKTHMGATMRLGSRRTFFQANTCKSAKLYGNASYVDERHRHRYEVNPEMVPEFEKAGLSFVGRDESGTRMEIIELPTHRFFVGAQFHPEFKSRPGKPSPLFMGLIAASSGQLDHLLQQSCGVVSSPVRRGNYCNGATKQQKLYQNGHVKNGLVNGCYYANGNSILHT

SEQ ID NO: 431 - protein, 552 aa, Oryza sativa
MDGGVGGAHSSRRSVSSSTGSRRRAGPTENGHHDAAAAAAGRRSSASISRASQQSMTGERTVKRLRLSKALTIPDHTTVYEACRRMAARRVDAVLLTDSNALLCGILTDKDITTRVIARELKLEETPVSKVMTRNPLFVLSDTLAVEALQKMVQGKFRHLPVVENGEVIALLDIAKCLYDAIARMERAAEKGKAIAAAVEGVEKHWGASVSGPNTFIETLRERMFRPSLSTIISENSKVVTVAPTDTVLTASKKMLEVKVSSAVVAIENKPGGILTSRDILMRVIAQNLPPESTTVEKVMTQTPECATVDTPILDALHTMHDGKFLHLPVLDKDGNVVTVVDVLHITHAAIATVGNSAGSGSEATSAMMQRFWDSAMSIGPLDDDDDSRSEGSTKVASEATDVGRSAFYPASGLSNTFGFKIQDKQGRMHRFNCETSSLTELITSILQRLGDDIDRKNLPQILYEDEDHDKVILSSDSDLVAAVDHARQIGWKSLKLHLDYAGVGRRKRGGGGTSDFEYAGKDAWASAYSAVAAGAALVAGLGVMAYLKRAG

SEQ ID NO: 432 - protein, 517 aa, Oryza sativa
MGIFKLNLLLKLQRQRQRRRRQIQARNGSVLIHPRDKINAPACQNNTHSWSGQAKCSDPTLPEDISCHIHSLMSMRDAARVACVSRAFARSWRCLPNLDFSEESLGINRSTCKKDEKLGDLTSKIDWILKNHSGIGIKKLIIQVGSVYSRDSSHLAHLDSWLQCAVKPGIEELIVNLSSMNAKYNFPCELLSSGTGDSLRYIYLASCNFHPTVRIGCLKSLTRLQLCMVNITENELRCLLSISLGLERLELRHCSTLKCLKVPCLQRLSYLDVMTCTGLQVIESKAPNLSSIRFEGDLYVQLSLGEPLQIKQLYRLCNDAAFYARTELPSSMPNLERLIIHSDTEMVNTPMVPSKFYHLKYLSIALGGQTYDYLSLVSFFDASPFLETFILNALRERTERATIFGDPSGLRMMPEHRHDKLKCVKIINFSSVKTLVELTCHIVESATALECLTLDTTSGSPRCSVNRLGKCFLMRRETLMEAHRALKAVQTYIELKVPSKVELNVLEPCSRCHALDL

SEQ ID NO: 433 - protein, 366 aa, Oryza sativa
MEDNLPVNVREYQELAKKALPKMAYDYINGGAEDEHTLRENIAAYTRIILRPRVLVDVSKIDMSTTLLGYTMRSPIIVAPTGGHKLAHPEGEKATARAAASCNAIMVLSFSSSCKIEDVASSCNAIRFYQLYVYKNRNVSATLVRRAESCGFKALLLTVDTPMLGRREADIRNKMVFPRSGNLEGLMTTDDHDTTNGSQLERFARATLDPSLSWKDIEWLKSITSMPIFLKGIVTAEDARRAVEAGVAGVIVSNHGARQLDYAPATIAALEEVVRAVAGAVPVLVDGGIRRGTDVFKALALGARAVMVGRPVFFGLAARGEAGARHVIEMLNGELEVAMALCGCRSVGEITRSHVMTEGDRIRSLL

SEQ ID NO: 434 - protein, 55 aa, Hordeum vulgare
MYNAPSGQEMSYTDHVQKRHEEKGCIYACVFTALCCFCCYETCECCLDCICCCCN

SEQ ID NO: 435 - protein, 210 aa, Zea mays
MGAECRYEVAQAAYIKLALHALKHPATAVNGLLVGRLVEPSSSPAVVSVIDAVPLSHHPHHLPLLPTLELALTLVEDHFATQGEGLAVVGYYHANPRCDDTELPPVAKRVGDHIFRYFPRSAVLLVDNKKLEEAVKGKFSDAVIQLHTRDSSKSWRQAGSDGSSQLVLKEPSTNVVLADHVTTKKWEKIVDFDDHLDDISKDWSNPGLLD

SEQ ID NO: 436 - protein, 833 aa, Oryza sativa
MKSNAVTSKGKAVFELKHRLVQAINKIADRDTYQIGLDELEKAADTLPPDMVGPFLSCVVDTDAEQKSAVRKECIKVIGTLARSHGSLVAPHMTKMVTSIVKRLKDADSVVRDACVDTCGTLALCARGYGDGGAALVALVRPLFESLGEQNRYVQAGAASCLAKVIDESNYFPGPVLPQMLVRVVKLLKNPHFMAKPAVIELIRSIIQAEGASTEQSLTSALTSIMDALKSSDWTTRKAASIALSSIALSSGYLVASFRTSCLRSLERSKFDKVKPVRDAITQAIQLWKVIPGSDTPEPSEAGSSTKENFFGDHHDGRSINDGGSRDTSFRRVDPASSVSAISGNSITSSKKRSPLSINKIALNNAANQQRSKLSDWHVEISVPKQNMIPLVDFEEKVSGNGSMLKGSNRSPYEIVDNDSKYEYDPMDDKQDCSSMSEVASRSCETKHVTSAQECVEDCDSARDIEQFPRAQKSKSIDSTVTDITSHGTHTCCLGAMKELSHIRKQLQEMERKQANIFDMLQEFMSNSVENMSVLSMKVHNLENAVDKTVYTITQSESRYHLPGSKFIKNQSATSSPRVSTSTPRSSVDANYKPPPIPHLKQEKKWMQDQPSKGLNMGVKEGEFLKSHTHDKTRKPGVVRSESALGRYVPSSARTRASGVKGNFPVSLTNSCEQPELQNALRASKEFDGNDDMASAYVEALNSGDCDYLIDVMDRTGPVLEKLSRETTSELLRVIAGQFLNKKMFDLALPWLQQVADLSMIYKPSQLFVSVRAQKEFLALLEEAATSGSTEPAIRIAIAQLAFKLTKVCEVAPCRKVLSRVCRGNETIMATAM

SEQ ID NO: 437 - protein, 388 aa, Oryza sativa
MERNQHRDGDGDGEGRHHHVVQVPASAVEVAAMEETSSEAADRSLRQKAAAMVASSMETYRSKPMSFWLLLVLSAGAMLTAFPASSLLSRLYYNNGGQSKWILSWSAVAGWPLPALLLLPCYLAGKAAPTPLSPKLCAWYALLGLLSAADNLMYAWAYAYLPASTASLVAASSLAFSALFGCAIAKNRLRLSSLNAVVVITAGVVIIALDSGSDRYPGITGRQYALGLVWDVLGSALHGLIFALSELVFVRVLGRRSFHVVLEQQAMVSLCAFAFTTVGLAVSGGGFPAMRREAAAFRHGEASYAMVMVWSAVTFQLGVLGGTGVLFLASTVLAGVLNAVRVPVTSIAAVIWFHDPMSGFKILSLLITVWGFGSYMVGHSSTKKASTN

SEQ ID NO: 438 - protein, 455 aa, Hordeum vulgare
MKSLMTSMTPNRRRQRGTKMKRLMTNRRQQTMWGENEESDDEHGHDDNDVPSGSSEEGEPKFIEDKYRYSTVDEVITVLREAGLGSSNLIFGIDFTKSNDWSGKHSFGGESLHAISRTPNPYEQAISIIGRTLSHFDDDNLIPCFGFGDVSTCDHSVFNFYEEDRPCRGFEEVLDRYKQMIPYLDFSGPTSFAPLIYAAISVVERSNFQYHVLVIIADGQAATSKSYSILSPQEEETIQALVDASFYPLSIVMVGVGDGPWDEMKHVDDCIPDRAFHNFQFVNFTDIMSTSKDMEKKEAALAFAALMEIPAQYKATQCLQPPEWHEEMADPWMILPPPIEVLERDYAVAVSHFPAAPALSTGIGKDSSDEQVCPICLMNPKDMAFQCGHLLSLPSAALTGVGKGTSDEQLCPICLTNPKDMAFQCGHLTCKECGPTLSTCHLCRAPITVRLRLFS

SEQ ID NO: 439 - protein, 577 aa, Oryza sativa
MTTTTTTTNHSAKSILLLALLLVPHLAAASSGDALISQRRRLLDYHGGGGGHGGGDVYVDPSYTFPNARLRDAYVAMQAWKRAVLSDPHNVTGTWIGPDVCAYEGVFCAAARDDPHLVVVASVDLNHADMAGHLPDELGLLADLAVLHANSNRFCGAVPSTLERLHLLHELDLSNNRLVGAFPDVVLRLPSLRYLDLRFNDFEGPVPAELFDRPLDAIFLNSNRLRFRIPDNVGNSPASVLVLANNDFGGCLPASVANMSGTLDEIILMNTGLKSCIPPELGMLTGLAVLDVSHNSLMGAIPGELARLENIEQLDLGHNRLTGDVPEGICHLPHLQNFTYSYNFITGEPPVCMHVKAFDDRRNCIPGRPDQRPAEQCQFQNTHHVNCDAFRCKKFVLPLSSTTFTSSSISTTTISIASSTFSPAAVSSTTIAIAASTISTASISSSAIASVLQLAAAAVLRGFTGGQVPLAAATSGVPRGAATAVLRGVAGGQVPVAAATSSLPRNAAAAAAVRGVTGGQVPVAATSITGEVEAAGVRVLIAAAAGSNMEAIKLKSILSGFFFSHTMIIHIVKFVVC

SEQ ID NO: 440 - protein, 329 aa, Hordeum vulgare
  misc_feature (313)..(313): Xaa can be any naturally occurring amino acid
MVWTTVQELAAAVEEPPRQYLVHEQDQGLLAADQMPEPIPLIDLSRLTADDEADKLRAALQTWGLFLLTNHGIEESLMDAMMGASRDFFRQPSEEKQKCSNLVDHGKKSELEGYGNDKVVNQDEGLSWNDRLHLRLEPEDERNFTKWPTHPASFRDVLLEYASRTKRIRDLVFRSIAKILDLDEDYFLNQISNKDPGFARFNYYPPCPRPDLVLGMRPHSDGGLLTIVFVDHDVGGLQVERDGKWYNVPAKPYSLVINLADCMEIMCNGIFRSPVHRVVTNAEKERLSLAVFYAVDGETMLEPAPGLLDDRRXPRYGKFKAKDFGLSLD

SEQ ID NO: 441 - protein, 191 aa, Zea mays
SFKTSIGIFGILILLILLGRVAFVFPISILSNIMSGSSERTPITFKHQVVIWWAGLMRGAVSIALAYNQFTFSGVTSDPVHATIITSTIIVVFFTTLVFGFLTRPLISGMLPHQSRALSRGHSTGSNSPKDDFTLPFLSGDEGASGSGIVLEQAKRSLSMMLERPVHTVHIYWRKFDDRFMRPIFGGPRSH

SEQ ID NO: 442 - protein, 244 aa, Hordeum vulgare
  misc_feature (192)..(193): Xaa can be any naturally occurring amino acid
MCTLEQRGRVFVLTLTGDGEHRLGHPLIASIRSALASVLAAAQAQPQGPGAALVTVAEGRFFSNGLDIGWAGASRARLGELVDALRPVAADLLALPMPTVAAVTGHASAGGFLLALCHDYRLMRADRGVLYMSEVDIGLPLPPYFVHVLRAKISQAHALRDVVLRGKKLRAPEAKEMGVVDVVCPGAPETAXXALKLAEQLAARKWDGAVYASIRMSMFPDACRAVGIAVESDEEKSKHFASRL

SEQ ID NO: 443 - protein, 339 aa, Hordeum vulgare
  misc_feature (182)..(182): Xaa can be any naturally occurring amino acid
MGGGIFPLLEPWFVSLAVLGAVYSTAVVLRLLSHLTLLLRRPRNPRRRYGAWAVVTGPTSGIGQSMALELARLGLNLVLVGRDPAKLQDISETISKTHAVQTKTVLFDLALIATPQGDEAVRRLREAVEGLDVGVLVNNAGVAKPCALYLHEVDVEAWVKMMRVNLWALTEVTAAVLPGMVXRGKGAVVNIGSGSSEAIPSFPLYSVYAASKRYVAQFSRSLYVEYRSKGIDVQCQAPLFVQTKMTSIVAGSGKRRRGVLPRLMVPTSDEYARAAARWIGHGPICMPNLGHRLQWCLCRVVPDRLLDALRLRENLRQRAVFQRLRSPRSPSHANGGKQS

SEQ ID NO: 444 - protein, 597 aa, Hordeum vulgare
  misc_feature (408)..(408): Xaa can be any naturally occurring amino acid
RHEASGPYTEFSGIIQPQQNFMELHGHPSEHSSSREPNMVTSLAEQSSFAPVKDMRNEMLMHFMDGAHSGGGDLIHNDAHSSAQLEFGLLNNPSSAIVPSAPGQGLSLSLNTHILAPSYPYWSPKPDLLTTQSYQGDENGMKNMQSEASRAIRNSKYLKAAQELLDEIVSVWKSIKQNAQKDKVEAGKMDGKDADEVLKSEGVSSNPQESAANAEAEISAAEKQELQNKMAKLLAMLDEVDRKYKHYFHQMQIVVSSFDMIAGSGAAKPYTAVALQTISRHFRCLKDAINDQVNVIRKKLGEEDNSSGREGKLTRLRFIDQQLRQQRAFQQYGMLQQNAWRPQRGLPENSVSILRAWLFEHFLHPYPKDSEKLMLARQTGLTRSQISNWFINARVRLWKPMIEDMYKXETGEAELDSNSSSDNVPRSKDKMASCEDREDQKCSMSQGQAYQTSEFKANVGMVGLTGGPASFHNEASSDDGFMNLLLKDQRPGEADGGLLHGDESARFMAYHLAELGGYQNSNVSLTLGLQHTENNLSAPNNTHRPGFTVGGEGDIYNTTAAHPGGGAAAASPDYESTNQLDQRQQFEPSPLLHDFVA

SEQ ID NO: 445 - protein, 320 aa, Triticum aestivum
TDAVLRSGCVWLMGVPAGFKLNTELAELLGMISLNAIQIYSTLWFMVGGFLRHIIQGLAFSGILLGFTVPVSIFIDIIQLATLHVTMLQWLISLIYSRQIQTVTSLWRLFRGRKWNPLRQRLDSYDYTVEQHVVGSLLFTPVLLLLPTASIFYIFFSILSSTIICLCIVLETAICIIHSTPYAAVILWVTRRQRFPAGLMFLPMSSSSVSTDDDAPSVEYRSTSLSGERKTDEPIHVHSVPLVSELNCNYNTLGQVIGPHYQKVFNGIALPFCKQLAHGILRGTRIPTTLHLPSSPLPWMHIGIREYWMLCRRATKWGRN

SEQ ID NO: 446 - protein, 384 aa, Oryza sativa
MAAVFFHHVVGDLTVGKPEVVELHDTDTPRAAPDEPPSGARFLGMISALDIATFVAASGVGDRAMAAVVGEVVQPNPGLLREVDPGTRLIDALDLMKQGVKRFLVRKNGAWRGISKRFSVLYNGKWLKNMEATSPTSASSSRELSSSTSSTYKFCCLSREDILRFLIGCLGALAPIPLSPISSLGAINPHYCHVDASVPAMEAIQKVPPDPSAVAVVETTPDGTRKILGDISAYKLWKCDYVAAAWALINLSAGQFVIGADDNESTPISAIPVPPISSSLVEEIGPGRSPRAKKFSSRSIGFLNSQAHQMAFGRMRSMYRGRSAPLMCKSTSSLAAVMAQMLSHRATHVWVTDAESEEDGVLVGVVGYTDIFNAVTKSVYPAAS

SEQ ID NO: 447 - protein, 693 aa, Zea mays
MSPDVDAAVATAVAPGGGCGGDGEAGAGTSSSPASAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQKGAVDFLVKPVRKNELRNLWQHVWRRHAMNCQTNGSENNAASNHISANVANGSKTGENSDEESDAQSFGSKRDTEIHSVEAVQDIRRDEVAGSSKNNELQNKSYDGVNTKVDVSKYTNGAPSGSEKNVRSKCLNGITSAKVAEQIMDNALRITDASSRRPTNLGNGLAMTEPAADRKCQSSVMENNAVTENNPGDKSKGAAIGHADSCPSEFMVTNLGKEHHLNGYKNQEFREKDIFNHSNSSAFSRYGNKRIEPSGEIQFFPSPCVIGQGHVNGKNPVFQPNGVLLPPNEHNTGESTRQARISLDSRTEGAAILCSTSAREDAGANSSSHRKDSMSHPSYGFIPVPIPVGATMPYHYGAILQPVYYPQSPLMHCDSAGINKAAIQHASGQPNYHEAPGKPSHVLIEHKQSEENHQLHHSRQILRESGEPIDMARAHVDRANQTASCSQGICKGSGCTCSGEADINANTMVALESGNESGIQNGDRSRREAALMKFRMKRKDRCFEKKVRYHSRKKLAEQRPRVKGQFVSQKLNSATTTDAEAD

SEQ ID NO: 448 - protein, 960 aa, Zea mays
MAEGSSSHRRSAFSPGLAVLLSGDEAKISSQKSHLVSYHDEIGHQAVERTIEHIFDLPHKSVVRPPGPVDTGFVHSVVRNQARKFDLDWENCIRGYHRSVFIVDKGAGQRKVVLDDSSICGSFRNVRGPSLVESSAPFSSARANACVWKGKWMYEVTLETSGVQQLGWATLSCPFTDQKGVGDADDSYSFDGRRVTKWNNDPKPYGQPWAVGDVIGCCINLDAGEISFYRNGTSLGVAFDGIRSVEPKKGYYAAVSLSEGERCHLNFGSHPFRYPVDGFDPLEAPPRSWSFVTYLLRCLFRLLEVHNLEKSESAYFEKLRRVKKFAPLQELFGPISEGICAEIFSAIEASQGCLEYIAWGSLITLLLDVFRTREPHDFSCLDQVLDLFLRFPGCTSLFQELIVALSCMCKVAPLVLTECPYSGSYPFLALVCHLLRHKDVMCLWWKAEDFVFSFEGFLTRKIPNKQDLQCLVPSVWWPGSSEDEVSMTLTMTTLSDAIKKIEEMHRELCSLVICFIPPMSTPQPPGSVFRSFVQSLVLKARGGDHRMVVNGTFNNTVLVSLYTVILHLLSEGFSMDSAGSASSSKANFGNGVGFLHKGGKRKFPTQLFFRNDAYHSVIPRIGGPPSILMHHQFDAVENEVQWDEGCMNDEETRVTHTTAQKPCCCSVTDVAVGLRYKETAKYVPSTSKGSCKPMPERSPHVAAECNGRGLSDEIEDKPSTSAQSEIEYGYQSLHSLENMPMATQSSSETLKEEELLDVMLLLYHLGISPNFRQAILISISSLQAFYFMSQQSQSISLLEETDRQIREKSCSEQVRRLKEARNSYHEDLVDCVRHCVWYRATLFSQWKQRGMYATCMWVVELLLVLSNSNSMFHYVPEFYVESLVDCFHALRRSDPPFVSPALFLMQGLASFVTLVVKHFDDTRIVNPDLKDLLLQSISVLVQYKEFMLVFENNREAINKM

SEQ ID NO: 449 - protein, 715 aa, Zea mays
MAGAPSSLARLLLLLLLAAGCLLPLVADAARLTLSLAPAADALLRLKAGIKDDGGALGSWSPDTSPCADGGPSWKGVLCNKDGVHGLQLEGMGLSGTLDLRALTSLPGPGLRTLSFMNNEFAGPLPNVKELSGLRAVFLSENKFSGVIPADAFAGMGSLKKVVLSNNDFTGPIPASLADAPRLLELRLNDNKFQGKIPDLKQEELTEVNLANNELEGEIPASLKSMTSDMFAGNKKLCGPPLGAKCEAPPTPSPKAHPQASVKEGTTPSQAAADTVASTGASSADDPKQDEGQEPVEGSISFGVSAALLGTLLIAGVAFIALRRRRGYKTKNFGPTASSSRPSGPPRVEPHPPAAKAPAAAGGVAHGGGAARKAEQGRLTFVRDDRGRFFELQDLLKATAEVLGAANLGVCYRATLTTGQSVVVKRFKEMNRVGREDFEEHMRRLGRLSHPNLLPLVAYYYRKEEKLLIHDYVPNRSLANLLHGGGESGGMKKAAVHWAARLKIVKGVARALSYLYDELCMLTVPHGHLKSSNILLDAHHGPLLTDYALVPVMNQSHAAQLMVAFKSPERKQFGRSSKKSDVWCLGLLILEILTGRPPTYDPPKAAAPSGELSSSQQKPGPAAGNTDLVTVVGSTPEGEWLNTVVDRDLRGEEEEDKEEMVKLIRVGMACCESNVDNRWELKTAIERIEELKAKERPDEEQATVIDEDYSDVALN

SEQ ID NO: 450 - protein, 903 aa, Hordeum vulgare
  misc_feature (146)..(245): Xaa can be any naturally occurring amino acid
  misc_feature (309)..(309): Xaa can be any naturally occurring amino acid
  misc_feature (801)..(801): Xaa can be any naturally occurring amino acid
METLNPDAADGAAAAAGGAARGEAEARRPEKAEALGLDPELTVARIYLGRIGAGLQNLGNTCYLNSVLQCLTYTEPFAAYLQSGRHKSSCRTAGFCALCALQNHVKTALQSTGKIVTPSQIVKNLRCISRSFRNSRQEDAHELMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGRALQAESCSKERFTIDRAPNVLTVHLKRFSPFRPREKIDKKVDFQPVLDLKPFMSDSKGAXYKYSLYGVLVHAGWSTQSGHYYCFVRTSSGMWHNLDDNQVRQVREPDVLKQKAYMLFYVRDRIGNTLGCKDNITPNLPVNKVIPGKISSINGAIRSGVMEAKSSGLTSPYANKKLQSTSNAHSSVSNMTLVDHCSTNDGKAETAAAPQNSVLPAAQKALGPQNDGVTLSTKSKQVASSNHKETSSSGQPASSNQTMAKMSLQEPKAGGAFAKLGNNTSIVSSMVSGPAGLSETDKQTSCAQTCSKPSLNLVGTITGFTTQTFQTKDAVVSNGVIPSTSGGGPVSSEKMKDLTGSLKQDDHTVKALTTSKEKTLLPGLEQVDVGKQISSQVSTKVVPGDSCNGRMTKRVDWKSKKLVRYPVIKLWLRPRQLPLKQQKKKHKRTKKHAIVKDTTSVDCSGDNSSEQQTSTSATVPPKTAESTSRKRKHSHASVSSENDTKAFKDSQQVVGASSAGAGDHNMDTRNSKSGTSASTGLPKLGSSSSANQAHSRNNXDAKRQVVIHTEDLRAEVTVPCWDDVAVPNTETIEYRSSGKKSIGYVLDEWDEEYDRGKAKKVRKAKEDEDDDGTNPFQAEANHVSARKEKQRPWSKPARPRR

SEQ ID NO: 451 - protein, 295 aa, Hordeum vulgare
  misc_feature (224)..(224): Xaa can be any naturally occurring amino acid
PIMPPLLLLLLAALAPVLSHAAAGGSYDPARVAQISWRPRAFLYSGFLSHAECDHLVELAKGRLEKSMVADNDSGKSVMSEVRTSSGTFLSKREDEIISGIEKRVAAWTFLPEENAESMQVLHYEVGQKYDAHFDYFSDKKNVKRGGHRVATVLMYLTDVKKGGETVFPVAEGRDLQHKDETWSECARHGLAVKPRKGDALLFFSLHVNATTDPSSLHCELPSXSEGEKWSATKWIHVRSFDNPPDVMTDAPCSDANEQCPRWAALGECYKNAKYMVGTKDTLGSCRKSCGVCDA

SEQ ID NO: 452 - protein, 164 aa, Hordeum vulgare
  misc_feature (131)..(131): Xaa can be any naturally occurring amino acid
GTRPGQPSDADLGELLPEGFLERTKEKGMVWPTKAPQKEILAHASVGGFVTHGGWNSTLESLWFGVPMVPWPLYAEQHLNAFTLVAYMGVAVAMEVDRKRNNFVAASELERAVKALMERDSEEGKRAREKXAEMKAACRKAVEEGGSSYSALGSLSEEIINGAN

SEQ ID NO: 453 - protein, 109 aa, Hordeum vulgare
SVLESLWHGIPMAPWPLYAEQHLNAFELVADMGVAVPLKVDRRRGNFVEAAELERAVRCLMGEEGRTAREKAAGMRDVCRKAVDKGGSSDAALQRLSEALHHGAVAPTI

SEQ ID NO: 454 - protein, 230 aa, Hordeum vulgare
LHSGAAPSHGAQQRPGESPLAGIGSNLWKEQDAPLRWLDGRPPRSVVYVNFGSIAVMSKEHMLEFAWGLANTGYAFLWNVRPDLVKGDDEAALPPEFSTATEGRSMLSTWCPQEKVLEQEAVGVFLTHSGWNSSLEGICGGVPMVCWPFFADQQTNCRYKCTEWGIGMEIGDDVKRTEVEALIREAMEGDKGREMRRRVLELWESAVASARPGGRSMRNVDRLIHEVLLA

SEQ ID NO: 455 - protein, 177 aa, Hordeum vulgare
PSDITPFSHSAATISNAAAVLDALTDDPQQLGIKAWKNARDATGYTPEDYARRRGHTSYIQMVQNKINRGLPAAHVSVSMTTTGITEEHADAGRPKSTDQTIFDVEKSLPGCRQCVQLQHIAYRPCPNRFLSNRPAVLSLVAIATVCVCVGLIMQSPPVVRGMPGPFLWNRLRWGPT

SEQ ID NO: 456 - protein, 236 aa, Hordeum vulgare
KEFILERNLLYPNPLEKDLTNEDKEVYHRYKVFMRFLSKEEHEALVRSVIEERKIRRRIQELQECRSAGCRTLAEAKIHIEQKRRKEYEANALKAKESGQLISNSKSGHKTNRPMKVETDGSLDLKKGSAILDAGGRDSPKSTGPTSAKQWDDWDIVGLPGAELLSVSEKLLCCQNRLLPSHYLRMQEVLMQEMFKGNIVKKEDAHVLFKVDPAKVDTVYDMVTKKLGNNEEAPMV

SEQ ID NO: 457 - protein, 148 aa, Hordeum vulgare
LDRTKDRGLVVMSWAPQREVLAHGSVGGFVTHCGWNSVLEAVMAGVPMLGWPLYAEQRMNKVLLVEGMQLGVAVERGEDGFVTAEEIERKVTWLMGSDGGRELRERTLAAMRGAREALSDGGDSRAALLQLVQRLSAPDVTEESVCQL

SEQ ID NO: 458 - protein, 124 aa, Hordeum vulgare
GYRVPKGSHVLLSRLGLGRNPAIWNDPLRFNPDRHLEGAGGNLELTENELRFISFSTGRRGCVAPMLGTAMTVMLFGRLLHGFTWSKPAEMPDIQLTESHNDLSMAKPLVLHAKPRLPLHLYRP

SEQ ID NO: 459 - protein, 89 aa, Hordeum vulgare
AGPLSADFSVTGSDLRLAPFGSGRRSCPGKSLAMATVGFWVATLLHEFEWTPPPPSSAGPGGVDMSEVLRLSCEMAAPLEARLRPRRTV

SEQ ID NO: 460 - protein, 207 aa, Hordeum vulgare
SHALGLSISSSTSLIAPMSMQQQQQQPTSANLLGAMPASSMISIAFTAAVGTAVLFVAVAVARYNRKYRGLRLPPGPPVWPIVGNLFQVAFSGKLFIHYIRDLRREYGPILTLRMGVRTLVVISSAELVHEALVEKGPEFASRPAENTTRNIFSSNSSPSIPPCTAPVAVVASEHGVRDAEHVASPGVPPARLRAMDRFVARMRADA

SEQ ID NO: 461 - protein, 523 aa, Zea mays
MGIMRVADDVEARLVVGAGGGGGTATTTTEPLLRHCHGGRKEEDDQGSKIRDSPEAEGASDCGRTDGGSLRMVLVSTAVAVCGSFEFGTCVGYSAPTQSGIVEEVGLSISEFAIFGSVLTVGAMVGAVTSGRLADFLGRKMVKSLRCQLRPIFLTMRISATICIFGWLSIHLAKSAIMLYFGRTLLGFSTGVLSYVVPVFIAEIAPKNLRGGLATSNQLLICSGSSATYIIGALVAWRNLVLVGLVPCVLLLAGLFFIPESPRWLANVGREKEFHASLQKLRGEDADVSEEAIEIKEYIESLYSLPKARLRDLFLSKNIYAVIVGVGLMVFQQLGGINGVGFYASYIFSSAGFSGKLGTILIGIIQIPITLFGAILMDRSGRRVLLMVSASGTFLGCFLTGVSFYLKAQGLFSEWVPTLALSGILVYIGAYSIGMGPVPWVVMSEIFSINMKATGGSLVTLVSWLGSFAISYSFSFLMDWSSAGTFFMFSSASLITVLFVAKLVPETKGRTLEEIQDSLNTRR

SEQ ID NO: 462 - protein, 476 aa, Zea mays
MGPACKTAARPRVLLLCSPCMGHLIPFAELARRLVADHGLSTTLLFASATSPPSEQYLAVAAAVPDAVDLIALPAPPPDALPPATAARERAELAVASNVPRVREIARELGAAAPLVALVVDMVGAAAARDVAAELGVPFYAFFTSPWMTLSLLLRLPEIDAARAGEHRDAAEPIRLPGCVPIHAHELPTSMLADRSSSAYAGFLSMAKGVAGVDGVLVNTFRELEPAVGGDGRLQLPVYPVGPLVWTRPAGVDTDHECMSWLDGQPRGSVAYVSFGSGGTITWQQTAELALGLELSQCRFIWAIKRPHQSSTIAAFFGTQRGDEHSPLDFLPEGFMERTRGMGLVAQSWAPQTAILGHPSIGCFVTHCGWNSVLESVINGVPMVAWPLYAEQNMNAAMMEVQVGVALRAKVGADRFIRKDEVANAIRRAIVGEEAERLRKRSSELRRQSAQALSKDGCSTRALAQIANAWKCASRK

SEQ ID NO: 463 - protein, 661 aa, Oryza sativa
MARRWPPLVVGLALLLLLSVAASSVVAKTDQPDVAALNVMFESMNKPSELLGWKASGGDPCGDDDEWKGIECSDSSVTEINLSGLGLSGTLGYQLSSLKSVTKFDVSKNNLNGEIPYQLPPNVVQLNLRGNAFSGGVPYSISQMTDLETLNLGKNQLSGQLTDMFSQLPKLTTMDLSFNSFSGNLPPSFQYLKNLKTLDVESNQFSGHINVLAKLSLEDLNVKNNKFTGWIPSKLKSIDNLETGGNSWSSGPAPPGMEKESSAGSSNGRDDSGINGFAIGAMVIAVLLAALILLSVLRRNHSSPVSSHYYTDESGPSMGCKTPPAVPRKSMSDNEFENKLNHSRRSTDPISLMNHSSSDLQAATGNFSSNRQLGQGTTGCVFRAKYADGRVLAVKKFDPLSFSGSSDFMDTVNGIAKLRHTNISELVGYCSEPGHYMLVYDYHMNGSLYDFLHLSDDYSRPLTWDTRVRIAACTAHALEYLHEVCSPPVLHKNIKSSNVLLDADLNPHLSDCGLSFFYEDASENLGPGYSAPECSRPSAYVMKSDVYSFGVIMLELLTGRKPYDSSKPRTEQCLVKYVAPQLHDSDALGSLADPALRGLYPPKALSRFADCIALCVQADPEFRPSMSEVVQSLLRCVQRTISNRGMAGYLSNSQRSDISDW

SEQ ID NO: 464 - protein, 377 aa, Hordeum vulgare
  misc_feature (266)..(266): Xaa can be any naturally occurring amino acid
MAKEGAGGGPDWNGLLKWSLAHGADGTNPPRALSEEDRKWFMEAMQANTIDVVGRMKEIAQVMKTPDDVLQSHGVTPGNIEDMLDELQEHVESIDNANDLHSIGGLDPLLGYLKNSHAGIRAKAAEVVSTVVQNNPKSQQLVMESNGLEPLLTNFRSDPSTTARTKALGAISSLIRNNQPGLAAFRLGNGHAALKDALGSDDARLQRKALHLTQYLLNNKADRSVAEEIGLPNQLIHLASSEDSGVREAALGGLLELARDKAPVAXNALPDQDKLKDVLRSRIEGISTMDADDLQAAREERQLVDSLWKECYGEPSSLREKGLVVLPGEDEPQQPPPDVAGKMFEPPLRAWAAPRPSSAEDSDSASGKKDPPLLLGP

SEQ ID NO: 465 - protein, 996 aa, Oryza sativa
MENDHGDLDDVGSGWLEVKKKHRSSSKFTLQRSSGGSNDNKISNSSSQSQTNFGSDSAKWCDRLQCSPQITKVNVCVNEPGSVVTMVVHGEECAHADASNLKSELSVSASDHAIEKPKKLLVTEEISEPPNVGKIDCADSPTPHQSSNCSSGLAKSSGFYDHVKGPPMTDSIGVLSNTSVRFGDFDEVPGLALPADACRNNSSSQKHIHIGDATEFINECKDESELKTEPNSCKTIVETSPVIIQGAETPTEDESKVLDICEITDNRLDVSGSPSLDDTVSLSCANNDLEVPVKSSSVASTESQTVLHAPTSADFGGETAGSKERFRQRLWCFLFENLNRAVDELYLLCELECDMEQINESILVLEEAISDFQELKSRAEHFDNTKKSTALPKEGMPMAVKADHRRPHALSWEVRRMTSSPHRQEILSSSLEAFQRIQLELARKQAGITTESFASSSSGEVSGSSSKLTTASATVGSISLKVESQVKLSDTEKKIAGERQSKDTIKSGRSPPQNMPSSSAKSRKGSLEPISEVEKHNFRKDKELPENKFDKLRSTDTAKRTTVHTEKEKQNAAPRKSLDAWKEKRNWEDILKSPVRSSRVSHSPGVGRKVPERARVLHDKLMSPEKKKRSALDMKKEAEEKHARALRIRSQLESERVQRLQRTSEKLNRVNEWQAVRSSKLREVMNARHQRSESRHEAYLAQVAKRAGDESTKVNEVRFITSLNEENKKFLLRQKLHGSEMRRAEKLLVIKTKQKEDIAREEAVLERRKILEAEKMQRLAEIQRKKEEAIIRREEERKASSAAREARAAEQQRRKEIRAKAQQEEAELLAQKLAEKLRESEQRRKYYLEQIRERASMDFRDQPSPFQRRFPSKDNQNRSSSANSGEDSQIISSANAAESGVKSFNSTQMKRRIKKIRQRLMALKHDFVEPLIGENTGIVHRSALGTAKAKLSRWLQDLQRLRQARKEGAASIGLIVSDMTKVLLVCSILCCNKDVY

SEQ ID NO: 466 - protein, 158 aa, Oryza sativa
DKREAPLFSTPRELKPSMENGGEEDDRASRCKRITRESDATKNGAATKLQALRLVEDLSLPSVQVVVMSANMGCSHCRQRVTKVVSKMNGLLDYMVDFGKKEVTVRGTMVHTKKKRKQHKKKHEENKKGIAANWEKKSSSQSNDSARTLAWFLRCYSS

SEQ ID NO: 467 - DNA, 1900 bp, Brachypodium distachyon
tgccgagcgaccctgccccctcgctcctggatcttcttcctcctcggccgagcgccgccacccatcccgctgccgagcgcccatcgtcttcctcctcgcgcgagcgcctccaccgcagaaactgaggagcgcagcataacacgagcaaaatcagcctgcccttcctatcaaggactttttttatttccagtacagctttcgagagatgcaaaaaatgatggggggaaaacctaaccttggttgacggaatgaaattgaggagcacagcaataacacgagcaaattcagcctgtcttcctatggaggatcgtggttgttttaagtacaatggtgtcaatgagggcgaagaagagcgaaagggagggcatggcatcccaaaggtttccatggtcccccttatattcctcatattctatgaagtttcaggggggcccttcgggattgaggatagtgttaaggctgctgggccgctcctagcaattgtgggatttcttctgtttgcactcatatggagtgttccagaagcactgatcactgctgagatgggcactatgttccctgagaatggtggctatgttgtctgggtctcttcagctcttgggccattttggggatttcagcaaggctgggcgaagtggatcagcggtgtcatagataatgccctctatcctgtcctttttcttgactatgtcaagtctagtattccagctcttggtggtggacttccaagaacctttgcagtgcttatcctcacagttgctcttacttacatgaactacagagggttaacaatagttggctgggtggcagtctttcttggggtgttctctctgctaccattctttgtaatgggattgatagctattccacgcattgaaccttcaagatggcttgaaatggacctgagcaatgtgaattggagcttgtatctgaacactctgttttggaacctcaactattgggattcaatcagtacattggctggagaggtcgagaatccaaagaggactcttccgaaggcactttcttatgctctagttttggtagttgggggatacctgtaccctctgatcacctgtacagcagcactaccagttgttcgggagtcatggacagacggatatttctcagatgttgcaaaaattcttggtggtttctggttgcattcatggattcaagcagcagcagcattgtcaaacatgggcaactttgtcaccgaaatgagcagtgattcttatcagcttctcgggatggccgagcgaggtatgctccctgagttcttcgccaagagatcgcggcacgggactccgctggtcggcatcctgttctccgcgttcggcgtggtcctgctgtcctggatgagcttccaggagatcatcgccgcagagaactacctctactgcttcgggatgatcctggagttcatagccttcatcaagctgaggatgacccaccccaacacctcccggccttacaggatcccgctgggcaccgtgggcgcggtcctgatgatcatccccccagccatcctgatcatcgtggtgatggcgctggcgtccttcaaggtgatggcagtgagcatcctggcggtccttattgggtttgcgctccagccgagcctggtgtacgtggagaagaagcggtggctgaggttctctgtcagcgaggacctgcctgagctgccggactcctcgcctgttgccgatggagatgagaccgtcccccttgtcatctgatttatgcaaatgtaatccccattcagaacatgctgcatggaagaaactataaatccagtgatctaaagcctgccgccatcgcgctggtttaccttgatgtcatccgaaaagaagtagagcatgtttaacttgcaatatacggagtacttagtttgctttgggtt

SEQ ID NO: 468 - DNA, 2259 bp, Zea mays
atgccactgccagatctcctctcctctccactgaggactctgaccagtgggactaggatattccttcttcttcacccacgactccgccttcctagttcttgggcggccggtgaggacgaacacggactcgcgctctcgctcgcgccatcggaggaaaggagatccactcggagcatgcgggccgccgcgcggtagatgaaactgaggaacacggcaataacacgagcaaattcagcttgtcttccaatgggggatcgtgttggtgtcaagtacaacagcatcaatgaggctgaagagcataagggagggcatggcatccccaaggtttccatgatacccctcatattcctcatattttatgaagtttcagggggtccctttgggattgaggatagtgtcaaggctgctgggccactactggcaattttgggctttcttctgtttgcactcatatggagcgttccagaagctctaatcactgctgagatgggcactatgttccccgagaatggtggttatgttgtctgggtttcttcagctcttggtccgttctggggttttcagcaaggttgggcaaagtggctcagcggtgtcatagataatgccctctatccagtcctatttctggactatgtcaagtccagtgttccagctcttggaggtgggctcccaaggaccttagcggtgcttatcctcacagttgcgcttacatacatgaactacagagggctgactatagttggctgggtggcagtctttcttggggtgttctctcttctcccgttctttgtgatgggattgatagctattccacagattgaaccttctaggtggcttgaaatggacttggggagtgtggattggggattgtatctgaatacactattttggaacctcaactattgggattcaatcagcacattggctggtgaagtcgagaatccaaagagaaccctaccaagagcgctttcttatgctctagttctagtggtgggaggatacctctacccattaatcacttgcacagcagcagttccaatcgttagggagcactggtcagatgggtatttttcagacatcgcaagaattctcggtggcatttggttgcactcatggattcaagcagcagctgctttatccaacatgggcaattttctcactgaaatgagcagcgattcttaccagcttcttgggatggctgagcgaggcatgctccctgacttttttgccaagagatctcactatggaaccccgcttattggcatcctgttctctgccttcggtgtgatcctactgtcctggatgagcttccaggagatcatcgctgccgagaactacctctactgcttcggcatgatcctggagttcattgccttcatcaagctgcgggtgtaccatccgaacgcctctcggccctacaagatccctttgggcaccattggtgctatccttatgatcatcccacctggtctcttgatcattgtggtgatggcactcgcgtcctacaaggtgatggtggtgagcatcctagcgatggtcttcggattcgtgctgcagccgtgtttggtgtacgtggagaagaagcggtggttaaggttctccatcagtgcagacctgcccgatttgcctgatgtgcaggaaattgctgaagatgatgctgtcccactcgtggtctaatattcggccattgtgctctggaggtgttgttcccaatcgagacatcctaggatggaatgtgacacactgggattcacgaccttgtatctcctgaatgagttccaaagccagaggtcttagacatcttgtataaggacacattatgttttcaccgtgctattgaacatcatgatggcatcatgcatcaaacagaaatgtaagccccagacagtgttcatcaaaggagatcctccagattatcaaatacatgttgcatctgctgtcagctgtcgcttaacttgtctatatactagggtcgatccatgacatgacatgaggttactcatctgggatcgccttaaaatgggtgaacgttaactcttgataagaggcagtagaggttctcgacctgcagattgtaacctggtttccattgcataaactgttatcagtaattccatcttttgcgtacagttttgtgttataaatggagcatcggcgtaattgtccttggaagttagttgccattattctgcatggttcgactcatttttgcaaacaatataaaatgtttttcgcaaacaatataaaatgttgagtttt

SEQ ID NO: 469 - DNA, 2104 bp, Pennisetum glaucum
gacaagatagtacttgcatgttaatactaaaatggaatgcaccatttttccccatattattacttatgttcatcatgtccatcttgcaagttgaaacattgaaacaagcaactaccttaggcattgcatatttttgatattctggttttccattgcagaaattgaggaacacagcaataacacgtgcaaattcagcctgtcttccaatgggggatcgtgttgctgtgaagtacaatagcgtcaatgatggtgaagagcgtaagggaggccatggcattgccaaggtttccatggtccccctcatcttcctcatattctatgaggtttctgggggtccctttgggattgaggacagtgtcaaggctgctgggccactgctagcaattgcaggttttcttctgtttgcgctcatatggagcattccagaagctctaatcactgcagagatgggcaccatgttcccagagaatggtggttatgttgtctgggtctcttctgctcttggtcccttttggggttttcagcaaggctgggcgaagtggctcagtggtgtcattgataatgctttgtatccagtcctctttcttgactatgtcaagtccagtattccagctcttggaggcgggctcccaaggaccttggctgtgcttatcctcactgttgcacttacatacatgaactacagaggtttgaccatagttggctgggtggcagtctttcttggggtgttctctctcctcccattctttgtgatgggattgatagctattccccggattgaaccttcaaggtggcttgagatggacttggggactgtgaattggggagcatatctgaacacattgttttggaacctcaactactgggattcgatcagcacattggctggagaagtcgagaatccaaagagaaccctcccgagagcactttcttatgctttagttctagtggtggggggatacctctaccctctgatcacttgtacagcagcaattccaattgttcgggagcgctggtccgatgggtatttttcagacattgcagggattctcggtggcgtctggttgcacacatggattcaaggagctgctgcgttgtccaacatgggcaacttcctcacggaaatgagcagcgattcttaccagcttctggggatggctgagcgtggaatgctccctgaattctttgccaagagatctcgctacggaaccccactgatcggcatcctgttctccgccttcggtgtgatcttgctgtcctggatgagcttccaggagatcgttgctgctgagaactacctctactgcttcggcatgatcctggagttcattgccttcatcaagctgagggtgacccatccagatgcctctcggccctacaagatccctctaggcaccattggtgctgtcctgatgatcatccctcctactatcctgatcgtggtggtgatggccctcgcatccttcaaggtgatggcagtaagcatcatggcgatgattgtcgggttcgtgctgcagccatgcctggtgtacgtggagaagcggcggtggctgaggttctccatcagcgcggatctgcctgatttgccagattcgcagcaagctaccgaagaggacactgtcccgctcgtgttatgattcgcttgtgttgtgctcttggaggtgtagttcccaattgaagcagcctaggatgaaatacactgggttcctcacgagttgtatctccctgatgagttccgaagctgatcccgaatgtaatgctgctttctgctgccatgacgccgttattgaatagcttgttggcatctgcagaaaatgtaaagccagtgttggtagatggagttcctcgatatgtggatgtgtcgtttattcccacacttttcctacactattgagagacatgatgatctgggtctggtgaatggaagagtgaacccttttcagaaccaacaatatgacatactcttgtgctgcacttagataccgtggttgttacttgattggtatactttgatatctcgtctcttggttgcatagttgtatttttcagttctccaagtcggaaacgcttggagcataccacatttctgtacgttttcatctgt

SEQ ID NO: 470 - DNA, 2260 bp, Sorghum bicolor
tctctcctctgcacagaggactctgaccagtgggactaggctgcccccatcgcctactcctgcctgcaggactccgtctcgccgccgccctgctctcgccctccctcccagttctcggcgtctcggaggaagtgacgaacgcggactcgcgctcgcgccgtcggagggagggagatccactcggagcatgcgggccgccgcgcgctagatgaaactgaggaacacagcaataacacgagcaaattcagccttttttccaatgggggatcgtgttggtgtgaagtacaacagcgtcaatgagggtgaagagcgtaagggagggcatggcatccccaaggtttccatggtacccctcatattcctcatattctatgaagtttcagggggtccctttgggattgaggatagtgtcaaggctgctgggccactactagcaatcgtgggcttccttctgtttgcgctcatatggagcattccagaagctctaatcactgctgagatgggcacaatgttcccagagaacggtggttatgttgtctgggtttcttcagctcttggtccgttctggggttttcagcaaggatgggcaaagtggctcagtggtgtcatagataatgccctctatccagttctttttctggactatgtcaagtccagtgttccggctcttggaggtgggctcccaaggaccgtagcagtgcttatcctcacagttgcgcttacatatatgaactacagagggctgactatagttggctgggtggcagtctttcttggcgtgttctctctcctcccattctttgtgatgggattgatcgctattccaaggattgaaccttcaaggtggcttgaaatggacttagggaatgtggattggggattgtatctaaatacactgttttggaacctcaactattgggattcaattagtacattggctggtgaagttgagaatccaaagagaaccctgccaagagcgctttcttatgctctggttctagtggtgggaggatacctctacccattgataacttgcacagcagcagttccagttgttcgggagtactggtcagatgggtatttttcagacattgcaagaattctcggtggcatttggttgcactcgtggatccaagcagcagctgctttatccaacatgggcaacttcctcactgaaatgagcagtgattcttaccagcttcttgggatggctgagcgtggcatgctccctgacttttttgccaagagatctcaccatggaaccccgcttatcggcatccttttctctgcctttggtgtgatcctactatcctggatgagcttccaggaaatcattgccgctgagaactacctctactgctttggcatgatcctggagttcattgccttcatcaagcttcgggtgacccatccgaacgcctctcggccctacaagatacctctgggcaccattggtgctgtcctgatgatcatcccaccagctgtcttgatcatcgtggtgatggccatcgcatcctacaaggtaatggcggtgagcatcttagcgatggtcattgggttcgtgctgcagccatgcctagggtacgtggagaagaagcgatggctaaggttctccatcagtgcagacctgcccgatttgcctgatgcacaggaaactgctgaagatgatgctgttccactcgtattctaaacttccaatattccactgtggaggtgttgttcccaatcgaggcattgtaggacggaatgtgatactgggattctcaacctgtatctcctggatgagttccaaagccagcaatcttagacatgttgtataatgatgcattatgttgtcaccatgctattggagacatcatgatggcatcaaacagaaatgtaacaccaccaaatacttgttgcatctgccgtcagctgctgcttaactcatttatatactagggtagatccatgatacgacatgaggttgctcatctggaaataggaactcttgatacaagtttcgcctttaaataggagaacgtgaactcttgacctggttgcctggttttctttatgggggaactgttatcagtaattcgatcttttatgtacaggtttgtgttataaatggagcatcggtataattgttcttggaagttagttgtcatttctgcattttcaagtctgagtttcacaaactatattgagtcttggaggggatctgttattttttcctggattcttgaatccaaattttcattgttataatgtttatgaa

SEQ ID NO: 471 - DNA, 1947 bp, Panicum virgatum
tgctggggcggtgctgccttcttctccccggctccgcctcctccaccgccaccacctcgccgccctctctctctcttccagaccccgggcgctcggtttccgtcccgggagggggaggacggggggagaggcgcgggacggggggcccgcgctcgcgccgtcggagggggaggggcgggcggacgctgatccgctcgccgagcatgcgggccgccgcccggcgctagatgaaattgaggaacacagcaataacacgtgcaaattcagcctgtcttccaatgggggatcatcttgatttcaagtacaacagtgtcaatgaaggcgatgaacgcaagggaggccatggcattcccaaggtttccatggttcccctcatcttcctcatattctatgaggtttcaggggggccctttgggattgaggatagtgtcaaggctgctgggccactgctagcaattgtgggctttcttgtgtttgcgctcatatggagcattccagaagctctaatcactgcagagatgggtaccatgttcccagagaatggcggctatgttgtctgggtctcttctgctcttgggcccttttggggttttcagcaaggctgggcgaagtggctcagtggtgtcatagacaatgctctatacccagtcctctttcttgactatgttaagtccagtgttccagctcttggaggtgggttcccaaggaccttggcggtgctcatcctcacagttgcacttacatacatgaactacagaggtctgaccatagttggctgggtggcagtctttcttggggtgttctctctccttccattctttgtgatgggagtgatagctattccccggattgaaccatcgaggtggcttgaaatggacttggggagtgtgaattggggattgtatctgaacacactgttttggaacctcaactactgggattcgatcagtacattggcgggagaagtcgagaatccaaagagaaccctcccaagagctctttcgtatgctctggttctagtggtggggggatacctctaccctctgatcacctgtacagcagcaattccagttgttcgggagcagtggtcagatgggtacttttcagacattgcaagaattcttggtggcatctggttgcactcgtggattcaaggagctgctgcattgtcaaacatgggaaactttctcactgaaatgagcagtgattcttaccagctccttgggatggctgagcgcggcatgctccctgagttcttcgccaggagatcacgccacggcaccccgctgatcggcatcctgttctctgcctttggcgtgatcttgctgtcctggatgagcttccaggagatcatcgctgctgaaaactacctctactgcttcggcatgatcctggagttcatcgccttcatcaagctgaggatgacccatccgaatgcctctcggccctacaagatccctctgggcaccattggtgctgtcctaatgatcatccctcctgctctcctgatcgtggtggtgatggccctcgcatccttcaaggtgatggcagtaagcatcatggcaatgatcgtcgggttcgtgctgcagccgtgtctggtgtacgtggagaagaagcggtggctaaggttctccatcagtggggacctgcctgatctgcctgattcgcaggaagctgctgaagatgacaccgtcccgctcgcgttctgatttgctggtgccgtgctctgcaggtgtagttcccaattgtaggatgggatgtactgggtttcacgagttgtatctactgatgagttccgaagcagatctcgtgtctaatgctgctttctgttgccaccatgctgttattgaataacatgttggcatcagcagaagatgtaaagccagtgttggtaaacggagctcctcaatatagatgtgtcgtcagttgtcgactgacctttatccc

SEQ ID NO: 472 - DNA, 1601 bp, Triticum aestivum
  misc_feature (911)..(911): n is a, c, g, or t
  misc_feature (925)..(925): n is a, c, g, or t
  misc_feature (927)..(927): n is a, c, g, or t
  misc_feature (957)..(957): n is a, c, g, or t
  misc_feature (984)..(984): n is a, c, g, or t
cggcacgaggcgatcctcccggtcgcggcggcgcttccccgatccgtgccgttgacaagggattcgagcagggcagcgcagggaggggagcctctgtgtgccgccgcccccctgcttccctcctctcctctctgtgccgccgggagaggagctcgtcaagccaaggtgcgcaagagaccgccgtgtggtgctgcgcgcgtggttcttcttccactccggcgcctcctgccctgcccctccggtggccgcttcgtcttcttatactccggcacaggtgatattgaggagtacagcagtaacacgggcaaattcagcctttcttcgtatggaggatcgtgttgatttcaagtatgatggtgtcaacaacgagagcaaagagcataagggagggcatggcatcccaaaggtttccatggtcccacttgtgttcctcatattctatgaagtctcggggggtccctttggaattgaggatagtgtcaaggctgctggaccactcctggcaattgtggggtttcttctgtttgcgctcatatggagtattccagaagccctaatcactgctgagatgggtactatgtttcctgagaatggtggctatgtcgtctgggtctcttcagctcttgggcccttttggggttttcagcaaggatgggcgaagtggctcagtggtgtcatagataatgctctctatccagtcctttttcttgactatgtcaagtccagtgttccagctctcgggggtgggcttccaaggacttttgcggtgcttatcctcacagttgcccttacttacatgaactacagaggattaactatagttggctgggtggcagtctttcttggggtgttctctctgctccctttctttgtaatgggattgatagcaattccacagattgaaccttcangaggtttgaaatgnanctggacaatgtgaattggggcctgtatctnaacactctgttttggaacctcaactantgggattcaatcagtacattggctggagaggttgagaatccaaagagaaccctccccagggcactttcttatgctcttgttttagtagtcgggggatacctctaccctctgatcacttgtacagcagcacttccggttgttcgggagtcgtggacagacggatatttttcagacattgcaaaaattcttggtggtttctggttgcactcatggattcaagcggcggccgcattgtcgaacatgggcaactttgttactgaaatgagcagtgattcataccagcttctggggatggctgagcgtggcatgctccctgagttcttcggcaagagatcacgctacgggaccccactgatcggcatcctgttctccgcgttcggtgtggtcctgctgtcctggatgagcttccaggagatcattgcggctgagaactacctctactgcttcgggatgatattggagttcatcgccttcatcaagctgaggatgacccaccctagcacctcccggcctttccggatcccgctgggcaccgttggctccgtcctgatgatcatccctccgactatcctgattgtcgtggtgatggtgctggcttccttcaaggtgatggctgt

SEQ ID NO: 473 - DNA, 1967 bp, Hordeum vulgare
ataccaacaaagtgtcccctcccacccctctcacgccgccgccgccgcaaccctgaaaacctaaccaaaccccccagcgccacaccatggcgtccgcctacgaccgggaggacggcctcgcgccgccgcagccgcacggcggcggccccgccgacgcctacgatcccaactacgtcccggactcggtgaagaccttcgtggtgcacctgtaccgccacatccgcgacaagaacgtctacgagatccaccagatgtacgagggcggcttccagcgtctctccgaccgcctcttccgcgacacgccctggccgtcggcggaggccgtggcgccctactgcgacggcgaccacgtcttcctcctcctctaccgcgagctatggtaccgccacgcctacgcgcgcctctcccccctcaccgccagccaccgctccgagtcctggaacaactactgcgacctcttcagcgtcgtcctccacggcgtcgtcaacatgcagctgcctaaccagtggctgtgggacatggtggacgagttcgtctaccagttccagagcttctgccagtaccgcgccaagctcaagaacaagacggaagacgagctccagcagctaaagcagtttgacaaggcatggaatgtctatggggttctcaattacctgcaagcactcgtcgagaagtccatgatcgcacagattctggagagggagaaagaggggctggagtcgtttactgccaccgacgggtatgactaccagggtgggagcaatgtgctcaaggtcctgggttactacagcatgattgggcttctcaggatacactgccttcttggcgattaccacactggcctgaagtgcttggcaccgattaaccttaaccagcagggggtctacaccattgtcattgggagtcacatctcgacgatctatcattatggatttgcaaaccttatgatgcgcaggtatgttgatgctaccaaggaattcaacaaaattctgctttatattataaagtataagcagtaccatcagaaatcccctcagtacgaccagattctgaagaaaaatgagcagatgtatgcgctgctggcaatttgcctatctctgtgtccgcaaaacaaactcatagatgaaaatgttagcacccagctgaaagaaaagtacaatgacaaaatgacaaagatgcagaggtttgatgatgaagcatatgctgcctatgatgagctattttcgtacgcctgccccaagtttattactccatcacctccagttctggaccagccacttacaaattataaccaggacgcctatcggcttcagttgaagctgttcctttatgaagtgaagcagcaacagctcctttctggtatccggagctatctaaagttatactcagcaattaccattaccaaacttgcccagtatatggaaatggatgaggcaacacttaggtctattcttatgacgtacaagcacaaaatgcatgcagttgacagtaatgggaaaattgtatccagtgcagactttgatttctatattaatgaggatgttattcatgtcgtggagtccaagtcgaccaagcgccatggggactactttttaagacagattttaaagtttgaagaaaccattgctgaattggacaaggtacagcttgactgagcatggtaaagatcatcgaggagagaaacatcccagatcatgttttcattttcctttttccttttacgggagacacttgtggcgactaatgttagcagagcattatttgtgccttctagtacacagtttgactcggtgaagcattggcaattcactgtattatcctgtttttttagttcctgtttgctatttgatgagtaatccgtcagttactagttgagaacttgagataccttccgtgtttatccaattgggtgggcacatgttttggctcacaagtattaaatctggaagctgattgcacaacgctca

SEQ ID NO: 474 - DNA, 1842 bp, Brachypodium distachyon
ccgccgccgcaaccccgaaccctaaccaaaccctccccttcccccgagcacaccatggcgtccgcctacgacagggaagacggcaccgcgccgccgtcgcacggtggcggcgcggccgacgcgtacgaccccaactacgtcccggactcggtgaagaccttcgtcgtgcacctctaccgccacatccgcgacaagaacgtctacgagatccaccagatgtacgagggcggcttccagcgcctctcggagcgcctcttccgcgacacgccctggccctcggcggaggccgtggcgccctactgcgacggcgaccacgtcttcctcctcctctaccgcgagctctggtaccgccacgcctacgcgcgcctctccccgctcaccgccagccaccgctccgagtcgtggaacaactactgcgacctcttcagcgtcgtcctccacggcgtcgtcaacatgcagctgcccaaccagtggctctgggacatggtcgacgagttcgtctaccagttccaaagtttctgccagtaccgggccaagctcaagaacaagacggacgacgagctccagcagctcaagcagttcgacaaggcgtggaatgtttacggggtgctcaattacctgcaagcgcttgtggagaagtctatgatcgcgcagatcctggagagggagaaggagggtctggagcagttcactgccactgacgggtatgactacgagggtgggagcaatgtgctcaaggtgctggggtactacagcatgattggactgctcaggatacactgccttcttggggattaccacactgccctgaagtgtttggcaccgatcaaccttaaccagcagggggtctacaccattgtgattgggagtcacatctcaaccatctatcactttggtttcgcaaaccttatgatgcgcaggtatgttgatgccacacgggaatttaacaaaattctgctttatattctgaagtataagcagtaccatcagaaatctcctcagtatgaccaaattctgaagaaaaatgagcagatgtatgcactgttggcaatttgtctctctttatgcccgcagaacaaactcatagatgaaaatgttagcacccagctgaaagaaaagtacaatgacaaaatgacaaagatgcagaggtttgatgatgaagcctattctgcttatgatgaactgttttcttatgcctgccctaagttcattaccccctcacctccagttctcgaccagccgcttaccaactataaccaggatgcctaccgtcttcaattgaagttgttcctttatgaggtgaagcaacaacagctgctttctgggatccggagttatctaaaattgtattcagcaataaccatttccaaacttgcccaatacatggaaatggatgaggcaacacttaggtctatcctcttgacatacaagcacaagatgcatgctgttgacagtaatggaaaaattgtatccagtgcagacttcgatttctacattaatgaggacattattcatgttgtggagtcgaaaccaaccaaacgccacggtgattactttttgagacagattttgaagtttgaagaaacgattgctgaattggaaaaggtacagcttgactgagcatggtagagatcatggaggggagaagcatctcagcatcctgttttctatttttgttttgtcctattataatgagaggcatatgtaacgactaatgttagcagagcattattcgtgccatccggtacaccttttgactcgagtgaagaactggtcattcactgtattacccgctttctgaaatcccgtttgctatttgagcattccatcagcttactagtc

SEQ ID NO: 475 - DNA, 1954 bp, Cenchrus ciliaris
  misc_feature (445)..(445): n is a, c, g, or t
  misc_feature (934)..(934): n is a, c, g, or t
  misc_feature (1574)..(1574): n is a, c, g, or t
  misc_feature (1779)..(1779): n is a, c, g, or t
  misc_feature (1908)..(1908): n is a, c, g, or t
cggccgccgccgcgcgcacccccgaaccctaacaccctccttcctcccgtcctgcccccaccatggcggccccctacgaccgggaggacggccttcctccggctccgccgcatcacgcgcatgacgcctactaccccaactacgtcccggactccgtcaagaccttcgtcgtccacctctaccgccacatccgcgacaagaacgtctacgagatccaccagatgtacgagggcggcttccagcgcctctccgaccgcctcttccgcgacgcgccctggccctccgccgaggccgtcgccccctactgcgacggcgaccacgtcttcctcctcctctacagggagctctggtaccgccacgcccacgcccgcctctccccgctcaccgccgcccaccgcgccgagtcgtggaccaactactgcgacctcttcagcgtcgtcctgcncggcgtcgtcaacatgcagctccccaaccagtggctctgggacatggtcgacgagttcgtctaccagttccagagcttctgccagtaccgcgccaagctcaagaacaagacggaggacgagctcaaccagctcaagcagttcgacaaggcgtggaatgtgtacggcgtcctcaactacctccaggcgctggttgagaagtccatgatcacgcagatcctcgagagggagaaggagggcctggagcagttcaccgccaccgacggctacgactacgagggcgggagcaacgtgctcaagatgctcggctactacagcatgattgggctgctcaggatacactgcctccttggggattaccacactgggctcaagtgcctcgcgcccattgacctcaaccagcaaggggtctacaccattgtcattgggagccacatctccaccatctatcactatggcttcgcaaaccttatgatgcgcaggtatgttgntgccacacgtgaattcaacaaaattctgctatatatcctcaagtacaagcagtaccaccagaagtcccctcagtatgatcagatactgaagaaaaatgagcagatgtatgcattgttggcaatttgcctgtctttgtgcccacagaacaagcttatagatgaaaatgttagcacccagctgaaagaaaagtataatgacaagatgacaaagatgcagaggtatgatgatgaagcatatgctgcctacgatgaactattctcgtatgcttgccccaagtttattactccatcaccaccagttctggatcagccacttacaaactataaccaggatgcctatcgtcttcagttgaagttattcctctatgaagtaaagcagcagcagttgctttctgggatccggagttatctgaaactatattcaacaataaccattggcaaacttgcccaatacatggaagtggatgaggcaacactaaggtcaatcctgatgacatacaagcacaaaatgcatgcagttgacagtgatggaaagatagtatccagtgcagactttgatttctacattgttgaggatgttattcatattgtggagtccaaacctacaaagagtcatggtgattactttttgagacaaatnttgaagttcgaggaaatgatgggtgaattggagaaagtacagcttgactgagcatggtagttacatgcagggaaatgtcatgtcactgcttcctttttgctaatataggaagaggcatttatggtggctggtattagtgagttatgtttcagccttctgtactccatgtgacttagttgagacccgatcattttgtaattttctnttttcctgaaatctactttgcagctctttcaggctctattagttgaattgtgatatttgtatggtctgctatttgcctggatgggcatatcaacatgcaagaatgttctcgttgttgattgctttgttnttgagaagctatatcttctcctagcttggactaacatccaagttca

SEQ ID NO: 476 - DNA, 1896 bp, Zea mays
agcaagcaagcaaaacccgcatctcctccatcccaccccgcgccgccgccgccgccgcatcccgtcccgaaccctaaccccactccatcatggcggccgcccactacgatcgcgaggacggcctgcctccatcggcgccgccgcacgcggcggcggacgcgtacgaccccaactacgtgccggactccgtcaagaccttcgtggtgcacctgtaccgccacatccgggacaagaacgtgtacgagatccaccagatgtacgagggcggcttccagcgcctctccgaccgcctcttccgcgacgtgttctggccctccgcggaggccgtgtctccctactgcgacggcgaccacgtattcctcctcctctaccgcgagctctggtaccgccacgcccacgcccgcctctccccgctcaccgccgcgcaccgcgccgagtcgtggaccaactactgcgacctctttagcgtcgtcctccacggcgtcgtcaacatgcagctgcctaaccagtggctctgggacatggtcgacgagttcgtctaccaatttcagagcttctgccagtaccgagccaagctcaagaccaagacggaagacgagctcaaccagctcaagcagttcgacaaggcgtggaacgtgtacggggtcctcaactacctgcaagcgttggttgagaagtccatgatcacgcagatcctcgagaaggagaaggagggcctggagcagttcactgccaccgatggctacgactacgagggtggcagcaacgtgctcaaggtgctgggctactacagcatgattggcctcctaaggatacactgtctcctcggggattaccacaccggcctcaagtgcctcacgcccatcgacctcaaccagcaaggggtctacaccattgtcattgggagccacatctcagccatctaccactacggcttcgcaaaccttatgatgcgcaggtatgttgaggccactcgtgaattcaacaagattcttctgtatatcctcaagtacaagcagtaccaccagaattcccctcagtatgatcagatactgaagaaaaatgagcagatgtatgcattgttggcaatttgcctatctttgtgcccacagaacaagctcattgatgaaaatgttagcacccagctgaaagaaaagtataatgacaagatgacaaagatgcagaggtatgatgatgaagcatacgctgcttatgatgagctattctcgtatgcttgccccaagttcattacaccgtcgcctccaattctggaccagccgctaacaaactataaccaggatgcataccgtcttcagttgaagttgtttctctatgaagtaaagcagcaacagttgctttctgggattcggagttatctgaagctatattcaacaataaccattagcaaacttgcccaatatatggaagtggatgaagcaacactaaggtcgatcctgatgacatacaagcacaaaatgcatgcagttgacagtgaaggaaagatagtatcaagtgcagactttgacttctacatcgtcgaggatgtgattcatgttgtggagtccaaacctaccaagcgtcatggtgattactttttgagacaaattttgaagtttgaggaaatgattggtgaactggagaaggtacagcttgactgaaatctgatagcgatcatggagagaaatgtcactgtttcctttttgctctcttttgtactccgttgaaaccccatcttttttttttttgtttccttattgactctgaagcccgttgaaaccggccattattaaccgtgtaccgtgtaatgttacttagccctgtttgtttcggattataatctctctagattatataatccagcgcaaataattcaataggtaaacaaacacatatatt

SEQ ID NO: 477 - DNA, 1916 bp, Zea mays
agccaagagccaggcaagcaaaacaatagggcttcatcccaccgcgcgccaccggaccttgaacggttgaacccccctgcctccccagttccccagccatggcggcggccccctacgaccgggaggacggtctgcagccgtcggcgccgccgcacgcggtggacgcttacgatcccagctacgtgccggactccgtcaagaccttcgtggtgcacctgtaccgccacatccgggacaagaacgtctacgagatccaccagatgtacgagggcggcttccagcgcctctccgaccgcctcttccgcgacgctccctggccctccgcggaggccgtcgcaccctactgcgacggcgatcccgtcttcctcctcctctaccgcgagctctggtaccgccacgcccacgcccgcctctctccgctcactgccgcgcaccgcgccgagtcctggaccaactactgcgacctcttcagagtcgtccttcacggcgtcgtcaacatgcagctgcccaaccagtggctctgggacatggtcgacgagtttgtctaccagttccagagctgctgccaataccgcgccaagctcaagaccaagacggaggacgagctcaaccagctcaagcagttcgacaaggcgtggaacgtgtacggggtcctcaactacctgcaggcgctggtcgagaagtccatgatcacacagatcctcgagagggagaaggagggcctggagcagttcaccgccaccgatggctacgactacgagggcgggagcaacgtgctcaaggtgctcggctactacagcatgattggcctcctcaggatacactgcctccttggggattaccacactggcctcaagtgcctcggtcccatcgacctcaaccagcaaggggtctacagcattgtcatcgggagccacatttccaccatctatcactatggcttcgcaaaccttatgatgcgcaggtatgttgaggccactcgtgaattcaacaagattcttctgtatatcctcaagtacaagcagtatcatcagaagtcccctcagtatgatcagatactgaagaaaaatgagcagatgtatgcactgttggtgatttgcctatctttgtgcccacagaacaagctcattgatgaaaatgttagcacccagctgaaagaaaagtataacgacaagatgacaaagatgcagaggtatgatgatgaagcatacgctgcttatgatgagctattttcgtatgcttgccccaagttcattacaccatcacctccagtgctggaccagccgctaacaaactataaccaggatgcataccgtctacagttgaagctgtttctttatgaagtaaagcagcagcagttgctttctgggatccggagttatctgaagctatattcaacaataaccattagcaaacttgcccaatatatggaagtggatgaagcaacgctaaggtcaatcttgatgacatacaagcacaaaatgcatgcggttgacagtgacggaaagatggtatcgagtgcagactttgacttttacattgttgaggatgttattcatgtcgtggagtccaaacctactaagcgtcatggcgattactttttgagacaaattttgaagttcgaggaaatgatcggtggactggataaagtacagcttgactgaacctggtagcaaatatggagagaaatgccactgctttctttttgctaatataggaatagatgtttatgatggatgtcattagcaagttatgtttgtgccttctgtagcccatgcaaaaacccgtcattttttctctcttttcactggattcgactttgaagcccgttgaggcaattagcagagtcgtgatgttaattttggtcgcccagttgcttgaatagtgatctcatatcctatctgggagtggcatgc

SEQ ID NO: 478 - DNA, 1870 bp, Oryza sativa; identical to SEQ ID NO: 4

SEQ ID NO: 479 - DNA, 2138 bp, Sorghum bicolor
aaagccccccatctcgtcctcctccgacccaccccgcgccgccgcaccccgaaccctaacccctcgcctcgcctcccaccatggcggccgccccctacgaccgcgaggacggcctgccgccgtcggtgccgccgcacgcggccgacgcgtacgaccccaactacgtgccggactccgtgaagacgttcgtggtgcacctgtaccgccacatccgggacaagaacgtgtacgagatccaccagatgtacgagggcggcttccagcgcctctccgaccgcctcttccgcgacgcgccctggccctccgcggaggccgtcgccccctactgcgacggcgaccacgtcttcctcctcctctaccgcgagctctggtaccgccacgcccacgcccgcctctccccgctcaccgccgcgcaccgcgccgagtcatggaccaactactgcgacctcttcagcgtcgtcctccacggcgtcgtcaacatgcagctgcccaaccagtggctctgggacatggtcgacgagttcgtctaccagttccagagcttctgccagtaccgcgccaagctcaagaccaagacggaggacgagctcagccagctcaagcagttcgaaaaggcctggaacgtctacggggtcctcaactacctgaaggcgctggtcgagaagtccatgatcacgcagatcctcgagagggagaaggagggcctggagcagttcaccgccacagatggttacgactacgagggtggcagcaacgtgctcaaagtgctcggctactacagcatgattggcctcctcaggatacactgcctcctcggggattaccacactggcctcaagtgcctcgcgcccatcgacctcaaccagcaaggggtctacaccattgtcattgggagccacatctccaccatctaccactatggcttcgccaaccttatgatgcgcaggtacgttgaggccactcgtgaattcaacaagattcttctgtatatcctcaagtacaagcagtaccatcagaagtcccctcagtatgatcagatactgaagaaaaatgagcaaatgtatgcattgttggcaatttgcctatctttgtgcccacagaacaagctcattgatgaaaatgttagcacccagctgaaagaaaagtataatgacaagatgacaaagatgcagagatatgatgatgaagcatatgctgcttatgatgagctattttcttatgcttgccccaagttcattacaccatcacctccagttctggaccagccactaacaaactataaccaggatgcataccgccttcagttgaagttgtttctctatgaagtaaagcagcagcagttgctttctgggatccggagttatctaaagctatattcaacaataacaattagcaaacttgcccaatatatggaaatggatgaagcaacactaaggtcaatcctgatgacatacaagcacaaaatgcatgcagttgacagtgacgggaagatagtatcgagtgcagactttgacttctacattgttgaggatgttattcatgttgtggagtccaaacctaccaagcgtcatggtgattactttttgagacaaattttgaagtttgaggaaatgattggtgaactggagaaagtacagcttgactgaacctcatagcgatcatggagagaaatgccactgcttcctttttgctaatataggaagaagtgtttatgatggatgtcattagcaagttatgtttgtgccttttgtactccatgcgacttagttggaaaccctttttttctttttgctgaaatcgactttgaaagaccgttgaggccattagctgagtcgtgatacttatttgggttgcccagttgcctgaatatttcatatcccatcacggagtggcatgcaaattgagctgtgccagcatgccctataggctatagctaacaaggatcggtgccaaggtgaacaaatttgtaccaatgggaatttagatgcgtctctcgtcagcacaacattattgactctcatctacttagggggtgtttagttctgcttttattctaaaattttttgggttttggttcatcattttgtataatggaactaaacactatgcaatttttttggaaaaataatggttattct

SEQ ID NO: 480 - DNA, 1852 bp, Panicum virgatum
tacgaccgggaggacggcctggcgccggcgcccccgccgcacgcggccgacgcctacgaccccaactacgtcccggactccgtcaagaccttcgtcgtgcacctctaccgccacatccgcgacaagaacgtctacgagatccaccagatgtacgagggcggcttccagcgcctctccgaccgcctcttccgcgacgcgccctggccctcggccgaggccgtcgccccctactgcgacggcgaccacgtcttcctcctcctctacagggagctctggtaccgccacgcccacgcgcgcctctccccgctcacagccgcccaccgcgccgagtcctgggccaactactgcgacctcttcagcgtcgtgctccacggcgtcgtcaacatgcagctgcccaaccagtggctctgggacatggtcgacgagttcgtctaccagttccagagcttctgccagtaccgcgccaagctcaagaacaagacggaggacgagctgcaccagctcaagcagttcgacaaggcgtggaatgtctatggtgtcctcaactacctccaggcgctggtcgagaagtccatgatcacgcagatcctcgagagggagaaggagggcctcgagcagttcactgccaccgatggctatgactacgagggagggagcaatgtgctcaaggtgctcggctactacagcatgattggcctgctcaggatacactgcctcctcggggattaccacactggcctcaagtgcctcgcacccattgacctcaaccagcaaggggtctacaccatcgtcattgggagccacatctccaccatatatcactatggcttcgcgaaccttatgatgcgcaggtatgttgatgccacacgtgaattcaacaaaattctgctatatatcctcaagtacaagcagtaccaccagaagtctcctcagtatgatcagatactgaagaaaaatgagcagatgtatgcattgttggcaatttgcctgtctttgtgcccacagaacaagcttatagatgaaaatgttagcacccagctgaaagaaaagtataatgacaagatgacaaagatgcagaggtatgatgatgaagcatatgctgcctatgatgaattattctcgtatgcttgccccaagttcattactccatcaccaccagttctggatcagccacttacaaactataaccaggatgcatatcgtcttcagttgaagctattcctctatgaagtaaagcagcagcagttgctctctgggatacggagttatctgaaactatattcaacaataaccattggtaaacttgcccaatacatggaagtggatgaggcaacactaaggtcaatcctgatgacatacaagcacaaaatgcatgcagtggacagtgatggaaagatagtatccagtgcagactttgatttctatattgttgaggatgttattcatgttgtggagtccaaacctacaaagagtcacggtgattactttttgagacaaattttgaagtttgaggaaatgattggtgaactggagaaagtacagtttgactgagctagtgatcatggagggaaatgccatttcttccttttttgctaatataggaaaaggcgtttatgatggctggtattagcgagttatgtttgtgccttttgtactccttgtgacttagttgagacctggtcattttgtactttttttttttgctgaaatctactttgcatctcgtccaggctctattagttgaattgtgatacctatatgggtcttcctttgcctggatgtgcatatcaacaggttcaatttatgtttggcctgcatctgtttgcaaaatagaccctatgctgaaatcaac

SEQ ID NO: 481 - DNA, 1892 bp, Triticum aestivum
gcaacaaagcgctcccctctgaagcctcctcccacccccctcacgccgccgccgcaaccccgaaaccctaaccaaaccccccagcgccacaccatggcgtccgcctacgaccgggaggacggcctcgcgccgccgcagccgcacggcggcggccccgccgacgcctacgatcccaactacgtgcccgactcggtgaagaccttcgtggtgcacctgtaccgccacatccgcgacaagaacgtctacgagatccaccagatgtacgagggcggcttccagcgcctctccgaccgcctcttccgcgacacgccgtggccgtcggccgaggccgtggcgccctactgcgacggcgaccacgtcttcctcctcctctaccgcgagctctggtaccgccacgcctacgcgcgcctctcccccctcaccgccagccaccgctccgagtcctggaacaactactgcgacctcttcagcgtcgtcctccacggcgtcgtcaacatgcagctgcctaaccagtggctgtgggacatggtggacgagttcgtctaccagttccagagcttctgccagtaccgcgccaagctcaagaacaagacggaagacgagctccagcagctaaagcagtttgacaaggcatggaatgtctatggtgttctcaattacctgcaagcactcgtcgagaagtccatgatcgcacagattctggagagggagaaagaggggctggagtcgtttactgccaccgacgggtatgactaccagggtgggagcaatgtgctcaaggtcctgggttactacagcatgattgggcttctcaggatacactgccttcttggtgattaccacactggcctcaagtgcttggcaccgatcaaccttaaccagcagggggtctacaccattgtgattgggagtcacatctcgacaatctatcattatggatttgcaaaccttatgatgcgcaggtatgtcgatgctaccaaggaattcaacaaaattctgctttacattataaagtataagcagtaccatcagaaatcccctcagtatgaccagattctgaagaaaaatgagcagatgtatgcgctgctggcaatttgcctatctctgtgtccgcagaacaaactcatagatgaaaatgttagcgcccagctgaaagaaaagtacaatgacaaaatgacaaagatgcagaggtttgatgatgaagcatatgctgcctacgatgagctattttcgtatgcctgccccaagtttattacgccatcacctccagttctggaccagccacttacaaattataaccaggacgcctatcggcttcaattgaagctgttcctgtatgaagtgaagcagcaacagctgctttctgggatccggagctatctaaagttatactcagcaataactatcaccaaacttgcccagtatatggaaatggatgaggcaacacttaggtctatccttatgacgtacaagcacaaaatgcatgcagttgacagtaatgggaaaattgtatccagtgcagactttgatttctacattaatgaggatgttattcatgtcgtggagtccaagtcgaccaagcgccatggtgactactttttgagacagattttaaagtttgaagaaaccattgctgaattggacaaggtacagcttgactgagcatggtagagatcatggaggagagaaacgtcccaggatcctgttttccttttcttttttcctattgtgagaggcagttgtgatggctactgttagcagagcattagttgtgccttctggtacactttttgactcagtgaagcattggcaattcactgtattatcccgtttctagttcctgtttgctatttgacgagtaatccgtcggttacgaattgagaacttgagat

SEQ ID NO: 482 - DNA, 1453 bp, Hordeum vulgare
cccacgcgtccgttccaatccttttccctctctctctctctctctcttccctcgtccgccatataaacttgtccgggaaaggcagccggggagagaggagagaaaggaaggaaagggagccgaggaaagctctccccccctcccgaatttccatcgttctcccttccgctcctcgcctcgcccggaccccggccggattcccgcaggaggagaaggaggaggaggaggaggggatggggagggaggaccggttcccgctctgggaggccgcgctcggcgccggggtcgccgccgtcttcgccgcgggcctcgtcggggtctacctctccatgccggactccgactacagcttcctcaagttgccccgcaacctccacgaactacaaatcctcactggccatcttgagaactataccagtgactacaccgtacaggtgttgataggttactgtgctgtatacatattcatgcagaccttcatgatcccagggacaatattcatgtcattgcttgctggtgctctattcgggcaactccggggcgtggctttggttgtctttgctgcctccgctggtgcttcttcatgctatttcctgtcgaaactgattggaaaaccgctggtgttcgtgctgtggccagacaaactcacgtttttccagaagcaggttgccaaaagaagagaaaagctgttgaattacatgcttttcctgagggtcaccccaacattgccaaataccttcatcaacttagcatctcccattgttgatgtgcccttccataccttcttattggcaactcttatcggtctcatcccagcagcctacgtgaccgtgagggctggcattgctctgggagagctgacatcgctcagcgacctgtacgacacccagtcagtagctctgctgttcttgatcggcgtcgtctcggtcacaccagcattgctgagcaaggacgaggctcaagaaaaggcaccagaaatcgcagcaggcgcctcatgaacaccgaagaggagccacctagccacctgtacataccaaggcacagcatgcggcggcttcattggatttgggcctacaggccttgtgaggcggatgacacatggtttgctagttcacatgacaacacagcaccacggcgggaccttggaccctgagtccgcccatcacccgcctgccggagatctgcgtcgccatgggaacactgtttcatttcatggtcaccccccacattgtttgttacgaatgaatctgggaagcacaatgcccatccacaggcaagttgcttcggatgtgtagacaagtagtgtgtgcgcgccgttcgtcagcctgcgatgctgtttactagatggaactggcagctagtcaaaatccttgtatatatattgaccagattcattcaatccatattcagtgattcaatgacaatttgtctgctgctgtgccgttccccttct

SEQ ID NO: 483 - DNA, 1347 bp, Brachypodium distachyon
ggagaagggaaaggagagggaacacagctctcctcccggatttcatctctctctctctctctctctctctcttcttcttctcctcctctcgcccggcggaccccggatttttgcaggggtggaagaggaggaggaggaggaggggatggggagggaggataagttcccggtctgggaggcctcgctgggcgccggagtcgccgccgtcttcgccgccgggctcgtcggagtctacctctccatgccggactccgactacagcttcctcaagttgccccgcaacctcgaggaactccaaatcctcactggccacctcgagaattataccagtgactacaccgtacaggtgttggtgggttactgtgctgtgtacattttcatgcagactttcatgatcccagggactatattcatgtcattgcttgctggtgctctattcgggcaactccggggcgtggctctggttgtctttgctgcctctgctggtgcttcttcgtgctatttcctgtcgaagctaattggaaagccgcttgtgttctcactgtggccagacaagctcacatttttccagaagcaggtttctaaaagaagagaaaagctgttgaattacattcttttcctgagggtcaccccaacattgccgaataccttcatcaacttagcttcgcccatagttgacgtgccctaccataccttcttattgggaactctaatcggtctcatcccagctgcctatgtgaccgtgagggctgggattgctctaggagagctaacatcgctcagtgacctttatgacacccagtcaatggcgctgctgttcttgatcggtgttgtctcagtcacaccagcattgttgggcaaggacgaggcgccagagaaaacaccagaaattgcagtaggcacttcatgatcaccagagacctcacctcacctcacctgtatatagccaagacacagaatgcggcggcttcatctgattgagcctaaaagctttgtcaggctcgacgaccacatggtttgcaagtttacatgactacacagcagaaccttggacccaagtttgtccattgcccgcccaccggagacctgtgttgccataagtagattgtttcatggtcactcaccatattgttatgaatgaaatctgggaaagcacgatgcccatcaggcaagctgcttcgatatgtagacaagtagtgtgtgctgtaatgctgtttagacgtgaaagacagctagtcaaatccttgtatatatattgaccagattcattcactccatatgctgtggttcaaagactatttgtcttgtgatgtgtggttccgcttcctcgtgaagctgaattttaac

SEQ ID NO: 484 - DNA, 1290 bp, Cenchrus ciliaris
ggaagggaaagggagacaggagagggagccaaagaaagctctccttcctcctcctcctctcggattccatctctctagtttcctctcttcctcaaagggcccggtccccggatttttgaagggggaagagcaggaggggatggggaaggatgagaggttcccggtgtgggaggccgcgctcggcgccggggtcgccgccgccttcgccgccgggctcgtcggagtctacctttccatgccggactccgactacagcttcctcaagttgccgcgcaacctcgaggaactccaaatcctcacaggccatcttgagaactatactagtgactacaccctacaggtgttggtaggttattgcgccgtgtacattttttttttgacccccccccccccggggacaatattcatgtaaaaaaaaagggggagctctatttgggcaactacggggcgtggccctggtggtctttgctgccactgctggtgcttcttcgtgctatttcctctcgaagatgattgggaagccactggtcttctccctgtggccagataagctcaacttcttccagaagcaggttgctaaaagacgagagaagctgttgaattacatgcttttcctcagggtcaccccaacattgccaaataccttcatcaacttagcttcaccaatagtagatgtcccctatcatacattcttactgggaaccctcattggtctcatcccagctgcttatgtgactgtgagggctggaattgctcttggagagttaacttcactgagtgacctttatgacacccagtcaatagcgctgctattcctgattggtgttgtttcagtcaccccagcactgttgggcaaggaccaggcacaagaaaaaccatcggaaatggtggttggcgcttcatgatcgccaaagcataacgcggcgtgcacttcacctgtatatatcagcattcagaatgtagtggcttaattagttcggatcgacaggcccttgtggccggatgatagatggttcgcatggctgcgcggcttggcgggagacctcagcccgaagccctgccattgcccacctacagagaggaacctgtgttgccatcatcagaaacattatctggtggccactcatcacatcatgaatgaatgaacctggaaagcagggtgcccgttggacgagctgctctaatgttaacgagcagttctgttcagatgggaaaatcattgtagttcaatccttgtatatataaacactgaccagattcattcaatccatattcagtggttcaaagata

SEQ ID NO: 485 - DNA, 823 bp, Festuca arundinacea
ggcacgaggaagaaagctctcccaaccccctcccgaaatttcttcttccgctcctcgccggtaccccggattctcgtagcggggcagagaggaagaggaggaggaggggatggggagggaggacaggttcccggtgtgggaggccgcgctcggcgccggggtcgccgccgtcttcgtcgcggggctcgtcggggtctacctctccatgccggactccgagtacagcttcctcaagttgccccacaacctccaggagctccaaatcctcactggccatcttgagaactataccagtgactacaccgtgcaggtgttggtaggttactgtgctgtgtacatcttcatgcagaccttcatgatcccagggacgatattcatgtcactgcttgctggcgctctattcgggcaactctggggggtggctctggtcgtctttgccgcctctgctggtgcttcttcatgctatttcctgtcaaagatgatcgggaagccactggtgttctcgctgtggccagacaagctcacatttttccagaagcaggttgcgagaagaagacaaaagctgttgaattacatgcttttcctgagggtcaccccgacattgccaaataccttcatcaacttagcttcgcccattgttgatgtgccctaccataccttcttactggcaactctaatcggtctcatcccagctgcctacgtgaccgtgagggccgggattgctctaggagagttaacatcgctcagtgacctctacgacacccagtcggtagcgctgctgttcttgatcgggattgtctcggtcacaccagcgctgctgggc

SEQ ID NO: 486 - DNA, 1400 bp, Leymus cinereus x Leymus triticoides
  misc_feature (5)..(7): n is a, c, g, or t
  misc_feature (39)..(39): n is a, c, g, or t
  misc_feature (74)..(74): n is a, c, g, or t
  misc_feature (1255)..(1255): n is a, c, g, or t
  misc_feature (1262)..(1265): n is a, c, g, or t
gaagnnngggagccgaagaaagctctcccccctcccgantttttatctttctcccttctgctcctcgcccggancccgtccggattctcgcaggagaggaggaggaggaggaggggatggggagggaggacaggttcccgctgtgggaggccgcgctcggcgccggggtcgccgccgtcttcgccgcgggcctcgtcggggtctacctctccatgccggactccgactacagcttcctcaagttgccccgcaacctccacgaactccaaatcctcactgtccatcttgagaactataccagtgactacaccgtacaggtgttgataggttactgtgctgtgtacattttcatgcagaccttcatgatcccagggacaatattcatgtcattgcttgctggtgctctattcgggcaactgcggggtgtggctctggttgtttttgctgcctctgctggtgcttcttcatgctatttcctgtcgaagctgattggaaaaccgctggtgttcgtgctgtggccagacaagctcacatttttccaaaagcaggttgccaaaagaagagaaaagctgttgaattacatgcttttcctgagggtcaccccaacattgccaaataccttcatcaacttagcatcgccaattgttgatgtgccctaccataccttcttattggcaactcttattggtctcatcccagcagcctacgtgactgtgagggctgggattgctctaggagagttaacatcactcagcgacctgtacgacacccagtcagtagctctgctgttcttgatcggcgttgtctcggtcacaccagcattgctgagcaaggacgaggcgcaagaaaaggcaccagaaattgcagcaggcgcctcatgaacaccgaagaggagtcacctagccacctgtacataccaaggcacagcatgcggcggcttcattggatttgggcctacaggccttgtgaggtggatgacacatggtttgcgagttcacatgacgactacacagcagcgcggcgggaccttggaccccaggtccgcccatcacccgcctaccggagatctgcgtcgccgtgagaacactgtttcatttcatggtcatcccccacaatgtttgttatgaatgaatctgggaagcacaatgcccatccacaggcaagatgcttcggatgtgtagacaagtagtgtgtgtgccgttcgtcagcctgtgatgctgcttattagatggaacaggcagctagtccaaatccntgtatannnnttgaccagattcattcaatccatattcagtggttcaatgacaatttgtctttcgccgtgccgttccccttcttatgtgtagctgaatttttctgagctcgggattagaaggacacttttggatttttctttctta

SEQ ID NO: 487 - DNA, 1475 bp, Zea mays
attccagctctccccctcggcccctcttctctccctccctccctccgtccccgcattaaactcggcgaacgggccaagaaaagcaaaccgagggaggagaaaggcaaggaaagtgggaaggtaggagagagagggagacagggaaagctctcttcctcctcctcctcctctcgaattccgtctcttgtccctgtcgtcctcgcccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccatcttgagaactatactagtgactacaccctacaggtgttggtaggttattgcgctgtgtacatcttcatgcagaccttcatgatcccagggacaatattcatgtcactgcttgctggtgctctatttgggcaactgcgtggccttgcactggtggtctttgctgccactgcaggtgcttcttcgtgctatttcctgtcaaagatgattgggaagccactggtgttcacactgtggccagataagctcagcttcttccagagacaggttgctaaaagaagagagaagttgttgaattacatgcttttcctcagggtgaccccaacattgccaaataccttcatcaacttagcttcacccatagtagatgtcccctaccatatattcttactgggaactctcattggtcttatcccagctgcttatgtcactgtcagggctggaattgctcttggagagttaacttcgctgagtgacctttacgacacccagtcgatagcactgctattcctgatcggtgttgtttcagtcacaccagcattgctgggcaaggatgaggcacaagagaaaccaccagaaatggcggtaggcgcgtcatgatcaccaaagcacctagcggtgtccacgtcacctgtatatatgtcaacatccagcatgcagtggcttcattagttcggatcaacgggcccttgtggctggatgataaaaacggttcgcatggccacacagcttggcgggacctcggcctaaactccctccactgctggcctagagaggcgcctgtgttgccatcatcagaacatgattcggtagccattcaccacattattaatgaatgaacctgggaagcagaattgcctgtagacgagctgctctgatgtgtaaacgagtagcgctgttcggataggacaggcatttagtccaatccctgtatatattaaccagattcattcaatccatattcagtggttcaaagataatgccctgttcagctgctgtgttcttgaatgttttgctctatttcccttctgtgcctgattgactatggcctaccggttc

SEQ ID NO: 488 - DNA, 1287 bp, Zea mays
cgagaaagggagggaagtgtgaaggtaggagagagagagagggagccaagggaagctctcttctttcttcctcctcctcgtcctctcgaattccgtctcttgtctctgtcctcctcgctcggcttccccggttcttgagaggggaaataggaggcggagccgaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgcttgctggtgctctgtttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgctaaaagaagagagaagctcttgaattacatgcttttcctcagggtgaccccaacattgccaaataccttcatcaacttggcttcaccgatagtagatgtcccctaccacatattcttactgggaactctcattggccttatcccagcttcttatgtgactgtcagggctggaatcgctcttggagaattaacttcgctaagcgacctttacgacacccagtcgatagcgctgctattcctgatcggtgttgtttcagtcacaccagcattgttgggcaaggacgaggcacaagaaaaaccatcagaaatggctgtaggcgcgtcgtgatcaccaaagcaccgagcacctgtacatatcaacatgcagccatgcagtggcttcattagttcagatcgacgggcccgtgtggctggatgacaaaaacggttcgcatggctactacacagcttggataggccattcagcacattatgattatgaacgattgaatgaatctgggaagcagaatgcccgttccacaagctgctctgatgtgtaaacgagtagtgctgttcggataggcctggcatttagtctaatccctgtttatattgaccagattcattcaatccatattcagtggttcaaagataatgccctgtccagctgctgtgttcctcaatgtctttctccatttct

SEQ ID NO: 489 - DNA, 1306 bp, Oryza sativa
tgtgcctcctccgttttcctcttcttcccttctgcagctctcctcttcttcttcctcccaaacggccagcggcgcgcagcgtcacagattttacaggggaaagagaggaggagatggggagggaggagaggttcccggtgtgggaggcggcactgctcgccggcgtcgcggccgcctttgccacgggtctcgtcggcgtctacctctccatgcctcattcggactacagcttcctcaagctgcccaagaacctccaggagctccaaatcctcacggatcatctcgaggactacacgagcgactacaccgtgcaggtgctggtgggctattgtgccgtgtacatcttcatgcagacgttcatgatcccaggaaccatattcatgtccctccttgccggagcactctttggccagcttggtggtgttgcccttgtggtctttgccgccacggctggagcttcttcatgctacttcctgtctaagctgattgggaaaccgttggtcttctcattgtggccggacaaacttgggttctttcagaagcaggttgcaaaaaggagagagaagctgttgaattacatgcttttccttagagtaactccaacattgcccaatactttcatcaatttagcgtcgccgatagtggatgtgccctaccatattttcttcctggcaacctttattggactaatcccagctgcctatgtgactgtcagggctggaatagctttgggagacttgagctcattgagtgacctatatgataaacaatcaatagcactgttgttcttgattggggttgtttcggtgacaccgacattgttgggcaagaacgagaagcaacaaggcaaagggccagaaatggtagctagcagtagctgatcacttgcacgcgaactccttctcacctccccttctgtgtacatatgaagatcctgcatttggttgcttccatggcctttgtttggatcggtgcaacttatggccggccaaagggcaacagaacatggcaagggcccctctttctttctccacttgtggaaccctttgtgcatggtgctgcgaaagggacacctcactgtcacaacattatgattctggggaacaagatgggccaccagagctaaaatgacccatttgttctgtttaacatcttgtttagatcgaaggaacagctgatcttatcatcattgtatatgcactgctaaccagattcagtttttcatggaaccttgtcttagtgatctgtgaatctgtccatgaaatggtctgtttgggcgcggaagtgaacagccaaattgcatgtc

SEQ ID NO: 490 - DNA, 1301 bp, Sorghum bicolor
agactacggcggtctctttttttcttgtcccctcccctcttcttttcccccactctccctctcctgtccgtcctctagcctcctagctcgttcgcccccgcaagctcgcgacctcgcccagcggccaaaccacgctagagtttgccgttggaagaggggaggaggacgagatggcgagggaggacgggttcccggtgtgggaggcggcgctgctcgccgccgtggccgccgtcttcgctgcggggctggccggcgtctacgtctccatgcctcgctccgactacagcttcctcaagctgccccgcaacctccaggagctccaagtcctcactgtccatctggagggctacaccagtgattacaccatccaggtgctggtgggatactgtgccgtgtacatcttcatgcagacgttcatgatcccagggaccattttcatgtccctgcttgctggggccctctttgggcagctcggtggtctagccctggtgatctttgctgccactgccggtgcttcttcctgttatttcctgtccaagctggtagggaaaccactggtcttctcgttgtggccagacaagctcatgttcttccaaaagcaggttgcaaaaagaagagagaagctgctgaattacatgcttttcctgagagtcaccccgacactgcccaatactttcatcaatttttcttcacctatagtgggtgtgccataccatactttcttcttggcgacagccattggcctcatcccagcagcctatgtgactgtcagggctggaattgctttgagcgacctgagatcgttgaatgacctgtacgatccacagtcgatagcagtgctgttcctgatcgggcttgtttcggtgatgccgacattgctgggcaagaacgagacgccaagcagagcaccagacatggcagctagcaccaactgatcacttacacgccaccccagctctcctctcctgtatgtacatacaaacgaccagcgtttggtggtggctccgagactgtggatcaagtagaacctgttgccgaccacgaaaatggcgagggcccccagtctgtctccacttttgtgctgatttcgttgaagggaccggatatctctcatgagcacctgtcatcgtaaatcttgctggcaaaacgggctgggaacagacctctttctgttgctgtattttagcttcacattgtttagatgtaaggtttcactgattgtatgtatcttgcacacgttaaccagattcaatcaataaagccgattcagtgattcattcatcaacgttttctgtgctgtc

SEQ ID NO: 491 - DNA, 1422 bp, Sorghum bicolor
ggccaagaaaagcaaccggagggaggagaaaggcaagggaagtgggaaggtaggagagagagagggagccagggaaagctctcttctttcttcctcctcctctcgaattccgtctctggtctctgtcctcctcgcccggtttcccccgttttttgagaggggaaagaggaggcggaggcggaggagggagggatggggcgggacgagaggttcccggtgtgggaggccgcgctcggcgccggggtcgccgccgccttcgccgctgggctcgtcggggtctacctttccatgccggactccgactacagcttcctcaagttgccacgtaatctcgaggaactccaaatcctcactggccatcttgagaactatactagtgattacaccctacaggtgttagtaggttattgcgctgtgtacatcttcatgcagaccttcatgatcccagggacaatattcatgtctctgcttgctggtgctctatttgggcaactccggggcttggccctggtggtctttgctgccactgctggtgcttcttcgtgctatttcctgtcgaagatgattgggaagccactggtgttcacactgtggccagataagctcagcttcttccagagacaggttgctaaaagaagagagaagctgttgaattacatacttttcctcagggtgaccccaacgttgccaaatactttcatcaacttagcttcacccatagtagatgtcccctaccatacattcttactgggaactctcattggtcttatcccagctgcttatgtgactgtcagggctggaattgctctaggagagttaacttcgctgagtgacctttacgacacccagtctatagcactgctattcctgatcggtgttgtttcagtcacaccagcattgttgggcaaggacgaggcacaagaaaaaccatcagaaatggtggtaggcgcgtcatgatcaccaaagcaccgagaggtgtccacctcacctgtatatatcaacatccagcatgcagtggcttcattagttcggatccacaggcccttgtggctggatgacagaactggttggcatggctacacagcttggcgggtcctcggcctaaactccgtcgcaccgccggcctacagaggcacctgtgtcaccatcatcagaacatgattcggtggccattcaccacattatgaatgaatgaatgaacctgggaagcagaatgcccgttagacaagctgctcttatgtgtaaacgagtagtgctgttcggatagaacaggcatttagtccaatccctgtatatatagaccagattcattcaatccatattcagtggttcaaagatccctgtccagctgctgtgctcctgaatgccttgctccatttctagtttcccttctgtgcctgattgaccatggcctactggttc

SEQ ID NO: 492 - DNA, 1336 bp, Saccharum officinarum
  misc_feature (1031)..(1031): n is a, c, g, or t
  misc_feature (1237)..(1237): n is a, c, g, or t
  misc_feature (1308)..(1308): n is a, c, g, or t
aagggaattgggaaggtaggagagagagaggagccagggaaagctctcttctttcttcttcctcttcctcctctcgaaattccgtctcttgtctctctgttctcctcgcccggttcccccggtttttgagaggggaaaagaggaggcggaggagaggagggatggggcgggacgagaggttcccggtgtgggaggccgcgctcggcgccggggtcgccgccgccttcgccgctgggctcgtcggggtctacctttccatgccggactccgactacagctttctcaagttgccacgtaatctcgaggaactccaaatcctaactggccatcttgagaactatactagtgactacaccctacaggtgttggtaggttattgcgctgtgtacatcttcatgcagaccttcatgatcccagggacaatattcatgtctctgcttgctggtgctctatttgggcaactccggggcttggccctggtggtctttgctgctactgctggtgcttcttcgtgctatttcctgtcgaagatgattgggaagccactggtgttcacactgtggccagataagctcagcttcttccagagacaggttgctaaaagaagagagaagctgttgaattacatgcttttcctcagggtgaccccaacattgccaaataccttcatcaacttagcttcacccatagtagatgtcccctaccatacattcttactgggaactctcattggtcttatcccagctgcttatgtgactgtcagagctggaattgctcttggagagttaacttcgctgagtgacctttacgacacccagtcgatagcactgctattcctgatcggtgttgtttcagtcacaccagcattgttgggcaaggacgaggcacaagaaaaaccatcagaaatggcggtaggcgcgtcatgatcaccaaagcaccgagaggtgtccacctcacctgtatatatcaacatccagcatgcagtggcttcattagttcggatcgacaggcccttgtggctggatgacaanaatggttggcatggctacatagcttggcgggtccttggcttaaactccgtccaccgccggcctacataggcacctgtgtcgccttcatcagaacatgattcggtggctattcaccacattatgaatgaatgaatgaatgaacctgggaagacaagctgctctgatgtgtaaacgagtagtgctgttcggataggacaggcatttantccaatccctgtatatattgaccagattcattcaatccatattcagtggttcaaagataatgccctgtccntaaaaaatatatatttaaatatataacg

SEQ ID NO: 493 - DNA, 1328 bp, Panicum virgatum
gaggagagaagaaagaaagggtagtgggaagggaggagagaggaggagccagggaaagctctcttcttcttcctcctcctcctcttcctctccaattccgtcccttgcctctgtcctcctcgcccggtttccccggttttttggaaggggaaagaggaggaggaaggatggggagggaggagaggttcccggtgtgggaggccgcgctcggcgcaggggtcgccgccgccttcgccgccgggctcgtcggagtctacctttccatgccggactccgactacagcttcctcaagttgccgcgcaacctcgaggaactccaaatcctcactggccatcttgagaactatactagtgactacaccctacaggtgttggtaggttattgcgctgtgtacatcttcatgcagaccttcatgattccagggacaatattcatgtcactgcttgccggtgctctatttgggcaactccggggcgtggccctggtggtctttgctgccactgctggtgcttcttcttgctatttcctctcgaagatgattgggaagccactggtgttctcactgtggccagataagctcagtttcttccagaaacaggttgctaaaagacgagagaagctgttgaattacatgcttttcctcagggtcaccccaacattgccaaataccttcatcaacttagcttcaccaatagtagatgtcccatatcatacattcctattgggaactctcattggtctcatcccagctgcttacgtgactgtgagagctggaattgctctaggagagttaacttcgctgagtgacctttatgacacccagtcaatagcgcttctattcctgatcggtgttgtttcagtcacgcctgcactgttgggcaaggacgaggcacaagaaaaaccatcggaaatggcagtaggcgcttcatgatcaccaaagcatcacacagtgtccacctcacctgtatatgtcagcatccagcaagtagtggctccattagttcgcatggctgcgcagcttggcgggaccccagcccaaagctcggccatcacccgcctacggaggaacctgtgttgccaccatcagaaacattatatggtggccattcaccacatcagaatgaatgaacctggaaagcagaatgcccgttagacaagctgctccaatgtgtaaacgagcagttttgctctgttcagatgggatgggacaatcttcgtagttcgatccttgtatattcgtagttcgatccttgtatatatattgaccagattcattcaatccatattcagtggttcaaagatgttgctttgtccagctgttgtgttc

SEQ ID NO: 494 - DNA, 1303 bp, Panicum virgatum
ggagggaggagaggagaaagaaagggaagtgggaagggaggagagagggggagccagagaaagctctcttcttcttcctcctctcgaattccgtcccttgcctctgtcctcctcgcccggtttccccggttttttggaaggggaaagaggaggaagggatggggagggaggagaggttcccggtgtgggaggccgcgctcggcgccggggtcgccgccgccttcgccgccgggctcgccggagtctacctttccatgccggactccgactacagcttcctcaagttgccgcgcaacctcgaggaactccaaatcctcactggctatcttgagaactatactagtgactacaccctacaggtgttggtaggttattgcgctgtgtacatcttcatgcagaccttcatgatcccagggacaatattcatgtcactgcttgcgggtgctctatttgggcaactccggggcgtggccctggtggtctttgctgccactgctggtgcttcttcatgctatttcctctcgaagatgattgggaagccactggtgttctcactgtggccagataagctcagtttcttccagaagcaggttgctaaaagacgagagaagctgttgaattacatgctttttctcagggtcaccccaacattgccaaataccttcatcaacttagcttcacccatagtagatgtcccctatcatacattcctactgggaactctcattggcctcatcccagctgcttacgtgactgtgagggctggaattgctcttggagagttgacttcgctgagtgacctttatgacacccagtcaatagcgctgctattcctgatcggtgttgtttcagtcacgcctgcactgttgggcaaggacgaggcgcaagaaaaaccatcggaaatggcagtaggcgcttcatgattatcaaagcattacacagtgtcgaccacacctgtatatatcagcatccagcatgtagtggctccattagttcggatcggcaggccctagcagccggatgatagatggttcgcatggctgcgcagcttggcgggaccacagcccgaagctcggccatcacccgcctacagaggaacctgtgctgcaaccattagaaacattatatggtggccattcaccacatcagaatgaatgaacctggaaagcagaatgcccgttagacaagctgctctgatgtgtaaacgagcagtgttgctctgttcagatgggacaagctttgtagttcaatccttgtgtatatattgaccagattcattcaatccatattcagtggttcgaag

SEQ ID NO: 495 - DNA, 1402 bp, Triticum aestivum
  misc_feature (1396)..(1396): n is a, c, g, or t
ccacgcgtccgggaaagggagccggcgagagaggagagaaaggaaggaaagggagccgaggaaagctctccccccctccccaaatttcatcttcgttcttccgctcctctcctcgcctcgcctcgcctcgcccggaccccggccggattctcgtcaaggaggaggaggaggaggagggggaggggatggggagggaggacaggttcccggtctgggaggccgcgctcggcgccggggtcgccgccgtcttcgccgcgggcctcgtcggggtctacctctccatgccggactccgactacagcttcctcaagttgccccgcaacctccacgaactccaaatcctcactggccatcttgagaactataccagtgactacaccgtacaggtgttgataggttactgtgctgtgtacattttcatgcagaccttcatgatcccagggacaatattcatgtcattgcttgctggtgctctgttcgggcaactccggggtgtggctctggttgtctttgctgcctctgctggtgcttcttcatgctttttcctgtcgaagatgattggaaaaccgctggtgttcgtgctgtggccagacaagctcacattcttccagaagcaggtcgccaaaagaagagaaaagctgttgaattacatgcttttcctcagggtcaccccaacattgccaaatacattcatcaacttggcatcgcccattgttgatgtgcccttccataccttcttattggcaactcttatcggtctcatcccagcagcctacgtgaccgtgagggctgggattgctctgggagagctaacatcgctcagcgacctgtatgacacccagtcagtagccctgcttttcttgatcggcgtggtctcggtcacaccagcattgttgagcaaggacgaggcgcaagacacggcaccagaaatcgcagcaggcgcctcatgaacaccgaagaggagtcacctagcccacctgtacataccaaggcacagcatgcggcggcttcattggatttgggccatacaggccttgtgaggtggatgacacatggtctgcgagttcacacgacgacacagcagcacggcgggaccttggaccccaagtctgcccgtcacccgcctgctggagatctgcgtcgccacgagaacactatttcatttcatggtcacccccacattgtttgttatgaatgaatctgggaagcacaatgcccatccacaggcaagatgcttcggatgtgtagacaagtagcgtgtgtgccgttcgtcagcccgcgatgctgtttatttagatggaactggcagctagtccaaatccttgtgtatatattgaccagattcattcaatccatattcagtggttcaatgacaatttgtctgttgctgcgccgntcccct

SEQ ID NO: 496 - DNA, 1310 bp, Triticum aestivum
aaggaaagggagccgaagaaagctctccccccctccccaaatttcaccttatttcttctgcccctctcctcgcccggaccccggccggattcccccgcaggaggaggaggaggaggaggggatggggagggaggacaggttcccggtctgggaggccgcgctcggcgccggggtcgccgccgtcttcgccgcgggcctcgtcggggtctacctctccatgccggactccgactacagcttcctcaagctgccccgcaacctccacgaactccaaatcctcactggccatcttgagaactataccagtgactacaccgtacaggtgttgataggttactgtgctgtgtacattttcatgcagaccttcatgatcccagggacaatattcatgtcattgcttgctggtgctctattcgggcaactccggggtgtggctctggttgtctttgctgcctcagctggtgcttcttcatgctttttcctgtcgaagctgattggaaaaccactggtgttcgtgctgtggccagacaagctcacatttttccagaagcaggtagccaaaagaagagaaaagctgttgaattacatgcttttcctcagggtcaccccaacattgccaaataccttcatcaacttggcatcgcccattgttgatgtgcccttccataccttcttattggcaactcttatcggtctcatcccagcagcctacgtgactgtgagggctgggattgctctgggagagctaacatcgctcagcgacctgtacgatacccagtcagtagctctgctgttcttgattggggtggtctcggtcacaccagcattgctgagcaaggacgaggcgcaagaaaaggcaccagaagttgcagcaggcgcctcatgaacaccgaagaggagtcacctagcccacctgtacataccaaggcacagcatgcggcggcttcattggatttgggcctacaggccttgtgaggtggataacacatggtttgcgagttcacacgacgacacagcagcatggcaggaccttggaccccaagtctgcccatcacccgcctgctgaagatctgtgttgccatgagaacactgtttcatttcatggtcaccccccacattgtttgttatgaatgaatctgggaagcacaatgcccgtccacaggcaagatgcttcggatgtgtagacaagtagtgtgtgtgccgttcgtcagcctgcgatgctgtttattagatggaacaggcagctagtccaaatccttgtatatatattgaccagattcattcaatcaatattcagtggttcaatgaca

SEQ ID NO: 497 - DNA, 1371 bp, Triticum aestivum
acttgtcctggaaagggagccggcgagagaggagagaaaggaaggaaagggagccgaagaaagctctccccccctccccgaattccatcctatttcttctgcccctctcctcgcctcgcccggaccccggccggccggattcccgcaggaggaggaggaggaggaggtggggatggggagggaggacaggttcccggtctgggaggccgcgctcggcgccggggtcgccgccgtcttcgccgcgggcctcgtcggggtctacctctccatgccggactccgactacagcttcctcaagttgccccgcaacctccacgaactacaaatcctcactggccatcttgagaactataccagtgactacaccgtacaggtgttgataggctactgtgctgtgtacattttcatgcagaccttcatgatcccagggacaatattcatgtcattgcttgctggtgctctattcgggcaactccggggtgtggctctggttgtctttgctgcctcagctggtgcttcttcatgctttttcctgtcgaagctgattggaaaaccgctggtgttcgtgctgtggccagacaagctcacattcttccagaagcaggttgccaaaagaagagaaaagctgttgaattacatgcttttcctcagggtcaccccaacactgccaaataccttcatcaacttggcctcgcccattgttgatgtgcccttccataccttcttactggcaactcttatcggtctcatcccagcagcctacgtgaccgtgagggctgggattgctctgggagagttaacatcgctcagcgacctgtacgacacccagtcagtagctctgctgttcttgatcggcgtggtctcggtcacaccagcattgttgagcaaggacgaggcgcaagacacggcaccagaaatcgcagcaggcgcctcatgaacaccaaagaggagtcacctagcccacctgtacataccaaggcacagcatgcggcggcttcattggatttgggcctacaggccttgtgaggtggatgacacatggtttgcgagttcacatgacgacacagcagcacggcgggaccttggacccaagtccgcctatcacccgcgtgccggagatgtgcgttgccgtgagaacactgtttcaattcatggccaccccccacattgtttgttatgaatgaatctgggaagcacaatgcccatccacaggcaagatgcttcggatgtgtagacaagtagtgtgtgtgccgttcgtcagcctgcgatgctgtttatttagatggaactggcagctagtccaaatccttgtatatatatgaccagattcattcaatccatattcagtggttcaatgacaatttgtctgtt

SEQ ID NO: 498 - DNA, 517 bp, Brassica oleracea
ggactcagaactcaaaacaaatctgtagggttcgttgtctccttcaggtctcgatctccgctctaggacagttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcaccgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaatacctgcaaacctgaatatgccaaatggcttttgtttctatggccgtgtgcggttattacatttttttgctacagatttttttaaagtaattccatacctaataacgagaatctgtcttt

SEQ ID NO: 499 - DNA, 722 bp, Hordeum vulgare
ggagcagtaagaaacgcgactaggccggaagcggaacaaagcccataggccgagctgtctcttcccctccattcctcgtcttctccgcatcgactcgaacgaaaccctagtctctcatcacttcgatccgttctttgacattcttcggcgcaggacgccataagaaatctctctagagatcttgcagctaccatggcggacaatgaacctgttgacccaaagaatttccttgaggaacgctgcaagccgcaatgtgtaaaatcattgtatgactatgagagatgtgtgaagagagtcgagaatgatgaaactgggcagaagcactgcaccggacagttctttgactactggtcatgcgttgacaaatgtgtggcaccgaagctctttgagaagctcaaatgatggactggaatgatgctggttggcccggaccccaaatacaataaatcaacccactgtcatcctgaattctggttgtgctgaacctgtaacaaggagctttgttctatctcctatttgttgctaaaacttgtcaaaacaagtaaacacaattattttggcagatggaacaactacttttattttgcttgtacttgaatggatgaaggcatttctgctttacttcaatccatctttcataatttttgcagattcagtaaccttgacacatttgtgaaaccttgagatacgcttctacttcaatccatctttcataatttttg

SEQ ID NO: 500 - DNA, 551 bp, Hordeum vulgare
gaaccattcccaaaatttccccaccctcgaaccctaacttcgaccagcctctcgctccagatcccctcccctcccctcccctcgccaggagcagaacccacccgctcggaccgcgtaatcgccatggcggatgaggaacctgttgatcccaagaagtatcttgaggagcggtgcaagccacagtgtgtaaagccgctgtatgagtatgagaaatgtatcaagagagttgaggccgatgataccgggcacaagcactgcactgggcaatattttgactattggtcatgcatcgataaatgtgtagcaccaaagctctttgaaaagctgaaatgatattggggtgctactttcagtgagtgagcctggtcattggccagaaccttgttcaagttgaaatatttgacgagtctgcaaattgtcctgtgactgtgttttgatttcatgaacttgtaataagagcaactatctcgacactgtttgcaagcaatgatttatatgtggctaagcactgatgacaactataacaatttgatgtctgtcgattgccgttc

SEQ ID NO: 501 - DNA, 772 bp, Brachypodium distachyon
atcatggcccacagcccagtctctccagtccaaacagagctagcacgaataccacccttctcgtcgctctccctcgtcgtcgtcgtcgtctacctaccaaccttccaaaattccccacccactcgcaaaccctagctccgatcagcccctcggaccagatccatccctcgcccgcgcctcgccaccagccccgtcgccatggcagatgaggaacctgttgatccgaagaagtaccttgaggagcgatgcaagccacaatgtgtgaagccactgtatgagtatgagagatgtgtcaagagagttgagtccgatgatactgggcacaaacactgcactgggcaatatttcgactatttgtcatgcatcgataaatgtgtagcaccaaagctctttgagaagctcaagtgatgacttggtgccactgtcaactgagtgacctgatctttgtccagaaccttgtgcacttaaaatattggatgagtccagaaactgctctctgattgcgtcccggttttccgtgaacttgtaataagagtcactgttttttacactccccttttgcaaacatggatttctgtggactaagggccgatggcagcggtagtaatcttatgtctgttgattaccattcttgtataaaccattttctctctccttgagagttgagatcatgtctgacacaaccgcatggagttatatgttgtccttttggcaatttaaactttcagagagcaatcaagttgggggatatacactacatttttagttctct

SEQ ID NO: 502 - DNA, 757 bp, Brachypodium distachyon
ggccggaatcagaacaaagcccataggccataggccgaactctccctcctcgtcgatctctccacccccattcctcgtctccggcaattccactcgaaggaaaccctagtcatccccaccaatcgtgttgttgacattcttgggggcaaggagaagggcgctagagatctcgcaactagctaccatggccgatgatgaacctgttgatcaaaagaattacctcgaggagcgttgcaagccgcaatgtgtgaaaccactgtatgagtatgagagatgtgttaagagagtcgagaacgacgaaagtgggcagaagcactgcactgggcagttcttcgactactggtcatgcgtcgacaagtgtgtagcaccaaagctctttgaacagctcaaatgagagacggggcggcgcagattgccttgctccccaataaattgatccactgctttgctgttcctacttttgttcggaacaagctgtgttgttatttctgtttatgctgaacctgcagcatggagctttgtctctctgttccaaaaacttgttagaacctcagaggagggcagcaaacacgaatgttttggcagctggagcaaagattttgtattttattcgagtggagtgggcaattatattcattgtccattttacctgaatttgtggacttaaattgctcatggattttcaggcatcttgacatccacattttaatcttattggataaccgataagatcttaaaatctttttgggctatcttc

SEQ ID NO: 503 - DNA, 499 bp, Bruguiera gymnorhiza
  misc_feature (367)..(367): n is a, c, g, or t
ggtctgcgccgcaccggctactgtagtattcttcaatcataggagtttcctgcctctccaggtgatgcagtgacctctctctgcaggatttgttctgaattttctttgaaataccaatggcggatgaggaacctgttgatccaaagaagtatcttgaagaagcttgcaagcccaagtgtgtgaaacccttacttgaatatcaggcatgtgcaaagaggatccaaggtgatgaaactggttataagcactgcaccggacaatattttgattattgggcttgcatcgacaaatgcgttgcaccgaagctgtttgagaagctcaagtaaagagaagaagaaatacaatgttccactctcctgtattttgnacagacaactgtttgcaatctccttgcttttgtatgccaaactggtaatcgtttgcatggtcccattcccgagatcctggtacttttgtactgtgctggactgtcgtgaataaaataacgtcaccaggcggg

SEQ ID NO: 504 - DNA, 534 bp, Brassica napus
gactgactcaaaactcaaaacaaatctgtagggttcgttgtctccttcaggtctcgatctcctctccaggacagtttctacaagcttcaaatttgacttctcgccatggcagatgaggaagttgttgatccaaagaagtaccttgaggaatcttgcaaaccaaaatgtgtgaagccactactcgaatatcaggcgtgtgtaaagagaatccaaggtgatgactctggccacaagcattgcactgggcagtacttcgactactggcattgcattgacaaatgtgttgcacccaagctttttgcgaaactgaaatgaaaacaacgcgattctggacacagtatcttcttgagtttgcttcatgttatttttaagagggtgtataaaacgcagtggatgttgaataactgcaaacctgaatatgccaaatggcttttgtttctatcgccgtctgcggttattacattttttttgctacagattttttaaaagtaattgcatgcctaataacgagaatctgtctttatcttggtcttg

SEQ ID NO: 505 - DNA, 528 bp, Brassica napus
cggaccgactcagaactcaaaacaaatctgtagggttcgttgtctccttcaggtctcgatctccgctctaggacagttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcaccgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaatacctgcaaacctgaatatgccaaatggcttttgtttctatggccgtgtgcggttattacatttttttgctacagatttttttaaagtaattgcgtacctaataacgagaatctgtctttatcttg

SEQ ID NO: 506 - DNA, 567 bp, Manihot esculenta
ggcggacgaggaacccgttgatcaaaagaagtatcttgaagaatcttgcaagcctaaatgtgtgaagcccctacttgaatatgaggcatgtgttaagaggattaaagatgacgattctgggcacaagcactgcacaggacagtactttgactattggtcttgtattgataaatgtgtggcaccaaaactattctcaaaactgaagtaactgggagagggttggagcagctctttcattatatgtttgtactctttgcaacatcatctgaattttgtcagaagtttacttgggtcgcttgaagcagcccttattgattgtgaagccttttcaactttggaataaaggaagatatattgaattgctgcacattttatgctgttggagtttatgatgaaaaatagacaccagagaaaagaatgatgtgattgtgttagacgttctttattttggtgaattgatagtttatccttgagaaaattaattaataggcttttattgttttaaaatgaagccaaaactaaaacatccttgtattttctcctctgctaactaaaactttgttgttt

SEQ ID NO: 507 - DNA, 522 bp, Ricinus communis
ggtcgagacctggagtcaaaacggtgaaaaagcagtagctcagcatctaacattgtattgcatttgcatccattttagccgccgatcgctgcttgcttctccagacaattaggaaagaatccctttttggacatcaactgaattctttccaggatcaatggcggacgaggaacctgttgatcaaaagaagtaccttgaggaatcttgcaaacccaaatgtgtgaagcctctccttgaatatgaggcatgtgttaagaggattagaggtgatgaaactgggcacaagcactgcacaggacagtacttcgactactggtcttgtgttgataaatgtgttgcgccaaagcttttctcaaaactgaagtaattttctggctgtctcacggcagctttcattctattttgtactcttttgcaacatcagctgaattttgtcaaatgtttagatgggttgcttgaagatgccctttggtgaaacttcttcacctgaaataaaggaagattcttttcagtttacttgat

SEQ ID NO: 508 - DNA, 538 bp, cucumber
atattgcaatttctcagcttccaaactaaacctaatcagagttcctagtttcctctcagattcgtgtttcagcttccaaaggttttcttgcgtgctctttccctccaagtcagtactctttgttagccatggcggatgaagagcctgttgatcagaagaggtatcttgaagaagcttgcaaacccaagtgtgtgaaaccactacttgaatatcaggcatgcgtgaagagaatccaaggagatgacagtggtcataagcattgcactggacaatattttgattactggtcttgcattgacaaatgtgttgcaccaaaactattgacgaaactaaagtaatgggagagttgttagggatgtggggatcctatccttttgcttttgcagcatttttctgattttttatgcaatgtcgttttgtgaacttgatttttgcatcaacaaaaaatgccaagggctgtgaaattttataaaaactgccagacctttaaccatggtcaataagaaaggagattggattcacgtttggagattttgaa

SEQ ID NO: 509 - DNA, 598 bp, Eucalyptus gunnii
  misc_feature (348)..(348): n is a, c, g, or t
  misc_feature (419)..(419): n is a, c, g, or t
cggccggggggcgctgtccagcgagccgtgcgccgccgtggactcttggaaagacctagaagcgctcgaagctccaaaacgccgattcctgttctcttcctcttcgtggcttctgctgcatccgagcattggaggcttcaagtaattgtgcaggcggctgcgtgagctcctccgggctgagtcgttcgaccattcatcttttacatggcggacgaggaacctgttgatcagaagaagtatcttgaagagctgtgcaagccaaaatgtgtgaaacctttgcttgaatataaggcatgtgtcaagaggatagagggcgacgagagcgggcacaagcactgcacgggacantacttcgattattggcactgcattgacaaatgcgtggctctgaaattgtttgaaaagctgaagtaacgaanagaggcaatttatcagtcgaacttcttttgtgatttgttcaagcgggatgaatgcatcccatcgtcagattttgtaccagtaactgaaaaagatgcttgatatgggttgtttcagaaactatagcgataaggagtggatcagattatgaataaagatgaaaacgttgtggggttttgcc

SEQ ID NO: 510 - DNA, 942 bp, Actinidia deliciosa
  misc_feature (412)..(412): n is a, c, g, or t
  misc_feature (414)..(414): n is a, c, g, or t
  misc_feature (416)..(417): n is a, c, g, or t
  misc_feature (421)..(421): n is a, c, g, or t
  misc_feature (427)..(427): n is a, c, g, or t
cgtaagctaactccatctgagagatcaccattccaagttccaacacgcaactctccgtgcgtcgctggcgattgcggcttaaaccaccagaaaggtgactgcagcgagctctgttgctgaacgaatcgttttattttaaatcgctatggcggacgaggaacccgttgatccgaagaagtaccttgaagagtcttgcaagcccaagtgtgtgaagcctttacttgaatatcaggcatgtgttaaaaggatccatggtgatgaaactgggcacaagcactgcactggacaatattttgactattgggcttgtgtcgacaaatgtgttgcacccaagctgtttccgaaactgaagtaatgttggataacttaatggtatattaaaatcgccatgacactttttttctttggcttngncnngacncccatngattgtcttcactgcaaacttttgatgtttgtatggtacttttcatcagctgtggatttttttagatgttggagacctcgagtttaagttaataatacagcactcgtggatgaaatttgattgacctggaaaaaaaaaaaaaaaaaaattcggcacgaggctgacacgtcacatagtatgtctattattttattatttcttagtttattggacacacgtgtccttttgaacacgccattagaaacgtttagaaacgtataacctattcattgttaaactaatatagtagtaattcagcgagccaaaagatatttagttaagataagaaaatgattagcttgtaattcgtttgacttcaaatgaactgttttggggccacggtattgagccacacatttttgtaacaaactcactctatttattatttcaataaaccttttgagttaaactatactggttccaaacttaatctattatgccatattttttgtttgaacatatttatatatatattc

SEQ ID NO: 511 - DNA, 511 bp, Actinidia deliciosa
cttcaactctccgtgcgtcgctggcgattgtggcttaagcacaccagaaagatttgaatctgggattcacgggatcgattaacttggggattgggattgcgagcttaagattgaatttgtgaatttaaggcaaattgaatgctttcaggtgactgtagcgagctcttttgctgaaaggatcgttttcttttaaatcgctatggcggatgaggagcccgttgatccgaagaagtaccttgaagagtcttgcaagcccaagtgtgtgaagcctttacttgaatatcaggcatgtgttaaaaggatccaaagtgatgaaactgggcacaagcactgcactggacaatattttgactattgggcttgtatcgacaaatgtgttgcacccaagctgttctcaaaactgaagtaatgtgggatagctttatggtatattgaaatcgccatggctcttttgttcttcgggctttgcccagacatcttcttgattttgtcttcactacaaacttttgat

SEQ ID NO: 512 - DNA, 792 bp, Liriodendron tulipifera
  misc_feature (604)..(604): n is a, c, g, or t
gagaaacgaagcgtgccctaatttcgaagttaaattggtgattcttttgcattttgttgttgatatctatattctctcactatggcggacgaggaacctgttgatcagaagaaatacctcgaggaatcttgcaagccaaagtgtgtgaagcctctacttgagtaccgggcatgtgttaagaggatcgaaggcgatgaaactgggcacaagcattgtaccgggcagtacttcgattactggtcatgtgtcgataaatgtgttgcgccgaagctgtttacgaaactgaaatgattgtgataggagtttcatgagttagtgttttctctgcctctcattttgtccgttgattataataactgtctccaaactaccgctcgggttgtcatcttcccaaattagccattgatggttatatggtctcattcctcaccgacacagtttttgcccgatggagatgtttcttcaatgtttctgtttataaagacccaagattaaaggacaccaataagaagagggtgttcttgtggttgtgatttattttaggaagattacatgggaactatgcagtatagggtgtcctcatgtacccattctgtacaagcanggccaatggtttggcaatccagaccattgatctgttggacctcactctcaatgtggggttgccgaacaaatttctagattggcagatcctacctgtctggtcatgtcctttttttgttttttgtttttggttgtcctttgttctggataatccctataaatctactgtcttatctctaaaaaaaaaaa

SEQ ID NO: 513 - DNA, 683 bp, Zea mays
tttttcgacttacctgattgtgatgccaatattgcgaaacaccatattgaagactcaaatatacaattgtctcgtcctcgtaaccctagacaacccataaggccataccctccaaccgctggatcgggtatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagtcgagagcgacggaagtgggcagaagcactgcaccggccaatacttcgactactggtcatgcgttgacaagtgtgttgcaccaaagctcttcgacaaactgaaatgataacggaacgcaactttgaaggcgcggctcctttcaggaagtcaaatagctccaataaacccatgccttggcctctggaatttgtttgctgaacctgtggcagggagcctcattttgatacgttttgctgaaccgtctttgttttttttcccctgaatctgtgtggtatcccaagcgtcgagcccaatttcttttgtataagaataatgaggtgcccataaaaaataggccccaagaagattgttcgaatgtacacaagcaaaacaaatttcctcataattggcaactc

SEQ ID NO: 514 - DNA, 441 bp, Zea mays
aaccgcccacttccccaaaacctgccacgcttgaacggctctcaatcccaaccctaacagcaccgtctctcggatctgatctgatctgatcctccaattcgttcgtccacgtctcgccatggaggacgaggaacttgttgatcagaagaaatatcttgaggaacgatgcaagccgcaatgtgtaaaatcactttacgaatatgagaaatgcgtcaagagagttgagaatgatgatactggtcacaaacactgcactgggcaatactttgattactggtcatgcatcgacaaatgtgtagcatcaaagctctttaagaagctcaaatgatttgtgcgatgtgatgcgacttctgacaaagtgaatcgaatttgcataccttacacctttggaaagtgtatgagctcgtacatcttggaataaaacatcaatttttctttgct

SEQ ID NO: 515 - DNA, 858 bp, Zea mays
cggaccaattcttcttgggggccaattttttatggggcccctcattttttttttaccaaaaagaatttggggttgacgccttgggaacccacacagatttcagggggaaaaaaaaacaaaggacggttcagcaaaacgtatcaaaatggggctccttcccacaggtttagcaaacaattcccaggaggccaggccatggtttattggagctatttgacttcctgaaaggagccgcgccttcaaagttgcgtaccgttatcatttcagtttgtcgaagagctttggtgcaacacacttgtcaacgcatgaccagtagtcgaaatattggccggtgcagtgcttctgcccacttccgtcgctctcgactctcttgacgcatttctcataatcatacaatgtttttacacattgcggcttgcaacgttcctcaaggtaattcttctgatcaacaggttcagcatccgccatggattcgtgattgcaagggggaaatccctacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcggccctgctcaagtccaacgaccccgtgggcttcaacctcgtcgacgtcctcgcctggggctcgctcggccacatcgtcgcctactacatcctcgccacctcaagcaacggatacgaccccaacttcttctgagcggtcgtcgaggatgtattctacagacagccgtgtgcgtgcgtgtgtgcttgtcatgtatccgatcaaagtttggttaatttggacaagtagtgca

SEQ ID NO: 516 - DNA, 1502 bp, Zea mays
tactcgaggtccattgtgggtgcttccttggaagtgatccagaagaagagagctgagaagcctgaagtccgagatgctgctagagaagctgctcttcgtgagatcaaggagcgcatcaagaagaccaaggatgagaagaaggcgaagaaggctgaggtgtccaagtcccagaaggcgcagacgaagggtgctgttcagaagggttccaaaggccccaagttgggtggcggcggtggcaaacgctgaaaaggaactaagtgtcattccgagacctcatcaaagccacctttgtagtaccttggttaattttgtattttctttcagagttacttgtgactcttaattttgcatctttatatattgggagaaatgatcgccgttcgttcatatgatttcctcatctttgtttctcaaccgaataatgtgactggatgtttccaaccgctggatcgggtatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagtcgagagcgacggaagtgggcagaagcactgcaccggccaatatttcgactactggtcatgcgttgacaagtgtgttgcaccaaagctcttcgacaaactgaaatgataacggaacgcaactttgaaggcgcggctcctttcaggaagtcaaatagctttaataaacccatgccttggcttctggaatttgtttgctgaacctgtggcagggagcctcattttgatacgttttgctgaaccgtctttgtttttttcccctgaatctgtgtggtatcccaagcgtcgagcccaatttcttttgtataagaataatgaggtgcccataaaaaattggccccaagaagattgttcgaatgtacacaagcaaaacaaatttcctcataattggcaactccaaaccgctggatcgggtatcgggattaactggggctcacaagactagggaattttcccccctttggaatcacgaaatccatgggcgaatgctgaaacctgtggatcaaaaaaaaatttaccccttaaggaaacgtttgaaagcccccccaaggaggtgaaaaacatttggaatggaattaatgaaaaaaaagggttttcaaaaaaaatctcaaagaccccaccggaaagttgggggcagaaaaaacaatttggaacccgggtccaattactttttcaaattaaatggggcccaaggccgtttaaaacaaaggtgggggtttgtcaaccaaaaaagtttccttttctgaacaaaaacttagaaaaatggattaaacccgggaaaaaccgccaacccttttttaaaaagggcgcccgcggtcttcctctctttttaagggagaggatccacaaaatatagccctctcccacaaataaaaaactcccacatgggcg

SEQ ID NO: 517 - DNA, 582 bp, Pennisetum glaucum
gagtgagaaccggcgtcgtcaacctcgtggtctactctttcccagtgttgtccagcggcttcccccaaatttgccactcccaaccctaatcctcccactctctcggatcggatcctatctcttcctctccttcctgtcggagcaaggccaggtccgttccggatctccccaccagtcgccatggaggatgaagagcttgttgatcagaagaagtatcttgaggaacgatgcaagccacagtgtgtaaaatcgctctatgagtatgagaaatgtgtcaagagagtcgagaacgatgatactggacacaagcactgcactggtcaatattttgattactggtcatgcattgacaaatgtgtggcaccgaagctccttaagaagctcaaatgatgtatctagtgatgtacttttgccgagtgccccaaatgatggcatgatgctacttcaacaagtgacaattatccatttgcattcaacaagtgatgtacttttctggactgattctgcctctacaaggtggttaaagctggatttttgaaccattatctagaaaaaaaaaaccaatttgcattaaaccttgcc

SEQ ID NO: 518 - DNA, 703 bp, Pennisetum glaucum
gctcctctcgggggtctcggcgtctcctccctggctccctccccctcgtaaccctagagacagtagtccgcccccacccacccaccggatcgggatcgggaggggcctcgcctttctgcgcgcgggggaccggggatttcgctcgccatcctacgagtgccatggcggacactgagcctgttgatccgaagaattaccttgaggaacgttgcaagccacagtgtgtaaaatcactgtatgattatgagagatgcatgaagagagttgagaatgatggtagtgggcagaagcactgcactggtcaatattttgactactggtcatgcgtcgacaagtgtgttgctccaaagctctttgataagctcaagtgatgatggaatgctgctttcgatgtctggcttctttgcggtagttgtcaagctcaataaattgaacatgtaacaaacggtttcgttttgctattgaacttcttcaagtctttgaataaggcagcaaacacatactgcgctgatgttcagtttcactgtcatggccaagagaaaatgcaggaccaagggatgttggtataaccaaccatccgttttcctggtgctgctggtggtggtggtggataatatgatcttcaaaattaaaactttcatcctttcttttgacaattgcttctgttcaacatggcatccatttgtggtaccttcaatccttt

SEQ ID NO: 519 - DNA, 1154 bp, Avena sativa
cggcacgaggccccactcgcttgtgagccccaactgcgaccagcctcccggatcagatccctccactcttctcgccgggagcagagcccacccgctcggatcctcgcaacctccatggcggatgaggaacctgttgatccaaagaagtatcttgaggagcggtgcaagccacagtgtgtaaaaccactgtatgtgtatgagaaatgtgtgaagagagtcgaggctgatgatactgggcacaagcattgcactgggcaatattttgactatttgtcatgcgtcgataagtgtgtagcgtcaaagctctttcaacagctcaaatgatgactggatgctactttcgatatgtgacttgatcatcggccataaccttgtccacttaaaaatttgatgtgtcggaactgtcatgtaatcgtgtttctatttcgtgaacttgtaataagagccactattttgacactcttttgccgtggatttatgtgggcaaaagcactgatgatgtcgattataacttgatgttgattacctttcttgcacaaaaaaaaaactctccccgaaccgcttcgcgaaccaccactctgtggcaggagatagatcttctacttacaggagaaggtccacaaatgttgccttccccattgttattacagcagctgcacgaggcaaaggtggtggtgtgcttgatcgaccaacagagaaagtttctccaggtcgccagtctgagtttgatgtgaagaaatcccggaaaatgtcccctccatttcgtgtcgtcctgcacaatgacaacgagaacaggcgcgagtatgttgtccaagtcctgatgaaagttatccctgggatgactgtcgacaacgctgtcaatatcatgcaagaggctcacgtgaatgggatggcggtggttattgtctgctcgcagcaggaagccgaggagcactgcacggcactcaggggcaatggcctccgaagttctattgaacctgcaagcggtggctgctgagggttcctatttttgccgttcaaagtttgtagatacccctgcatatctagataaactgcagtgaattactggcatttattgttaaagatgaacatgggtaccttcttgcagatgtaaatcatgtagaccaaatatagtttttccagctatttttcgc

SEQ ID NO: 520 - DNA, 505 bp, Avena sativa
gattcggcacgaggtccaaccctagtcccacccatcaatcggatcaggtcttggcatttctcagttaaaaaaaaggtcttggcatttctgggcgcagaagaccgccggagagatcttgcaactacgatggcggatgaacctgttgatcctaagaaccaccttgagcaacgttgcaagccgcaatgtgtgaaatcattgtatgattatgagaaatgtgtgaagagggtcgagagcgatgaaactgggcacaagcactgcactgggcaatatttcgactacctgtcatgcgtcgacaagtgtgttgcaccaaagctctttgagcagctcaagtgatggcagggtgccgctgattgccttgggcgttaataaatccatccgctgtcttgcctttcctgttcatgttgaacctgtgacatggagctctgattttgctattcttaaagcttgttaaaaccagggcagcaaacatcgttttttagggggcagttggaacagctattttggt

SEQ ID NO: 521 - DNA, 682 bp, Populus trichocarpa
gatcaggagaggcattattttcaaaatcgaacaacgaacaatcacgccgccgatctctgttatctatctctctcccccactaacactaaccagagagggaacaccgcgaattgtcatatcttagttctaatacatggcggacgaagaactcgttgatcaaaagaagtatcttgaggactcttgcaagcctaagtgtgtgaagcctctacttgaatatgaggcatgtgttaagagagttgaaggagatgacagcagccagaaacattgtacagggcagtactttgactactggttctgtattgataaatgcgttgcaccaaagctactctctaaactgaagtgatatggaatgctctcaggacaccactttcatttcctatccgtatgttttgctttgctaccctagttgacatttctcagatgttatttggctgattcgtgccaacccttcctcattttgatgaggaaaaccttttgaattggaataacagaggatgtttttagatggacttggaagactgcataaaaatgttaataaaaggagtgacctgccctgctgtaactacgggcaatcatgtttggaacaataatgttttattcttgtcagctagggtttagggtttcaaagcagcaattcttgcttcattgatgtttgccctcatattattttcacttgaaaata

SEQ ID NO: 522 - DNA, 557 bp, Populus trichocarpa
tttgtctgcgtcaatctcccgatcatcgtttctccaactcccccgaccaagggaattcgcgaactgtcgtaccgtgatttttagttctaatacatggcggacgaggaacctgtcgatccgaagaagtatcttgaggaatcttgcaagcctaaatgtgtgaagcctttgcttgaatatcaggcatgtgttaagagaattcaaggtgatgagactggccacaaacattgtactggacagtactttgattactggtcctgtgttgataaatgcgttgctctgaagctgttttcgaaactgaagtagtagggatgctgttagggcactttcatttcctgttgtatcttttgaaatgtcagatcatgggctcgtttccactatctgcggcacctcttttcgatttgatcagcaaacattttttgaattaaaataatggaagatgtcttaaattgattgctttgtaacttgtaagttgttgaacgtgatatatcatgcgaggtcatgttgaaaattttaaagatggaggctatatatcgctccagggtggattgattttgcag

SEQ ID NO: 523 - DNA, 444 bp, Secale cereale
tttcccaaatttccccctctcgcgaaccctaacttcgaccagcctctcgctccagatccgctcccctcctctctccaggagcagaacccgcccgctcggaccgcgacgcgtaatcgccatggcggatgaggaacccgttgatcccaagaagtatcttgaggagcggtgcaagccacagtgtgtaaagccactgtatgagtatgagaaatgtatcaagagagttgaggccgatgataccgggcacaagcactgcactgggcaatattttgactatttgtcatgcatcgataaatgtgtagcaccaaagctctttgaaaagctgaaatgatattggggcgctactttcagtgagtgagcctggtcattggccagaaccttgttcaagttgaaatatttgatgagtctgcaaattgtcctgtgactgtgtttcgattttcatgaact

SEQ ID NO: 524 - DNA, 455 bp, Secale cereale
gacattattcggcacaggacgccgtaagaaatctcgctagagatcttgcagctaccatggcggacaatgaacctattgacccaaagaattaccttgaggaacgctgcaagccgcaatgtgtaaaatcattgtatgactatgagagatgtgtcaagagagtcgagaatgatgaaattgggcagaagcactgcaccgggcaattttttgactactggtcatgcgttgacaaatgtgtagcaccgaagctctttgagaagctcaaatgatggacgggatggcgctgattgccccggaccccaataaatctatccactgtcctgatttcttgttgtgttgaacctgtaacaaggagctcatgcaaacacaattatttggcagttggaacaactacttttattttgcttgtataatgttcattttgttatgttatatactcggacggatgacatttctgc

SEQ ID NO: 525 - DNA, 923 bp, Sorghum bicolor
ccaaacagaagcagttggcgtcgtcaacctcgtcgtggtcagtctagtctctaccgtaccgtaccagcagcaaaccgcccgccccgctccgcttcccccccaaatccaatccccccccaaccctagcatcggatctgatcctcctccacttcgttcgttcgtccacggtctccgccagtcgccatggaggacgaggaacttgttgatcagaagaaatatcttgaggaacgatgcaagccacagtgtgtaaaatcgctttatgagtatgagaaatgtgtcaagagagttgagagtgatgagactggtcacaaacactgcactgggcaatattttgattactggtcatgcattgacaaatgtgtagcaccaaagctctttaagaagctcaaatgataaatgtgattctactttggaagtgttacaaacgatgacgctaagcgacttctgacattgtgaatcggatttgcattaccttgacacctttggaaagtgtctgagctcgtagatcttgcaataaaacaacaaatttcctttgctggcatgtgtgtctctttggactgtgcatggataagttgatgagtgaatctggtgtcaatcttgctcttttacgtgctgttttgtgggaaaacatattatcaattagcttttctgtgaggaaaactatatttcgagtgaactgtaaagagaacgaacctgatcctattctagtttggcttcacggccctgccgatctggcatgtcgtgtcagctcatgctggcactggcatctgtggtttgttctgtcctgctgcatcaacaccttatcagccaaaggaagatagcaggaggcagcaggtcgctgagtgtctgattttcaaccttattaatcgtttggcgcaatactatttgtacctcgctcattgctatatctggaaaaggaaaaa

SEQ ID NO: 526 - DNA, 696 bp, Saccharum officinarum
  misc_feature (76)..(76): n is a, c, g, or t
  misc_feature (91)..(92): n is a, c, g, or t
  misc_feature (375)..(375): n is a, c, g, or t
tcgcccaatcccaactctaacagcaccctccctcgtatctgatgtgatcctccagttcgttcgggcacgtctctcngtcagtcgccatggnngatgaggaacttgttgatcagaagaaatatcttgaggaacgatgcaagccacagtgtgtaaaatcactttatgagtatgagaaatgtgtcaagagagtcgaaagtgatgatactggtcacaaacactgcactgggcaatattttgattactggtcatgcatcgacaaatgtgtagcaccaaagctctttaagaagctcaaatgatatatgcgatggtactttggaagtgttccaaatgatgacgctaagcgacttctgacaaagtgaatcgaatttgcattangttgacaccctttggaaagtgtctgagctcgtaggtcttggaataaaacaacaaattccctttgctagcatgtgtgtttctttggactgtgcatggataagttgatgagtgaaatctggtgtcaatcttgctcttttatgtgctgttttgtgagaacatattatcaattagctttttctgtgaggaaaactatattatgagtgaactgtaaagagaaagaacctgagcctattctaacacgacatcgcggccctgccgatccggcatggtgtggtaagctcatgcctgcatctggggttttggtcttggtttggctgcttc

SEQ ID NO: 527 - DNA, 540 bp, Saccharum officinarum
gccgtctcctctccctctcgtaaccctagacaaccgtgccccaccaaccactggatcgggaatcgggatcactgggcgcacgagaccagggatctcgcttgcaatcctacgagtcccatggcggatgctgagcctgttgatcagaagaattaccttgaggaacgttgcaagccacaatgtgtaaaatcattgtatgattatgagagatgcgtcaagagagtcgagaacgatggaagtggtcagaagcactgcactggccaatatttcgactactggtcatgcgtcgacaagtgtgttgcaccaaagctctttgacaaactgaaatgataatggaatgtggcttctgtcaggaagccaaatagctccaataaatcgatgccctggcctctggattttatatttgctgaacctgtaacagctaacaggaagccatttgattcattttgctaaactgtttgagcggggcatgaaaacagtactgctctggcagagatcctttcagtgcttgtattgaaggtttgaaatcattatctcgttttt

SEQ ID NO: 528 - DNA, 688 bp, Panicum virgatum
cccgcagttcttcttcctcggcgtcgcgtctcctcctccatctcgtagccctagacaacccatcagatcgggggctcggctcctcttggctcacgagaccagggatttgtctcgcgatcctacgagttccatggcggacgctgaacctgttgatccgaagaattaccttgaggaacgttgcaagccacagtgtgtaaaatcattgtatgattatgagagatgcatgaaaagagttgagaacgacgatagtgggcagaagcactgcaccggccaatatttcgactactggtcatgcgtcgacaagtgtgttgctccaaagctctttgataagctcaaatgatgagactgcagctttcaacgtgacttctctgttgtaattctcgagctaaataagttgaacatgtaacaaatggtttcattttgctattcaactggtagaagtctttgaataaggcagcaaacacgtactgtgctggttttcagtttcactgtcatgactagagaaggtagatggagcaaggtacccagagtgttagtataactaaccaaacgttttcctggtggtggtggtggtggatatgagcttcgaaattcaacctttcatcctttattttgacaattgtttacattcaagattgacatccatttgtcgtgcctccagtcctttgataattttcatgtagatttc

SEQ ID NO: 529 - DNA, 744 bp, Panicum virgatum
gtccccgcagttcttcttcctcggcgtcgcgtctcctcctccatctcgtaaccctagacaacccatcagatcggggtctcggctcctcttggctcacgagaccagggatttgtctcgcgatcctacaagttccatggcggatgctgaacctgttgatccgaagaattaccttgaggaacgttgcaagccacagtgtgtaaaatcattgtatgattatgagagatgcatgaaaagagttgagaacgatgatagtgggcataagcactgcactggccaatatttcgactactggtcatgcgtcgacaagtgtgttgctccaaagctctttgataagcttaaatgatgtcgctgctttcaatgtgacttctttgccgtagttctcaagctaaataaattgaacatgtaacaaacagtttcattttgctattcaattggcagaagtctttgaataaggcagacacgtactgtactggtgttcagtttaactgtcatacctagagaaggtagatggagcaaggtacccagagtgttggtataactaaccaaacgttttcgtggtggtggtggtggtggatatgagcttcaaaattcaaactttcatcctttattttggcaattgtttccattcaagattgcatccatttttcgtgcctccagtcctttgataatttctgtgtagatttcaaatgaatcagtcagtgcaatatggcatccatgagctgcaaaggtggattgattctgtcc

SEQ ID NO: 530 - DNA, 587 bp, Panicum virgatum
aaagcttttccttctctctcggactctctcctcgcttgctctgccttccccggcggcgacgactgggcgagcggcggcgccttttgtcctgtattcgcccagccctttgccggcaatgagcgaagaatcgtccagagacgatgaggaacttgttgatcaaaagaagtatcttgaggaacggtgcaagccacagtgtgtaaaatcactttacgagtatgataaatgtgtcaagagagtggagaatgatgatactgggcacaaacactgcaccgggcaatattttgattactggtcatgcatcgacaaatgtgtagcaccaaagctgtttaagaagctaaaatgatgtctgggatggagcttttggcaagtgattctgatgatagcatgatgctactttctgcgagcgacttatccatttgtgttaaccttggcgcctttggaacctggctgagctcacgaactgttatgcctgtgccttgattctgtgaacttgtaataaatcaacaattttccttcgcaagcatgtgtgttcctctggacttgacatggataagttgatgtttggtgaatctaatgtcatttgcccc

SEQ ID NO: 531 - DNA, 677 bp, Panicum virgatum
gcacccgcttcccccaaacaaatttcccactgccatcccaacccgattcaatccccccaagcactctcctcggatcagatcccctccattggattggatctcctcttctccttcctgtcggagcaaggccaggtggtccggatctctctatcagtcgccatggatgatgaggaacttgttgatcaaaagaagtatcttgaggaacgatgcaagccacagtgtgtaaaatcactttatgagtatgataaatgtgtcaagagagtcgagaatgatgatactggacacaaacactgcaccgggcagtattttgattactggtcatgcatcgacaaatgtgtagcaccaaagctgtttaagaagctaaagtgatgtctgtggtggtgcttttggcaagtgactcagatgatgcatgatgctactttcggcgagcgacttatccatttgcgttaaccttggcgcctttggaacttggctgagctcacgaactgttatgtttgtgccttgattctgtgaacttgtaataaaccaacaattttccttcccaagcatgtgtgttcctttggacttagcatggataagttgatgtttgctgaatctaatgtcattgccccagtgtcattccattgaactgagcatggatataagttgatgttcggtgaatctgatgtcattgctcc

SEQ ID NO: 532 - DNA, 672 bp, Panicum virgatum
cggggggcttcccccaaacaaacaaatttgccactgcaagtcccaaccctaatcaatcctctcctcggatcagatccctccattggatatcctcttctcctctccgtcggagccaggccacggatctctctatcagtggccatggacgatgaggaacttgttgatcaaaagaagtatcttgaggaacgatgcaagccacagtgtgtaaaatcactttatgagtatgataaatgtgtcaagagagtcgagaatgatgatactgggcacaaacactgcaccgggcaatattttgattactggtcatgcatcgacaaatgtgtagcaccaaagctgtttaagaagctaaaatgatgtctgtgatggtgcttttggcaagtgattctgatgatatcatgatgctactttcagcgagcgacttatccatttgtgtgaaccttggcgcctttggaaccgggctgagctcacgaactgttatgcttgtgccttgattctgtgaacttgtaataaatcaacaattttccttcgcaagcatgtgtgttcctctggacttgacatggataagttgatgtttggtgaatctaatgtcatttgccccagtgccattcctttgaactgactgactgagcatggataagttgatgttcggtgaatctgatgtcattgctctgcgcc

SEQ ID NO: 533 - DNA, 640 bp, Triticum aestivum
cgtctctcttcccctccattcctcctcttctccgcatccacccgaacgaaaccctagtctcccatcacttggatccggtctttgacattcttcgacgcaggacgccgtaagaaatttcgctagagatcttgcagctgccatggcggacaatgaacctattgacccaaagaattaccttgaggaacgctgcaagccgcaatgtgtaaaatcattgtatgactatgagagatgtgtgaagagagtcaagaatgatgaaactgggcagaagcactgcaccgggcaattcttcgactactggtcatgcgttgacaaatgtgtagcaccaaagctctttgagaagctcaaatgatggatggggtggcgctgattgccacagaccccaataaatcgatccactgtcctgatttctgattgtgctgaacctgtaacaaggagcttccttctatctgttgctaaaacttgtcaaaacaagcaaacacaattattttggcagtgggaacaataacttttattttgcttgtgtaatgttcgttctgtccctgttacttgggcagatgaaagcatttctgctttacttcaatccatcttcaataatttttgcagattcaggacccttgagatataccttttttttaagtca

SEQ ID NO: 534 - DNA, 627 bp, Triticum aestivum
ataggtcgagctgtcccttcccgtctctcttcccctccattcctcctcttctccacatccacccgaacggaaccctagtctcccatcacttggatccggtctttgacattctccggtgcaggacgccgtaagaatttcgctagagatcttgcagctgccatggcggacaatgaacctgttgacccaaagaattaccttgaggaacgctgcaagccgcaatgtgtaaaatcattgtatgactatgagagatgtgtgaagagagtcgagaatgatgaaactgggcagaagcactgcaccgggcaattcttcgactactggtcatgcgtcgacaaatgtgtagcaccaaagctctttgagaagctcaaatgatggatgggatggcgctgattgccccagatcccaataaatcgatccactgtcctgatttctggttgtgctgaacctgtaacaaggagcttcgttctatctgttgctaaaacttgtcaaaacaagcaaacacaattattttggcagtgggaacaattacttttattttgctcatgtaatgcattctgttctgttatacttggacagatgaaagcatttctgctttacttcaacccatcttcaataatttttgcagattca

SEQ ID NO: 535 - DNA, 591 bp, Triticum aestivum
ctcccgtggtccacggaccatttcccaaattttccccactcgcgaaccctaacttcgaccagcctctccctccagatcccctcccctcctctcgccaggagcagaacccacccgctcggaccgcgccgcgtaatcgccatggcgaatgaggaacccgttgatcccaagaagtatcttgaggagcggtgcaagccacagtgtgtaaagccactgtatgagtatgagaaatgtatcaagagagttgaggccgatgatactgggcacaagcactgcactgggcaatattttgactattggtcatgcatcgataaatgtgtagcaccaaagctctttgaaaagctgaaatgatattggggcgctactttcagtgagtcagcctggtcattggccagaaccttgttcaagttgaaatatttgtcgagtctgcaaattgtcccgtgactgtgtttcgatttcatgaacttgtaataagagcaactatcttgacactttttgcaaccattgatttatgtttggctaagcactgatgacaactataacaatttgatgtctgttgattacagttctggtactgatcatttttctcatcaa

SEQ ID NO: 536 - DNA, 633 bp, Triticum aestivum
tcgttcctcccgtggtccacgaaccatttcccaaaatttccccactcgcgaaccctaacttcgaccagcctctcgccccagatcccctccccctactctcaccaggagcagaacccacccgctcggaccgctccgcgtaatcgccatggcggacgaggaacccgttgatcccaagaagtatcttgaggagcggtgcaagccacagtgtgtaaaaccactgtatgagtatgagaaatgtatcaagagagtcgaggccgatgatactgggcacaagcactgcactgggcaatattttgactactggtcatgcatcgataaatgtgtagcaccaaagctctttgaaaagctgaaatgatattggggcgctactttcagtgagtgagcctggtcattggccagaactttgttcaagttgaaatatttgacgagtctgcaaattgtcctgtgactgtgtttcgatttcatgaacttgtaataagagcaactatcttgacactgtttgcaaccattgatttatgtttggctaagcactgatgacaactataacaatttgatgtctgtcgatacagttctggtactgaacatttttctcgtcgagatcatatccaacacaaatagacaagatttcaacaa

SEQ ID NO: 537 - DNA, 608 bp, Triticum aestivum
ccttcccgtctctcttcccctccattcctcctcttctccgcatccacccgaacggaaccctagtctcccatcacttggatccggtctttgacattctccggtgcaggacgccgtaagaatttcgctagagatcttgcagctgccatggcggacaatgaacctattgacccaaagaattaccttgaggaacgctgcaagccgcagtgtgtaaaatcactgtatgactatgagagatgtgtgaagagagtcgagaacgatgaaactgggcagaagcactgcaccgggcaattctttgactactggtcatgcgttgacaaatgtgtagcaccaaagctctttgagaagctcaaatgatggatgggatggcgctgattgccccagaccccaataaatcgatccactgtcctgatttctgattgtgctgaccctgtaacaaggagctttgttctatctgttgctaaaacttgtcaaaacaagcaaacacaattattttggcagtgggaacaattacttttattttgcttgtgtaatgttcattctgttctgttatacttggacagatgaaagcatttctgctttacttcaatccatcttcaataatttttgca

SEQ ID NO: 538 - DNA, 639 bp, Triticum aestivum
  misc_feature (7)..(7): n is a, c, g, or t
cccccgntcgttgctcccgtgggtccacggaccatttcccgaattttccccactcgcgaaccctaacttcgaccagcctcccccctccagatcccctcccctcctttcgccaggagcagaacccacccgctcggaccgcgccgcgtaatcgccatggcggatgaggaacccgttgatcccaagaagtatctcgaggagcggtgcaagccacagtgtgtaaagccactgtatgagtatgagaaatgtatcaagagagttgaggctgatgataccgggcacaagcactgcactgggcaatattttgactattggtcatgcatcgataaatgtgtagcaccaaagctctttgaaaagctgaaatgatattggggcgctactttcagtgagtgagcctggtcattgaccagaagtccagaacccagtgagtgagcctgatcattggccagaaccttgttcaagttgaaatatttgtcgagtctgcaaattgtcctgtgactgtgtttcgatttcatgaacttgtaataagagcaactatcttgacactttttgcaaccattgatttatgtttggctaagcactgatgacaactataacaatttgatgtctgtcgattacagttctggtactgatcatttttct

SEQ ID NO: 539 - DNA, 3436 bp, arabidopsis lyrata
ttctcctggaatttgcgaatcttctccgccatggctgccgagaagttaagagacttgagtcagccaattgacgtcgttttactcgatgccattgttgaggccttttacgctaccggatctaaggaagaaagagcttctgcggatactatcttgcgggatttgaaagctaatcctgatacttggcttcaagtggttcacattctacagaacaccagtagtacacatacaaaatattttgcccttcaggtgctagaaggtgttataaagtataggtggaatgcattacccgttgaacaacgtgatggaatgaaaaattacatctctgatatcattgtgcagctctcaagggatgaagcatctttcagaacggaaaggctttatgtcaacaagttaaatgtcatcctggtccagatcgtgaaacatgagtggccggcaaagtggaaaagctttattcctgatctagttatagctgcaaagactagtgaaactatctgtgagaattgcatggccattttgaaactcctaagtgaagaggtctttgatttctcaagaggagagatgactcagcaaaagataaaagaactgaaacagtctctaaacaggcaatttcaactcattcacgagttatgcctatatgtcctctcagcttcccaaagacaagaacttatacgtgcaacactctctgcattgcatgcctatctttcttggattccgttgggatacatatttgagtcccctttgctggagaccctacttaaattcttccctgttccagcatttaggaatctcacacttcaatgtctgtcagaggttgcatctctcaactttggggacttctacaatgtgcaatatgtcaagatgtacagcattttcatgaatcagttgcaggcaattctccctataaatttaaatatccctgaggcatattcaactggaagtagtgaagaacaggcaagttattttttttctgcttttatccagaacttggcactgtttttcacttcgtttttcaagttacatataaaaatcctagaatctgcacccgagaatatttctctattacttgcgggtctgggatatctcattagcatatcgtatgttgatgacactgaagtattcaaggtttgtttggactattggaattcattagttttggagttgtttggggcgcaacatcatgctggtcaccctgcactaactccaactctgtttggattgcaaatgtctttccttcctatcacagttgatggtgttaaacctgaagtcacggagcggcatcaactttattcagatccaatgtcaaaattaaggggactcatgattagtcgcatggctaagcctgaagaagtgttaattgttgaggacgaaaatgggaacattgtccgtgaaactatgaaggataatgatgttcttgtccagtataagataatgcgagagacattaatctacctctcacatcttgatcatgaagataccgaaaaacagatgttgagtaagctaagcaaacagttgagtggagaggaatgggcatggaacaatctgaacactttatgctgggcgattgggtctatttctgggtccatggtagtagaacaggaaaacagatttctcgtgttggttatccgtgatttgttaagtttatgtgaagtcgtcaagggaaaagacaataaagctgttattgcgagcaacatcatgtatgttgttggacaatattcaagattcttaagagcccattggaagtttttgaagacagttgtccataagttgtttgaatttatgcatgagacgcatcctggtgttcaggatatggcttgtgacacattcttaaaaattgttcagaagtgtaaacgaaaattcgttattgttcaggttggagaaagtgagccatttgtatctgaacttctatcaggccttgctacaatcgtcggagatcttcaacctcatcagattcatacattttatgaatctgttggtagtatgattcaggcagaatcagatcctcagaagaggggggaatacctccagaggttgatggctctcccgaatcagaaatgggcagaaataataggacaagcacgtcaaagtgcagatatcctcaaggacccagatgtgatacgtactgtgcttaatatcctccagacaaatacgcgcgttgcaacttcattaggaacattcttcctctctcaaatttcgttgatcttcttggatatgctgaatgtttacagaatgtatagtgaactcgtgtcaagcagcattgctaatggtggcccatacgcttcgagaacatctcttgttaaacttttaaggtctgttaagagggaaatccttaagctgatagagacgtttttagacaaagctgaaaaccagccacacattggaaaacagtttgttccaccaatgatggatcaagtacttggcgactatgcaagaaatgttcctgatgcaagagaatcagaagtcttatcactctttgcgacaataataaacaagtacaaggttgtaatgcgagatgaagttcccctcatatttgaagctgttttccagtgcacattggagatgattactaagaattttgaagattacccagagcaccgtctcaagtttttctcgttactgcgtgctattgctacattttgtttccgtgcgttgatacagttgtcaagtgagcaactgaagctagtgatggattcagttatctgggcatttaggcataccgaaagaaatatcgctgaaactgggctcaatctcttgctcgagatgctgaaaaactttcagaaatctgacttctgtaacaaattctaccaagcatactttctacaaattgagcaagaagtatttgctgttttgaccgataccttccataagcctgggttcaagttgcatgtgttggtgctgcagcacttatttagcctggttgagagtggatcgttgacagaaccattgtgggatgctgcaacggtaactcatccttatccaaataatgtcgcctttgtgcttgagtacaccaccaagcttctaagctcatcattccctaacatgactacaacagaggtgacacagtttgtgaatggactttacgagtcgagaaacgatgctggcagatttaagaataacatacgcgacttccttgtacagtccaaggaattttctgctcaggataacaaagatttatatgctgaggaagctgctgcccaaatggagagagagagacaaagaatgctttcgattcctggacttatagcgcccagcgaaattcaagacgacatggctgattcttaagtcttgttgtgtctaagaaggagattttcgaaaagagagatggattttttcttgtagagattttgagaaatggaaatcttagaaaagagaagtgttagatgggtttctaaattactatcttttttgttagactggatttgttaactatcaaatgaaa

SEQ ID NO: 540 - DNA, 3379 bp, arabidopsis lyrata
tctctctcctagggttttcgtctctctcgttcactgttgatagtcttatcggagagccttaattcgcagcctccgaaggttctactgcgaacttttacccacatctctctctctgccatggcggctgagaagttaagggacttgagccagccgattgacgtcggtgtgctcgatgccactgttgcggccttctttgttaccggatctaaagaagagagagctgctgcggaccagattttgcgggatttgcaggctaatccagatatgtggcttcaagttgtccacattctacaaaacacaaagagcatggataccaagttctttgctcttcaggttctagaaggtgttataaagtatagatggaatgcactgcctgttgaacaacgagatggaatgaaaaattacatctcagaggtcattgtacagctctcgagtaatgaagcttctttcagatcagaaaggctctatgtcaacaagctaaatgtcattttggtccagatagtgaaacatgattggccggcaaagtggacaagcttcattcctgatctagttgcggctgctaaaactagcgaaactatctgcgaaaattgcatggccattttgaaactcctaagcgaagaggtttttgatttctcaagaggcgaaatgactctgcagaagattaaagagctgaaacaatctctaaacagcgagtttaaactcattcatgagttatgcctatatgtcctctcagcttctcaaagacaggatcttatacgtgcaacactgtctgcgttgcatgcctatctttcctggattccattgggttatatttttgagtctcctttgcttgagaccctccttaaattcttccctgtgccagcatataggaacctcactcttcaatgtctgaccgaggttgcagctcttaatttcggggacttctacaatgtccaatatgtcaacatgtacaccatatttatagggcagctgcgagcaattctcccaccgagtacaaatatccctgaggcatattcaagtggaagtggtgaagaacaagcatttatccagaacctggcactgtttttcacttcctttttcaagtttcatattcgagtcctagaatcagcgccagaagttgttgctttgttacttgctggtctcgaatatctcattaatatatcatatgttgatgacactgaagtatttaaggtttgtttggattattggaactcgttggttttggagctgtttgatgcacatcataattctgataaccctgcagtaagtgcaagcctgatgggattgcagatgcctttccttcctggtatggttgatggccttggttctcaagtcatgcagcggcgtcaactttattctaacccaatgtccaaattaagagggttaatgattaaccgcatggcgaagcctgaagaagtgcttattgttgaagatgaaaatgggaacatcgttcgtgaaaccatgaaggacaatgatgttcttgtccagtataagattatgcgggagacattaatctacctctcacaccttgaccatgatgataccgagaagcagatgttgaggaagctaaacaaacaattaagtggggaggaatgggcatggaacaacttgaacactttgtgctgggctattggatctatttctggatctatggcagaagatcaggaaaacaggtttttggtgatggtcattcgtgatttgttgaatttatgtgaaattactaagggtaaagacaataaagccgttattgcgagcaacatcatgtatgtcgttggccagtacccgagattcttaagggcccattggaagtttttgaagacagttgtgaacaagttgtttgaattcatgcatgagacacatcctggtgttcaggacatggcatgtgacacattcttgaaaatagttcaaaagtgcaagcgaaaatttgttattgtacaggttggagagaatgaaccatttgtatctgaacttctatcaggccttgcaacaactgttcaagatcttgagcctcatcaaatacactcattttatgaatctgttggtaatatgatccaagcagaaccagatcctcagaagcgagatgaatatctccagaggttgatggcactccccaaccagaaatgggcagaaatcataggacaggcacgccaaagtgtagaattcctcaaggatccaggtgtgatacgaacagtgcttaacatcctacagactaatactagtgctgctacttcactgggaacctacttcttatcccaaatttccttgatcttcttggatatgctgaatgtatacagaatgtacagtgagcttgtgtcaaccaacattactgagggaggaccatatgcttccaagacatcttttgtaaaactcttaagatctgttaagagggaaacccttaagctgatagaaaccttcttagacaaagctgaggaccaaccacacatagggaaacaatttgtgccgccaatgatggaatcagtacttggtgactatgcgaggaatgtgcctgatgctagggaatccgaagttctttcactctttgcaacgattataaacaagtacaaggcgacaatgttagaagacgtgcctcacatatttgaagctgtattccagtgtacattggagatgataactaagaactttgaagattatccagaacaccgcctcaagtttttctcattactccgtgctattgctacattttgtttccctgccttgataaagttatcaagtccgcaactgaagctagtgatggattcaattatctgggcatttagacatactgagagaaatatcgctgaaaccgggcttaatcttttgcttgagatgctgaaaaactttcagcaatctgagttttgtaatcaattctaccggacatactttatgcaaatcgagcaagaaatatttgccgttttgactgataccttccataagcctggcttcaagctgcatgtgttggtgctgcagcagctgttttgtctgcctgagagcggtgctttgacagaacctttgtgggatgccacaactgttccttacccgtatccgaacaatgctgcatttgttcgtgaatacaccattaagctactgagctcttcattccccaacatgactgcagcagaggtcacacaatttgtggatggactttacgagtctagaaatgacccgtctggatttaagaataacattcgtgacttccttgtacagtctaaggagttttccgctcaggataacaaagatctctatgctgaggaagcagctgcacagagagagagagagcgtcaaagaatgctttcgattcctgggcttattgctcctaatgagattcaagacgagatggtggactcataaaattaagaaggctgcaacaagaagaagcttc

SEQ ID NO: 541 - DNA, 3478 bp, Arabidopsis thaliana
ttcttctagaatttgcgcatcctctccgccatggctgccgagaagttaagagacttgagtcagccgattgacgtcgttttactcgatgccactgttgaggccttttactctaccggatctaaggaagaaagagcttctgcggataatatcttgcgggatttgaaagctaatcctgatacttggcttcaagttgttcacattctacagaacaccagtagtacgcataccaaattttttgcccttcaggtgctggaaggtgttataaaatataggtggaatgcattacccgttgaacaacgtgatggaatgaaaaattacatctctgatgtcattgtgcagctgtcaagggatgaagcatctttcagaacggaaaggctttatgtcaacaagttaaatatcatcctggttcagatcgtgaaacaggagtggccggcaaagtggaaaagctttattcctgatttagttatagctgctaagactagtgaaactatctgtgagaattgcatggctattttgaaactcctaagtgaagaggtctttgatttctcaaaaggagagatgactcagcaaaagataaaagaactgaaacagtctctaaacagcgagtttcaactcattcacgagttatgcctatatgtcctctcagcttcccaaagacaagagcttatacgtgctacactctctgcattgcatgcctatctttcttggattccgttgggatacatatttgagtcccctttgctggagatcctacttaaattcttccctgttccagcatataggaatctcacacttcaatgtttgtcagaggttgcatctcttaattttggggacttctacgatatgcaatatgtcaagatgtacagcattttcatgaatcagttgcaggcaattctccctttaaatttaaatatccctgaggcatattcaactggaagtagtgaagaacaggcttttatccagaacttggcactgtttttcacttcgtttttcaagttacatataaaaatcctagaatctgcacccgaaaatatttctctattacttgcgggtctgggatatctcattagcatatcgtatgttgatgacactgaagtattcaaggtttgtttggactattggaattcattagtgttggagttgtttgggacgcgacatcatgcgtgtcaccctgcactaactccaagtctgtttggattgcaaatggctttccttcctagtacagttgatggtgttaaatctgaagtcactgagcggcaaaaactttattcagatccaatgtcaaaattaaggggactcatgattagtcgcacggctaagcctgaagaagtgttaattgttgaggacgaaaatgggaacattgttcgtgaaactatgaaggataatgatgttcttgtccagtataagataatgcgggagacattaatctacctctcacaccttgatcatgaagataccgaaaaacagatgttgagtaagctaagcaaacagttgagcggggaggaatgggcatggaacaatctaaacactttatgctgggctattgggtctatttctgggtccatggtagtagaacaggaaaacagatttctcgtgatggttatccgtgatttgttaagtttatgtgaagtcgtcaagggaaaagacaataaagctgttattgcgagcaacatcatgtacgttgttggacaatattcaagattcttaagagcccattggaagtttttgaagacagttgtccataagctgtttgaatttatgcatgagacgcatcctggtgttcaggacatggcttgcgacacattcttaaaaattgttcagaagtgtaagcgaaaatttgttattgttcaggttggagaaagtgagccatttgtgtctgaacttctatcaggccttgctacaatcgtcggagatcttcaacctcatcagattcatacattttatgaatctgttggtagtatgatccaggcagaatcagatcctcagaagaggggggaatacctccagaggttgatggctctcccgaatcagaaatgggcagaaattataggacaagcacgtcaaagtgcagatatcctcaaggaaccagatgtgatacgtactgtgcttaatatcctccagacaaatacgcgcgttgcaacttcactaggaacattcttcctgtctcaaatttcgttgatcttcttggatatgctgaatgtttacagaatgtatagtgaactcgtttcaagcagcattgctaatggtggcccatacgcttcgagaacatctcttgttaaacttttaaggtctgttaagagggaaattcttaagctgatagagacgtttttagataaagctgaaaaccagccacacattggaaaacagtttgttccaccaatgatggatcaagtacttggcgactatgcaagaaatgttcctgatgcaagagaatcagaagtcttgtcactctttgcgacaataatcaacaaatacaaggttgtaatgcgagatgaagttcccctcatatttgaagctgttttccagtgcacattggagatgattactaagaattttgaagattacccagagcaccgtctcaagtttttctcgttacttcgtgctattgctacattttgtttccgtgcgttgatacagttgtcaagtgagcaactgaagctagtgatggattcagttatctgggcatttaggcatactgaaagaaatatcgctgaaactgggctcaatctcttgctcgagatgctgaaaaactttcagaaatctgacttttgtaacaaattctaccaaacatactttctgcaaattgagcaagaagtatttgctgtcttgaccgataccttccacaagcctgggttcaagttgcatgtgttggtgttgcagcacttatttagcctggttgagagcggatcattggcagaaccattgtgggatgctgcaacggtaccgcatccttattcaaataatgtcgcctttgtgcttgagtacaccaccaagcttctaagctcatcattccccaacatgactacaacagaggtgacacagtttgtgaatggactttacgagtcgagaaacgatgttggcagatttaaggataacatacgcgacttccttatacagtccaaggaattttctgctcaggataacaaagatttatatgctgaggaagctgctgcccaaatggagagagagagacaaagaatgctttcgattcctggacttatagctcccagcgaaattcaagacgacatggccgattcttaagtcttgtttttatattttataagaagaaggctctcgaaaagagaaatggaattttttttgtagagatcttgagaaatggaaagcttagaaaagacaagtgttaggttttctaaattacaatcttttttgttggatttgttactattaaatgaaaaatgtttaggatctcaaaattaatcgaacctcaaaccggttataaaccggtcttaatttcaaa

SEQ ID NO: 542 - DNA, 3885 bp, Arabidopsis thaliana
aaaccatcctctcctttctctctctagatttttatcccctttccctctctctctctctctctcctagggttttcgtctctctcgttcactgttaatagtcttaacggagaggtttgattagcctccgggaagattctactgcgaactttggacacatctctctctgccatggcggctgagaagttaagggacttgagccagccgattgacgtcggtgtgctcgatgccactgttgcggccttctttgttaccggatctaaagaagagagagctgctgcggaccagattttgcgggatttgcaggctaatccagatatgtggcttcaagttgtccacattctacaaaatacaaacagcttggataccaagttctttgctctgcaggttctagaaggtgttataaagtatagatggaatgcactgcctgttgaacaacgagatggaatgaaaaattacatctcagaggttattgtacagctctcgagtaatgaagcatctttcagatcagaaaggctctatgtcaacaagctaaatgtcattttggtccagatcgtgaaacatgattggccggcaaagtggacaagcttcattcctgatctagttgcagctgctaaaactagcgaaactatctgcgaaaattgcatggccattttgaaactcctaagtgaagaggtttttgatttctcaagaggagaaatgactcagcagaagattaaagagctgaaacaatctctaaacagtgagtttaaactcattcatgagttatgcctatatgtcctctcagcttctcaaagacaggatcttatacgtgcaacactgtctgcattgcatgcctatctttcctggattccattgggttacatttttgagtctactttgcttgagaccctccttaaattttttcctgtgccagcatataggaacctcactattcaatgtctgaccgaggtcgcagctcttaatttcggggacttctacaatgttcaatatgtcaaaatgtataccatatttatagggcagctgcggataattctcccaccgagtacaaagatccctgaggcatattccagtggaagtggtgaagaacaagcatttatccagaacctggcactatttttcacttcctttttcaagtttcatattcgagtcctagaatcaacgccagaagttgtctctttgttactcgctggtctagaatatctcattaatatatcttatgttgacgacactgaagtatttaaggtttgtttggactattggaactcgttggtgttggagctatttgatgcgcatcataattctgataaccctgcagtaagtgcaagcctgatgggtttgcagcctttccttcctggtatggttgatggccttggttctcaagtcatgcagcggcgtcaactttattctcacccaatgtccaaattaagagggttaatgattaaccgcatggcgaagcctgaagaagtgcttattgttgaagatgaaaatgggaacatcgttcgtgaaaccatgaaggacaatgatgttcttgtccaatataagataatgcgggagacattaatctacctctcacaccttgaccatgatgataccgagaagcagatgttgaggaagctaaacaaacaattaagtggggaggaatgggcatggaacaatttgaacactttgtgctgggctattgggtctatttccggatctatggcagaagatcaggaaaacaggtttttggtgatggtcattcgtgatttgttgaatttatgtgaaattaccaagggaaaagacaataaagccgttattgcaagcaacatcatgtatgtcgttggccagtatccaagattcttaagggcccattggaagtttttgaagacagttgtgaacaagttgtttgaattcatgcatgaaacacatcctggtgttcaggacatggcctgtgatacattcttgaaaatagttcaaaagtgcaagcgaaaattcgttattgtacaggttggagagaatgaaccatttgtatctgaacttctaacaggccttgcaacaactgttcaagatcttgagcctcatcaaatacactcattttatgaatcagttggtaatatgatccaagcagaatcagatcctcagaagagagatgaatatctccagaggttgatggcactccccaaccagaaatgggcagaaatcataggacaggcacgccacagtgtagaattcctcaaggatcaagttgtgatacgtacagtgctaaacatcctacagactaatactagtgctgctacttcactgggaacatacttcttatcccaaatttccttgattttcttggatatgttgaatgtatacagaatgtacagtgagcttgtgtcaaccaacattactgagggaggaccatatgcttccaagacatcttttgtaaaactcttaagatcggttaagagggaaacacttaagctgatagaaacctttttagacaaagctgaagaccagccacacatagggaaacaatttgtgccgccaatgatggaatcagtacttggtgactatgcgaggaatgtgcctgatgctagggaatccgaagttctttcactctttgcaacgattataaacaagtacaaggcaacaatgttagacgacgtgcctcacatatttgaagctgtattccagtgtacattggagatgataactaagaactttgaagattatccagaacaccgcctcaagtttttctcattactccgtgctattgctacgttttgtttccctgccttgataaagttatcaagtccgcaactgaagctagtgatggattcaattatctgggcatttagacatactgagagaaatattgctgaaaccgggcttaatcttttgcttgagatgctgaaaaactttcagcaatctgaattttgtaatcaattctaccggtcatactttatgcaaatcgagcaagaaatatttgccgttttgaccgataccttccataagcctggcttcaagctacatgtgttggtgctgcagcaactgttttgcctgcctgagagcggtgctttgacagaacccttgtgggatgctacaaccgttccttacccgtatccggacaacgttgcatttgttcgcgaatacaccattaagctactgagctcttcattcccaaacatgactgcagcagaggtcacacaatttgtgaatggactatacgagtctagaaatgacccgtctggatttaagaataacattcgtgacttccttgtacagtctaaggagttttccgctcaggataacaaagatctctatgctgaggaagcagctgcacagagagagagagaacgtcaaagaatgctttcaattcctgggcttattgctcctaatgagattcaagacgagatggtggactcataaaattaagaagggtgcaacaagaagaagcttcctgtgttcaatgggctggattttttgtaatcataggtttttgaaaacaggaaagagttcaaggagagattaatttccccgaccgtatctctactaccgtattccgaagcttctcaattcgattttgaggattggaaaagctaagaaaacagagatctttttggggataaattagtgtcttgtttggttaattaattgggtttaatgtagatttaaacattagggaccttctctagttatctcatatggttggctcctttttgctttgacctttttttgggggtttgtttctattactcagtgattcgtgttttaggtgcaagatatttttttagactctatctttgtcaccccctagggggtttaaaattgtaagattgacttgtggtgatgtttctcattaaaatcgtccactttaaagtgtgctttgacaattttatcaaacaaaactttgaattt

SEQ ID NO: 543 - DNA, 3694 bp, Brachypodium distachyon
cgcccgcccgcccgcccgccatggcggacaaactaagggatctgagccagcccatagacgtcccggtgctggacgccaccgtcgccgccttctacggcaccggatctaaggaggagaggaatgctgccgatcagatattgcgggagctgcagaataatcctgacatgtggctgcaagtagtccacattctgcagaattctcagaacttgaacacaaagttctttgccctccaagtacttgaaagtgttatcaagtacaggtggaatgcgttgccgactgagcaacgcgatggcatgaagaattacgtatctgatgttattgttcagctctcaagtaatgaggcttcctttcgacaagagagactttatgttaataaactcaacattatattggtgcaggttctgaagcatgagtggccagccaggtggtcatccttcattcctgaccttgttgcagcggcaaagagtagtgaaacgatatgtgaaaattgcatggctatattaaagcttttaagtgaagaaatttttgatttttcaagaggcgaaatgacacagctgaagattaaagaactcaagtcttcacttaacagcgaatttcgtcttgtccatgagctttgtttgtatgtcctatctgcaacacaaagttcggagctgatccgtgctacgttggctacacttcatgctttcttatcatggattcctgtcggattcatctttgaatcgccattgctggagacgttgttgaagttctttcctatggctgcttatcggaaccttacacttcagtgcttaacagaggttgctgctcttcagtttggtgatttttatgatatgcagtatgtgaagatgtacacaattttcatgatgcagttgcaggctattcttcctcctggtcctgcaacgattcccgatgcctatgctaatggttccaatgaagaacaggcattcatacaaaatctggcgctcttcttcaccgcgttctttaagaatcatatgcgtatactggaggcatctccagaaaatagagctgcattactcctgggtcttgagtacctcattggaatttcatatgttgatgacactgaggtttttaaggtatgcttggattactggaatgtatttgtcttggagctatttgaagcacacaatcaaatggagcctgcaacagcagctgtaagcatgatgggacttcaggctcagatgatccctggagttattgatggtactgttacggctgttcagcaaaggagacagctttactcaggcccactgtcaaaattgagaatgttgatgatttgtcgtatggcaaagcctgaggaagtattgattgtggaagatgagaatggcaatattgtacgcgaaacaatgaaagataatgacgtccttgtccagtataagatcatgagggaaacactgatctatttgtctcatcttgatcatgaggatacagaacaacagatgttgaagaaattgagtaagcaattaaatggagaagactggagttggaataacctcaatactctctgctgggctatcggatcaatatctggttctatggtggaggaacaggagaatagatttttggtaatggtcattcgcgatttgctaaatctctgtgaaatcaccaaggggaaagacaataaagctgtaattgcaagcaacatcatgtatgtggttggtcagtatccaagatttctaagggctcactggaaatttctgaaaacggtggtcaacaagttgtttgagttcatgcatgagatgcatcctggagttcaggatatggcgtgtgatacttttctgaaaattgttcagaaatgcaagcgcaagtttgtgacccaacaggtgggcgagaatgaaccatttgtttctgagctgctctccaaccttactacaacaattcttgatcttgagccgcaccagattcacactttttatgaatcggttggccacatgattcaagctgaatctgataatactaagagggacgaatacctcaagagactgatgagccttcctaatctgaaatgggctgaaataattgggcaggcaggccaaagcattgatattctgaagaaccaagatgttatcagatctgtgctgaacatcttacagacaaacacaagtgttgcaaattcgcttggaccacacttcttcccacaaatttcactaatcttcctggacatgctgacagtttacagaatgtacagcgagcttgtatcaagcacaattgctgaaggaggaccttatgcctcgaagtcctcgtttgtaaaactcttgagatctatcaagagggaaacattgaagttgattgagacctttgtggacaaagccgaagatctaccacaccttgggaagcagtttgttcctccaatgatggatcctgttcttggagactatgctagaaatgtccctgatgcgagggaatctgaagttttgtccctttttgcaactattataaacaagtacaaaggtgaaatgcttgacgatgtgcctcgtatatttgaagctgttttccagtgtactctcgagatgattactaaaaactttgaagattatcctgagcaccgccttaaatttttctctttgcttcgtgctattggcacccattgcttccaagctttaattcagctttcaagtcagcaattgaagcttgttatcgattcaatcaattgggcatttagacatacagagagaaacattgctgagactggccttagtctgttgctggaaattctgaagaattttcaggcttcagcattccagaatcagttctataaaacatattttttgaatatcgagcaagagattttcgcagttctcacagactcattccataagcccggtttcaagcttcatgttttggtgctacagcacttgttttgtgtggttgatggtctaactgagcctctatgggatgcttcctcagtaccataccaatatactgataatgctatgttcgttcgagactatactgtaaaacttcttggagcatcatttcctaacattgcgcctgctgaggtgaccaagtttgttgatgggcttcttagttcgaaacatgatcttccaagctttaaaaatcatataagagacttcctggtgcagtcaaaggagttctccgtgcaggataacaaggatctgtatgccgaagaggctgctgtacaaagagagcgggaacggcaacggatgcttgctattccagggctgattgccccaagcgaattgcaagacgagatgttagattcatagtgctctgtgattctgcattgctaatagtgattcggcctcgagaggcctcgacatcccgagccttagttttcttccaagatggtgaaaggtgcctgctgtaattttatttttggttgcctccacttgacgatgattccgagatttgtgctagttgatagggaaatgccgactcagttttgtggctaagagctgttgtggagactggtaattggtttgcagcaccagtatgcgctgtgtggttgatgtgtgctagcagcagctcttgtgctcagtgtaaacattggtgcgtgtgctcagccatgatatagtatgctcaccgtacaacattgtaagcttattcctagtttagtctatagattgacagcattctgtatcaagactgataggattcttctaatcctagtgtacttgctattctgtgaaatatgcccctaccttttcttttgccc

SEQ ID NO: 544 - DNA, 3751 bp, Ricinus communis
atggcgtctttagctatggccgccgagaagcttagggatttaagtcagccgattgatgttcctttactcgatgccactgttgctgccttctatggcaccggatctaaagaagagagagctgctgcagaccggatattgcaggagttgcaaagcaacccagatatgtggatgcaagttgttcatattttacaaaatacaaagaatttaaacaccaagttctttgctttacaggtcttagaaggtgttataaagtatagatggaatgcgctgcctgttcagcaacgagatggaatgaaaaattacatttctgaagtcattgtacagctttccagtaatgaagcttcctttcgactggaaaggctgtatgtgaacaagctcaatataattctggtccagatattaaaacatgaatggccagctagatggagaagctttattcctgatcttgttgcagcagcaaaaactagtgaaactatttgtgaaaattgcatggcaatattgaaacttttaagtgaagaagtttttgatttctcacgtggggaaatgactcaacagaagatcaaagagcttaaacaatcactaaacagtgaatttcaactcatccatgagttatgcttatatgtactatcggcctcccaaagaactgagcttattcgggctacactttctaccttgcatgcatttctttcctggattcctttgggctatatatttgaatccccactgctggaaacactcctgaaattctttcctatgccatcatatagaaatcttaccctccagtgtctgacagaggttgcagctctgaattttggagatttctacaatatgcagtatgttaagatgtatactttcttcatggtccaattacaggccattctaccaccaacaacaaacattcctgaggcttatgcacatggatctagtgaagaacaggcctttattcagaacttgtcattgttcttcacttcattttataagtctcatattcgagttctagagactacacaagagaacatatctgcattattgatgggtcttgaatatttgattaatatctcatatgttgatgacacagaggtttttaaggtttgcttggactattggaactctttggtcttggagctctttgaggcacatcataatttggataatccagcagtgactgcaaacatgatgggactgcagatgcctttgcttcatggtatggtagatggcataggttcgcaaatactacagcgaaggcagctttatactggtcccatgtcaaagttgagaatgcttatgatttgtcgtatggctaaacctgaagaggttcttatagttgaagatgaaaatggtaacatcgtacgggaaaccatgaaggacaatgatgttctagttcaatacaagatcatgagggagaccttgatctacttatctcatcttgatcatgaagacactgagaaacagatgctaaagaaattaagtaaacaattaagtggcgaggattggagttggaacaatctaagcactctgtgctgggcaataggatctatatctggttccatgatggaagaacaggaaaatagatttctggtgatggttattcgggatctattgaatttgtgtgaaatcacaaagggaaaagataacaaagctgttattgcaagtaacattatgtatgttgttgggcagtatccacggtttctcagagcccattggaagttcttaaaaactgttgtcaataagttgttcgagtttatgcatgaaacacatcctggagtgcaggatatggcctgtgaaacattcttgaaaattgttacgaagtgcaagcggaaatttgtaattttacaggttggggaaagtgaaccatttgtgtccgaacttctgatagggctgccaacaactgtcgctgatcttgagcctcaccagatccattcgttttacgaatctgtagggcatatgattcaagcagaacctgatccgcagaaaagagatgaatatttgcagagactgatggatcttcctaaccagaaatgggctgaaatcatagggcaggctcgccagagtgttgattttctgaaagatcaagaagtgataaggactgttctaaatatattacagacaaatacaagtgttgctagctctctggggacttatttcttaacccaaatttctttaatctttttggacatgcttaatgtgtatagaatgtacagcgagcttatatcaagtagcattgctgatggagggccatctgtcaagagagagacacttaagctcattgagacatttttggacaaagctgaagaccagcctcagattgggaagcaatttgtgcccccaatgatggatccagtccttggtgactatgctaggaatttgcctgatgctagagaatcagaagttctttcactttttgctataattataaacaagtacaaagctgcaatgatcgatgatgtacctcggatatttgaagctgttttccagtgtacgcttgagatgattaccaaaaattttgaagactacccagaacatcgcctcaagttcttttcattactccgggccattgcaacccattgttttcctgctttgatccggttgtccagccagcaattaaagctcgtaatggattcaatcatatgggcattccggcatacagaaaggaatattgctgaaactgggctaaaccttctgttagagatgctgaagaactttcaggcttctgaattctgtaatcagttctaccggacatactttgtgacaattgagcaggaaatatttgctgtgttgacagatacatttcacaaacctggcttcaagttgcatgtcttagtgttgcagcacttgttttgcctagttgagagtggtgctttgacggagcccttatgggatgctgcaacagtgcctttaccataccctaataatgcaatgtttgttcgcgaatacaccattaaactgttgggtacatcatttcccaacatgacagcatcagaggtcactcaatttgtcaacggattatttgagtcaagaaatgatctctctgtatttaaaaatcatatccgggactttcttgtgcaatcaaaagaattttcggctcaggataataaagatctttatgctgaagaagctgctgctcagagagaaagggagagacaaagaatgctttctattccggggcttattgcccctaatgagatccaggatgagatgttggactcttagaagggggggttttgatgcgaaagctaatttgatgaattttaaaccaggagttgccggtgccatgttgattcagttacgtagaagtcaatgggtttaaaacagattacagcattcttttcatctacagtcaaatttttcgttggttttgatcctggtagatgacaagggtgccacagaattgaaggtctggctgctggcagaactgtctgtatatccattggctgggtgtagattatttaggtgctaatgtaggaatatattggagtcattgtacggttgcctgggatcctggtcgacccttgtattcatcatgatgatggttgggatcaaaactgtttaaatgactcgttttggagttgttgattgattcatcttaggtgttaacgcataatctaatgttggcgggttgtgcagatagtttcaaatttcttttacagtgccgtgttctatgttcgtttaggggcttagttttaatatcttcccctcttcgtgaaatgtaccttgaacgtgttttgatatatatgaggtttcctttttcctc

SEQ ID NO: 545 - DNA, 3836 bp, Castanea mollissima
tttccctttatctctttctagaatcttcttcttcttcttctttttctctctctattttctagggttttcattttcggtgctttggcactgctcggaccgtgtgttttcttctctagggtttatctgtgagtttgtgttgtgtggtggtttttcggcgatggcggccgagaagcttagggatttgagccagccgatcgatgtggctttgctagatgccaccgtcgcggccttctatggcaccggatctaaggaagagaggactgcagcagaccagattttgcgtgatttgcaaaacaatccggatatgtggctccaggttatgcacattctacaaaatacaaagaacctaaacaccaagttctttgccctgcaggtcctagaaggagttattaagtatcggtggaatgcattgcctgttgaacagcgagatggaatgaaaaattacatatctgatgtcattgtgcagctttctagtaatgaggcctcttttcgaattgaacgactgtatgtcaacaaactcaatgttatattggttcagatattgaagcatgagtggccagttagatggcgaagctttattcctgatcttgttgctgcagctaaaactagtgaaacaatttgtgagaattgcatggctatactaaaacttctaagtgaagaggtttttgatttctcgaggggggagatgactcaacagaagattaaagatctcaagcaatcattgaacagtgagtttcaactcattcatgagttatgcttatatgttctatcggcatctcaaagaactgagcttatacgtgctacattgtctacattgcatgctttcctttcgtggattcccttgggttatatttttgagtcaccattgcttgagacactcctaaaattcttccctgtgccagcatatcggaatcttacccttcaatgcttaactgaggttgcagcccttaattttggggacttctacaatgtgcagtatgttaagatgtatagtatcttcatggtgcagttacaggttattctcccccctactacaaacatccctgaggcttatgcacatggaagtagtgaggaacaagcatttattcagaacttggcactgtttttcacttcattttacaagtttcatattcgagtgctagaagttactcaagagaatataaatgccttgctaatgggtcttgaatatcttactaacatctcatatgtggacgacactgaggtttttaaggtttgcttggattactggaattccttggttttggaactgtttgaggcacaccataacattgataatcctgcagtagcagctgcaaatatgatgggactgcagatgccgatgcttcctggtattgttgatggcattggttcacaaattcttcagaggcggcagctttttgccattccaatgtcaaagttaagaatgcttatgatttgtcgaatggctaagcctgaagaggttctcatagttgaagatgaaaatgggaatattgttcgtgagaccatgaaggacaatgatgttcttgttcaatacaagataatgagggagactcttatctatttgtctcatcttgatcatgaggacactgaaaagcagatgttgaagaaactaagtaagcaattgagtggcgaggattggacttggaacaacttgaacacattatgctgggcaataggatctatatctggctccatgatggaggaacaggaaaacagattcttggtgatggtcattcgtgatttattgaatttatgtgaaatcacaaaagggaaagataataaagctgttattgctagtaacattatgtatgttgttgggcagtacccaaggtttttaagagcccattggaaattcttgaagactgttgtgaataagttgtttgagttcatgcatgagactcatccaggagttcaggatatggcctgtgacacattcttgaaaattgttcagaagtgcaagcggaaatttgtaattgtacaggttggagagaatgaaccatttgtgtctgaacttctaacaggccttccgacaaccatagctgatcttgagccacaccagattcatacgttctatgaatctgttggtcacatgatacaagcggaatctgatccccagaagcgggatgaataccttcagaggttgatggagctcccaaatcagaaatgggttgagatcataggtaaggcgcgtcaaagtgttgatttcctgaaggatcaagacgtaatccggactgtgcttaatatattgcagacaaatactagcgttgccaattcacttggaacatattttttatctcaaatttctctgatctttttggacatgcttaacgtttacagaatgtacagtgagcttatatcaagtagcatcgcagaaggagggccctttgcatctaaaacatcctacgtgaaacttttacggtcggttaaaagggagactcttaagctcattgagacattcttggacaaggcagaagatcaaccacaaattggaaaacaatttgtgcccccgatgatggatcctgttcttggtgactatgctaggaacttgcctgatgctagggagtcagaagttctctcactttttgccacaataattaataagtataaagctgcaatgattgaagatgtgcctcgcatatttgaagcagttttccaatgtacattggagatgatcacaaaaaattttgaagattacccagagcatcggctcaagtttttttcattacttcgtgcaattgctacacattgttttcctgcattgattcgtttatcaagtcagcaactgaagcttgtcatggattccattatatgggcatttcggcacacagaaaggaatattgctgaaactgggctgaatcttttattggagatgctgaagaactttcagaattccgagttttgtaatcaattctaccagtcatactttttgcaaattgagcaagaaatatttgctgtgttgacggacacttttcataaacccggtttcaagttgcatgtcttggtgctacaacacttgttttgcctggtggagtctggtgggttgacggagccgttgtgggatgttgccacagttccctatccatatccaaacaacacgatgtttgttcgtgagtacaccataaaacttctgagcacttcgttccccaacatgactgcagcagaggtcacgcaatttgtgaatggactgtttgagtcaagaaatgagctctctgcatttaaaaatcatataagagactttcttgtgcagtcaaaagagttttcagctcaggacaacaaagacctttatgcagaggaggctgctgctcagagagaaagagagcgacagcggatgctttccattccagggcttattgcacccaatgagatacaagatgagatgttggactcataaatggctgatgctgatgtgaatctaatgtcatggacttctataactcagagttgcaagcgggctccttgattcatttttaccagattctgtggatatgagcagaaaagagcaattttccctatgtgtccctcctgttccccagagttttcttgttgaaccttgtataaatcagtaaggtacctgggtgcaatggttgggctgccggcgatactgcctattggtggctgtgtgtaggttatttagttactaatggtagggggataaaaagagtcattatacgggttttgcttgatccagcttaaaatttgtattggcaggatgagatgcagacagtttaaatggctcattttcaagtattgattattcatctttaggtgtaacgtatactaaccctggagggttgtgtagaaattcaatcggtttttattgatagaattgatatatt

SEQ ID NO: 546 - DNA, 3642 bp, cucumber
cttcatcttaaaccatggctgcagagaagctcagggatttgagccagccgattgacgttaccttgctcgatgcaactgttgccgccttctatggtactggatctaaggaagagaggagtgctgcagatcaaattttaagggacctacaaaataatgcagacatgtggctgcaggttgtgcacattttgcaaaatacaaagaacttaaacaccaagttctttgccttgcaggttctagaaggtgtaatcaaatatagatggaatgcattgccggttgaacaaagagatggaatgaaaaattatatatctgatgtgattgtgcagctttcaagtaatgaagcttcttttcgagtggaaagactgtatgtcaacaagcttaatatcatcttggttcagatattaaagcatgaatggccagctaaatggagaagcttcattccagatcttgtttcagcagccagaactagtgaaacaatttgtgagaattgcatggcgattttaaaactcttgagtgaagaggtctttgatttctctaggggagagatgacacaacaaaaaatcaaagagcttaaacaatctttgaacagcgagtttcaactcatccatgagttatgcttatttgtgctatcagtatctcaaaggaccgagctcatccgagcgacgctatcaacattacatgctttcctttcatggattccattgggatatatatttgaatccccattgcttgaaacattactgaagtttttcccagtcccatcatatcgtaatctgactctccaatgtctaacagaggtggcagctcttaattttggggactactacaataggcagtacattgagatgtatactgtattcatggggcgattacagactattctcccacctagtacaaacatcccagaggcctatgctcacggatcaagtgaggaacaggcttttattcagaacttggcactatttttcacttcattttacaagtcgcatattcgagttctggaatcgactcaggagagtatagctgcgttgctaatgggtctcgaatatcttattaacatctcatatgttgatgacaatgaggttttcaaggtatgcttggattactggaactccttggtcctggaactttttgagacacaccataacatggataatcctgctgtgtctgccaacatgatgggattgcaggtgcctttgctttctggtgtggttgatggccttggtgcacaactcatgcaaaggaggcagctttactctggtcctatgtcaaagttgaggatgcttatgatatgccgcatggctaaacctgaagaggttctcattgttgaggatgagaatggtaatattgttcgagaaaccatgaaggacaatgatgtccttgttcagtataagagcatgcgagagacattgatatatttgtcacaccttgatcatgacgacaccgagaaacagatgctaaagaaactaagtcgacaactaagtggtgaagattggtcatggaacaatttaaacactctatgctgggcaattggatccatctctggttccatgatggaagatcaggagaacaggttcttggtgatggtcatacgtgatttactgaatttatgtgaaatcactaaaggaaaggacaataaagctgttattgcaagtaacatcatgtatgttgttggtcagtatccaagattcttacgagctcactggaagttcttgaaaactgtcgtgaacaagttgtttgagttcatgcacgaaacacatccaggagtgcaggacatggcttgtgatacattcttaaaaattgttcaaaagtgcaagcgaaagtttgtcattgtacaggttggagaaagtgagccattcgtctctgaacttcttactagtcttccaacaacagttgctgatcttgagcctcatcaaattcatactttttatgaatctgttggtaatatgattcaagctgaacctgatccgcagaagagagatgaataccttcagaggttaatggatctcccaaatcagaaatgggctgaaattattggtcaggcacgccaaagtgtggaatttctaaaagatcaagatgtaataagaacggtgctcaatatactacagacaaatacaagcgttgccagttcacttggaacctatttcttacctcagatatctttgatctttttggatatgctcaatgtgtacagaatgtatagtgagcttatatcaagtagcattgctggaggcgggccctatacatctaaaacttcctatgttaaacttctacgatcagtgaagagggaaactctgaagcttattgaaacatttttggacaaggccgaagatcaaccacaaattggcaagcagtttgtgcccccaatgatggaaccagttcttcttgattacgcaaggaatctgccagacgctcgtgaatcagaagtcttgtctctttttgctacaattataaataagtataagaatacaatgatagaagatgtgccttgtatatttgaagcagtcttccaatgcacgttggagatgattactaaaaattttgaagattatccagagcatcgcctcaaattcttttcactactacgtgcgattgccacgtattgttttcctgctctgattcggctgtcaagtcagcacttaaagcttgttatggattcaattatatgggcatttcggcatacagagaggaatattgctgaaactgggctcaatctactactagagatgctaaagaattttcaggcttccgagttttgcaatcaattttatcgaacatattttttgaccatagagcaagaaatatttgcagtcttgacggacacatttcataagccaggatttaagttgcatgtcttggttcttcaacatttgttttgcttggcggagtctggtgtattaacagaacctttgtgggatgctgcaactgtaacttatccatacccaaataacgtggcctttgttcgggagtacactatcaagctgttgagttcttcattccccaacatgactgcagcagaagtcactcaatttgtgaatggactgtttgactcgagaaatgacctctctgtgtttaagaatcacattcgagattttctggtgcaatccaaagagttttcagcacaggataataaagatctttatgctgaagaggcagctgctcagagggaaagagaacggcaacgaatgcttactattccagggcttattgctccaaatgagattcaagatgagatggtggactcgtaaatgtgtctagtttatgtgcagaaagtaaaaagctcatggactttgacgaggttgaagtgggcatttgatttgcagtcccccaaatctcttacagctcatggcacggcttggtagtttgacagctgatgatgggatattcctatagattgaatgtggagtaagtatttactatttagttggctgattttagggttagaacacatgataggaggtgcgagtgatttagtcgcaggaagcacaagccagattgatattgtatttggactgttagattgcaacagtttgagggacgaaccattttctatctaatgatgattcatcctctaaaggtgtaacgtatacattaggcctgtggccttggcgcgggttgtgcagaaattatttccttttgcctttt

SEQ ID NO: 547 - DNA, 3453 bp, Lotus japonicus
ttttctccctcaaatctctattctcttctctcccgctctgtggtttccagggtttatcactctccctccgccatggccgccgagaagctccgagacttgtcccaacccatcgatgtcccgttactcgacgccactgtcgctgccttctacggcaccggatctaaagaacagagaactgctgctgaccagattttgcgcgatttgcaaaacaatccagatatgtggcttcaagtcatgcatattctacagaacactcagaatctcaataccaagttctttgctctgcaggtgctagaaggtgtaattaaatatagatggaacgcattaccacttgagcagcgagatggaatgaaaaatttcatctctgatattattgtgcagctttctggcaatgaggcctcatttcgaatggagcggttgtatgtcaataagctcaatattatattagttcagattttgaagcatgagtggcccctgagatggcgaagttttattcccgaccttgtttctgcagctaaaactagtgaaacaatttgtgagaattgtatggcaatattgaagctcttgagtgaagaggtttttgatttttcaagaggagagatgactcagcagaagattaaagagcttaaacaatccttgaatagtgaatttcagctcatacatgagttatgcttatatgtgttgtcagcatcccaacgggccgaacttatacgtgcaactctgtctacattgcatgccttcttatcatggatccccttgggttatatatttgaatcaccgttgcttgagaccctgctaaagtttttccctcttccagtatatcgaaaccttacactgaaatgcttaattgaggtggcagcccttcaatttggcgattactatgatacacagtatactaagatgtataacatattcatggttcagttgcagacaatactcctacctactacaaatatacctgaggcatatgcacagggttctagtgaggaacaaacattcatacagaacttggcactgttctttacctcattttacaaggttcacattcgaattttggaatccactcaagagaatatcgctgctttgctatctggtcttgaatatcttatcaacatctcatatgtcgatgatactgaggtttttaaggtttgtctggactactggaatatcttggtttcggaactgtttgagccacatcgtagcttggagaaccctgcagctgcagctacaaacatgttaggaaatcaggcgccactgatgcctcctggtatggttgatggccttggttcacagcttcttcaacgccggcagctttatgccggtccgatgtcaaagttgagaacgcttatgatctgccgtatggctaaaccagaagaggttctcatcattgaagatgaaaatggcaatattgtccgcgaaaccctcaaagacaatgatgttcttgttcaatataagattatgagggagactcttatttacttgtcgcatcttgaccatgatgatacagaaagacagatgcttagaaaattaagtaaacaacttggtggtgaggattggacatggaacaatttgaacacactatgctgggccataggatctatatctggttccatgatggaagatcaggaaaacagatttttagtgatggtcattcgtgatttattgaatctatgtgaattcacaaagggaaaggacaacaaagctgttattgcaagtaatatcatgtatgtcgtggggcagtatccgcggttcttgagagctcattggaagtttctaaaaactgttgtgaataagttatttgagtttatgcatgagtcacatcctggagttcaggatatggcatgtgacacttttttgaaaatagtccagaagtgtaagcgtaaatttgtaatcacccagcttggcgaaaatgagccatttgtatctgaacttctttctggtctttcaactacgattgtagatcttgaaccccatcaaatacacactttctacgaatctgtcggcagtatggttcaagctgagtctgattcacagaagagagatgaatacctccagcggttgatgcatctccccaatcagaaatggctggaaattatagggcaggcacgtcagaatgttgattttcttaaggatcatgatgttatccgaactgtgcttaacatattgcagacaaatacaagcgttgcatcttctttaggaacatatttccttcctcaaatctcattgatctttttggacatgttgaacgtttacagaatgtatagtgagcttatatcaaaaagtattgctgaagggggtccatatgcatccaggacatcgtttgtaaaacttctgcgatcggttaagagagagacacttaaactaattgagacatttttggacaaagctgaagatcaaccacaaattggaaaacaatttgtgccaccaatgatggatcctgttctcggagattatgccaggaacgtgcctgatgcaagggaatcagaggttttgtcactttttgccacaattgtaaataaatataaagctgcaatggttgaagatgtcccccgcatatttgaagctgttttccagtgtacactagagatgattaccaaaaatttcgaagattacccagagcatcggctaaagttcttctctttactttgtgctatagctactcattgtttccatgcattaatctgcttgtcgagtcagcaactgaagtttgtcatggattcaatcatatgggcatttcggcatacagaaagaaacatagctgaaactgggctgaacctgttgttggagatgctaaagaagtttcaggccacggagttctgtaatcagttttatcgtacatattttttgacaatagagcaagagatatttgctgtcttgacggacacttttcataagcctgggttcaaattacatgtcttggtgcttcaacatttgttttgtctggcagaaactggtgccctgactgagcctctttgggatgctgctacaaatccttatccgtacccaagtaatgcagcttttgtacttgagtacacaataaaacttttaagcacttcatttcccaacatgactgctgcagaggttacccaatttgttaatggactctttgagtccacaaatgacctctccacatttaaaaatcacatacgagattttcttgtacagtcaaaagaattttcagctcaggataacaaagatctttatgctgaagaggcggcagcacagagagagcgagaacgacaaagaatgctttctgttccaggtcttatagccccaagcgagttgcaagatgaaatgttggactcatagatagatagatagatataggctaaacagcatgcgagttaggcattttgaatcgtgtcacaggcgccttaattcaatcaaataccagatgctttatgaatagatgctgcactttcctatttaaagtttagttttttcgattccccc

SEQ ID NO: 548 - DNA, 3817 bp, Lotus japonicus
ttttaccacactccgtcgtcatggccgccgagaaactcagagatttgacccaacccatggacgtccctctcctcgacgccaccgtctccgccttctacggcaccggatctaaggaagagagaagtgctgctgatcagattctgcgggagttgcagaataatcctgacatgtggctccaagtcatgcatattctgcagaacactcagagtctcaataccaagttcttcgccttgcaggttctagaaggtgtaattaaatacagatggaatgcactacctgctgagcagcgagatgggatgaagaacttcatctctgatgttattgttcagctttctagcaacgaggcgtcatttcgaatggaaaagttgtatgtcaacaaactcaatattatattagttcagattctgaagcatgaatggccagcaagatggagaagctttatccctgatcttgtttcagcagctaaaactaatgaaaccatttgtgagaattgcatggctatattgaaacttttgagtgaagaggtttttgatttttcaagaggagagatgactcagcagaagataaaagagcttaaacaatctttgaacagtgaatttcaactcatacatgagctatgcttatacgtgctatcagcatcccaaaggacagagctcatgcgtgcaacactgtctacattgcatgccttcttatcatggattcccttgggttatatatttgaatcgccattgcttgagacactcctgaagtttttccctgttccagcgtataggaacctgacattgcaatgtttaacagaggtggcaggccttcaatttgggaattattatgatgtgcagtatgtcaagatgtataatatattcatggtccaattgcagggtgtactcccacctactacaaatatacctgaggcatatgcacatggctcaagtgaggaacaagcatttattcagaacctggcgctgttcttcacctcattttacaaggttcacattcgcatcctggaatccactcaagagaatatatctgctttgctattgggccttgaatatcttatcaacatttcatatgtggacgatacagaggtttttaaggtctgcttggactactggaattccttggtgtcggagctatatgagccaaaccggagtttggataatcctgcatccgctgcaaccatgatgggacttcaggtaccaggaatgctccctggtatggttgatgggcatggttcgcagcatcttcagcgccgacagctttatgctggtcccatgtcaaaattgagaatgctcatgatctcccgaatggctaagcctgaagaggttctaattgtggaggatgaaaatggaaatattgtccgtgagaccttgaaggacaacgatgttcttgttcaatataagattatgagggaaactcttatttacttgtcacaccttgatcatgatgatactgaaaagcagatgctgaggaagttaaataaacaactcagtggtgaggactggacatggaacaatttaaacacactctgctgggcaatagggtctatatctggttccatgatggaagaacaggaaaacagatttttggttatggtcattcgtgatttattaaacctatgtgaaatcacaaagggcaaagataacaaagcagttattgcaagtaatatcatgtatgttgttgggcagtatccacggtttttaagagctcattggaagtttctaaaaactgttgtgaataagttgttcgaatttatgcatgagatacatcctggagttcaggatatggcctgtgacacatttctgaaaatagtccaaaagtgcaagcgtaaatttgtgatcacccagcttggggaaaatgagccatttgtatctgaacttctatcaggccttccaatcaccattgcggatcttgaaccccatcagatacactcattctatgaatctgttgctcacatgattcaagctgagtctgatgcacagaagagagatgaatatcttcagcgattgatgcagctcccaaatcagaaatggatggaaattatagggcaggcacatcaaaatgttgagtttttgaaggatcaagatgtaatccggactgtacttaatatattgcagacaaatacaagtgttgcatcttcattagggacatatttcctgccccaaatcacattgatctttttggacatgttgaatgtgtacagaatgtacagtgagcttatttcaaaaagtatttcagaagggggtcctttcacatcaagaacatcctatgtgaaacttctacgttctgttaagagggagacacttaaactaattgagacattcctggataaggctgaagatcaacctcaaattggaaaacaatttgtaccaccaatgatggatcctgttttgggagattatgctcggaatgtccctgatgcgagggagtcagaggttttatcactttttgccacaattgtaaacaagtataaagctgcaatgattgaagatgtacctcgtatatttgaagctgtttttcagtgcactctagagatgattacaaaaatttttgaagactacccagagcataggctgaagttcttttccctacttcgtgccatagctactcattgttttcctgcattaatctgcttgtcaagccagcaactgaagcttgttatggattcaatcatttgggcatttcgccatacagaaagaaatattgctgaaactggcttaaacctattgttggagatgctgaagaagtttcagggctcagagttctgtaatcagttttatcggacatatttcttgacaattgagcaagagatcttcgcagttctgactgacacttttcataagcctgggttcaaattgcacgtcttggtgcttcagcatttgttctgtctgctggaaactggcgccttaactgaacctctctgggatgctgctacaaatccatatccttacccaagtaatgctgcttttgtacgcgagtttaccataaaacttctaagcacttcttttcccaacatgacaacagctgaggttacccaatttgtgaatggactatttgaatccacaactgatctctccacattcaaaactcatatacgagattttcttatacagtcaaaagaattttctgcgcaggataacaaagatctgtatgctgaagaggctgctgctcagagagagagagaacgacaaagaatgcttgctattcctgggcttattgctccgaatgagttgcaagacgaaatggtggactcatagttaggctaaacagcatgggagtgaatagtaataccatggggatttttacttgatttaatcaattaccctagactttgagaacagatggagctttttcctccaattttagttttcccccacttgtcactattttatattgggactggtttggcgaaggttcctgatttcagagtttagctggccggggatattgccttgtccattgggtgagtgtagattattcagttactaattgaggatgttaatatcatcgagtcattagtaagggattcatgaaagcgtctttatatagattcgcaggatagaaagacttgttctcatgactccttaggtgtgacctcctaatgtctggcggtttgtgcagaaaacccttgtggttttatattttgtattttttcccttcaccaattaattcttaggtttattgatgtactatgagtgcacttaatatatggtttcatgaatattagtgtgttatgtgtgttcccttctctcccaatagagagaaggtattatttaatattttagtgttgtgctttatttatttattcaattctcttgtt

SEQ ID NO: 549 - DNA, 3478 bp, Zea mays
atggcggagaagctcagggatctaagccagccggtagacgtgacgctcctcgatgctactgtcgctgccttctacggcaccggatctaaagaggagaggagcgccgctgatcagatactacgtgacctacaaaacaacccagacatgtggctacaagttgtacacattctgcagaattcccagaacctcaacaccaagttctttgcattgcaaatacttgaaagtgttatcaagtacaggtggaatgcattgcccgtcgatcaacgtgatggcataaagaattacatatctgatgttattgtgcaggcaaggattagtatatttacctttcggcaggagaggctttatgtcaataaactcaatattattttggtgcagcttctaagcgaagaaatttttgacttctcaagaggtgaaatgacacaacaaaagatcaaagaactgaagtcgtcacttaacagtgagttccggctcattcacgagctatgtttatatgtcctatctgcaacgcaaaggccagagctcatccgtgctacattggcgacactccatgctttcttatcatggatccctgttggattcatctttgagtcaccgttgctggagacattactgaagttcttccctatggctgcttatcggaatcttacacttcaatgcctaacagaggttgcagcacttcagtttggtgatttttataatgtgcagtatgtgaagacatatacatttttcattattcagttgcaggctattcttcctcctgaaaaaatcccggacgtatatgctaatggttccactgaagagcaggcgtttatacaaaatcttgcactcttcttcacatcattttttaagaatcacatgcgtatactggaaacaactcaagaaaatattgctgctttgcttatgggtctcgagtaccttattggaatttcatatgttgacgatacagaggtttttaaggtgtccttggattactggaatgtatttgtattagagctatttgaagcacacaatcaaatggaacctgcagtaactgtaagcatgatggggcttcaggcgcagatggttcctggaatggtagatgggggcacagctgttaaacagaggagacagctttactctggcccactctcgaaactacggatgctgatgatttgccgtatggcaaagcctgaggaagtacttattgttgaagacgaaaacggcaatattgtacgcgagacaatgaaagacaacgacgttcttgttcagtacaagatcatgagggaaacactgatctatttatcccatcttgatcacgaggacacagaacaacagatgttgaagaaactaagcaagcaattaaatggagaagactggagttggaataaccttaatactctctgttgggctattggatcaatatcaggttctatggtagaggagcaggagaatagatttctggttatggttattcgtgatttgctaaacctctgtgaaatcacaaagggaaaggacaataaagctgtgattgcaagtaacattatgtatgttgttggtcagtatccaagatttctcagggctcattggaagtttttgaaaactgtggtcaacaaattgtttgagttcatgcatgagatgcatcctggagttcaggatatggcatgtgataccttcctgaaaattgttcaaaaatgcaagcgcaagtttgtgacacaacaggtgggcgagaatgaaccatttgtttctgaacttctgtccaaccttgctacaaccatcgccgatcttgagccacatcagattcatacgttttacgaatcagttggccatatgatccaagctgaatctgacaacactaatagggatgaatacctcaagagattgatgagccttcctaaccagaagtgggcagaaataatcggacaggcaagccaaagtattgatatcctgaagaaccaagatgttatccgatcagttctcaacattctacagacaaacacaagtgttgcgagctcacttgggccacacttcttcccacagatttcactaattttcttggacatgctaacagtctacagaatgtacagcgagcttgtatcaagcacgattgctgaaggaggaccctttgcctcaaggacgtcatttgtaaaactcttgagatctgtcaagagggaaaccctaaagttgatcgagacttttgtggacaaggcggaagatttgccacatataggaaagcagtttgtaccaccaatgatggatcctgttcttggtgattatgctagaaatgtacccgatgcaagggagtctgaagttctgtccttgtttgcaacaatcattaacaagtacaaaggggaaatgcttgaggatgtgcctcgtatatttgaggctgttttccagtgcacccttgagatgattactaagaactttgaagattatcctgagcaccgcctcaaatttttttctttgcttcgtgcaattggcacccattgcttccaagcattaatccagctttcaagtcagcaattgaagcttgtgatcgattcaattaattgggcgttcagacatacagagagaaatattgcagagactggccttagcctgttgttggagatcttgaaaaaattccaggcttcaggattccaaaaccaattctacaaaacctactttttgacaattgagcaagagatttttgcagtcctcacagacacattccacaaacctggtttcaagcttcatgtttcggtgctgcaacacttgttttgtgcggttgatggtctaacggagcctctatgggacgcgtcttctgtaccttaccaatatacggataatgctatgtttgttcgagattacaccataaagctcttagggacatcatttcctaacatgacagtaaccgaggtgacaaagtttgtagatggtcttcttagttcaaaacttgatcttccaagcttcaaaaaccatattagagacttcctggtgcagtccaaggagttctcagttcaggataacaaggatctatacgcggaagaggctgctgcccaaagagagagggagcgccaacgtatgcttgccattccggggctcattgcccctagcgagttgcaagacgagatggtagattcgtagtgttccttgttgattcagctctctaatgtagcttcctgtttgttggtccggcatcggaatacctctggagccctcgacgtccaagttttcttccagggtggtgaaagaaggtgcctgctgtaattttatttttggttacctccacatgatgctgattccaagatttgtggtagtagacagtcagttttgccgcatgactgctgctgggggtctctcagcagctgtggttgcctggatgtgttagcagcggctcttgtgctcggtgtactttgctaacattggtgcgtgtactttgcccatcatatattatattgtggtacatcattgtatgcttctttggtttaagttaatagatggaatagcgatttatgta

SEQ ID NO: 550 - DNA, 3664 bp, Zea mays
atggcggagaagctcagggatctgagtcagccgatagacgtgacgctgctcgatgccacagtcgccgccttttacggcactggatctaaagaggagaggagcgccgctgatcagatactacgtgatctacaaaataatccagacatgtggctacaagttgtacatattctgcagaattcccagaatctcaacaccaagttctttgcactacaagtacttgaaagtgttatcaagtacaggtggaatgcattgcctgttgaacaacgtgatggcataaagaattacatatccgatgttattgtgcaggcaaggattaatatctttacctttcggcaggagaggctttacgtcaataaactcaatattattttggtgcagcttctaagtgaagaaatttttgacttctcaagaggtgaaatgacacaacaaaagatcaaagaactgaagtcttcacttaatagtgaattccggctcattcatgagctatgcttgtatgtcttatctgcaacgcaaaggccacagctcatccgtgctacattggcgacactccatgctttcttatcatggatcccaattggattcatttttgagtcaccgttgctggagacattactgaagttcttccctatggctgcttatcagaatcttacacttcaatgcctaacagaggttgcagcacttcagtttggtgatttttataacgtgcagtatgtgaagatgtatacatttttcatgattcagttgcaggctattcttcctcctgaaaaaatcccagatgcatatgctaatggttccactgaagagcaggcatttatacaaaatctcgcactcttcttcacatccttttttaagaatcacatgcgtatactggaaacaactcaagaaaacagtgctgctttgcttatgggtctcgagtaccttattggaatttcatatgttgatgatacagaggtttttaaggtctgcttggattactggaatgtatttgtcttagagctatttgaagcacacaatgaaatggaacctgcagcagccgtaagcatgatggggcttcagacgcgaatggttcctggaatggtagatgggactgtcactgctgttcatcagaggagacaactttactccgcttcactctcaaaactgcggatgctgatgatttgtcgaatggcaaagcctgaggaagtacttattgttgaagacgaaaatggcaatattgtacgtgagacaatgaaagacaacgatgttcttgttcagtacaagatcatgagggaaacactgatctatttatctcatcttgatcacgaggatacagagcaacagatgttgaagaaactaagcaagcaattaaatggagaagactggagttggaataaccttaatactctctgttgggctattggatcaatatcagggtctatggtagaggagcaggagaatagatttctggttatggttattcgtgatttgctaaacctatgtgaaatcacaaagggaaaggacaataaagctgtgattgcaagtaacatcatgtatgttgttggtcagtatccaagatttctcagggcccattggaagtttttgaaaactgtggtcaacaaattgtttgagttcatgcatgagatgcatcctggagttcaggatatggcatgtgataccttcctgaaaattgttcaaaaatgcaagcgcaagtttgtgacacaacaggtgggcgagaatgaaccatttgtttctgagcttctgtccaaccttgctacaacaatcgcggatcttgagccacatcagatccatacattttacgaatcagttggccatatgattcaagctgaatctgacaacactaagagagatgaatatctcaagagattgatgagccttcctaatcagaagtgggcagaaataattggacaggcaagccaaagcattgatatcttgaagaaccaagatgttatcagatcagttctcaacatcctacagacaaacacaagtgttgcgagctcccttggaccacacttcttcccacagatttctctaattttcttggacatgctaacagtctacagaatgtacagtgagcttgtatcaagcacgatcgctgaaggaggaccatttgcctcaaggacatcatttgtaaaactattgagatctgtcaagagggaaaccctaaagttgatcgagacttttgtggacaaggcagaagatttaccgcacttaggaaagcagtttgttccaccaatgatggatcctgtccttggtgattatgctagaaatgtacccgatgcaagggagtctgaagttctgtctttgtttgcaacaatcattaacaagtacaaaggggaaatgcttgaggatgtgcctcgtatatttgaggctgttttccagtgcactcttgagatgattactaagaactttgaagattatcctgagcaccgcctcaaatttttttctttgctccgtgcaattggcacccattgcttccaagcattaatccagctttcaagccagcaattgaagcttgtgatcgattcgattaattgggcgttcagacataccgagagaaatatcgcagagactggccttagtctattgttggaaattttgaagaactttgaggcttcaggattccaaaatcaattctacaaaacctactttttgacaattgagcaagagatttttgcagttctcacagacacattccacaaacctggtttcaagcttcatgttttggtgctccaacacttattttatgtggttgatagtctaactgagcctctatgggattcttcatcagtaccatatcaatatacggataatgccatgtttgttcgagattacaccataaaactcttaggaacatcatttcctaacatgactgtagctgaggtgaccaagtttgtggatggccttcttagttcaaaacttgatcttccgagcttcaaaaaccatattagagatttcctggtgcagtcgaaggagttctcagctcaggataacaaggatctatacgcggaagaggctgctgcccaaagagaaagggagcgccaacgaatgcttgccattccggggctgattgcccctagcgaattgcaagacgagatggtagattcgtagtgttccttgttttgattctgctttctctaatgtagcttcctgtttgttggtctggcctcgggagccctcgtctttcaagtgcgagttttcttccagggtggtgaaaggtggctgctgtaattttatttttggttacctccacatgatgctgattccaagatttgtggttgtagactgggaatggactagtcagttttgccgcaggggaggttcctggaaccgctgttgggtcttcagcagctgtgcttgcctggatgtgttaacagcggctcttaacattggtgcgtgtgctttgcccatggtatatcatcgtggtacagcagtgtatgcttcttcagttgaagctcatagatggatccaggctgataggaaccttgatatatctgtactgtactattctcagatatctcatatatatatttttctttgcattggtgcatttctcaatgtgtagatttgctgtctcatcgacaagctgtgtatcgagaaactgttgggtatttctgccagctgtgtggaggcacattcgaaaacggaatagattttttttgttttt

SEQ ID NO: 551 - DNA, 3650 bp, Medicago truncatula
tatcactttctctcttcgccatggccgcggagaaactccgtgatttatctcaacccattgacgtccctttgctcgatgctactgttgctgccttctatggcaccggatctaaagaacagagaactgctgctgaccagattttgcgggaattgcaaaataatccagacatgtggctacaagtcatgcatattttacagaacactcaaaatctaaataccaagttctttgctttgcaggtgctagagggtgtgattaaatatagatggaacgcactaccggttgagcagcgagatggaatgaaaaatttcatctccgatgttattgtacagctatctcgcaacgaggcctcatttcgaacggagcgattgtatgtcaacaaactcaatattatattagttcagattctgaagcatgagtggcctgcgagatggcgaaactttattcctgaccttgtttcagcagctaagaccagtgaaactatttgtgagaattgtatggctatattgaagcttttgagtgaagaggtttttgatttttcaagaggcgagatgactcagctgaagattaaagagcttaaacaatcattgaatagtgaatttcagctcatacatgagttatgcttattcgtgttatcagtttcccaacgaactgagctgatacgtgcaacactctctacattgcatgccttcttatcttggattcccttgggctatatatttgaatcaccattgctcgagacattactgaagtttttcacaatgcaagcatatcggaacctgacattgcaatgtttaactgaggtggcatcgcttcaatttgggaatttctatgatgcacaatatgttaagatgtataacatattcatggttcagttgcagagcatactcccacctactacaaatatacctgaggcatatgcacatggttcaagtgatgaacaggcatttatacaaaatttggcactgttcttcaccttatttttcaaggttcacatacgaattctagaatccacacaagagaatatctctgctttactattgggtcttgaatatctcatcaacatctcatatgtggacgatactgaggtttttaaggtctgtctggactactggaatactttggtttcagaactttttcagccacaccgcagcttggagaattctgctgcagcagccacaaacatgatgggatcacaggtgtcattaatgcctcctggtatggttgatggccttggtccacagcttcttcagcgccgacagctttatgctggtcccgtgtctaagttgagaatgcttatgatctgtcgtatggctaaaccagaagaagttctcatagttgaagatgaaaatgggaatatagtccgtgaaaccatgaaagacagcgatgttctcgttcaatataagattatgagggaaactcttatttacttgtcacatctggatcacgatgatactgaaaagcagatgcttggaaaattaagcaagcaactaagtggtaaggattggacatggaacaatctgaacacattgtgctgggcaataggatctatttcaggttccatgggcgaagaacaggaaaacagatttttggttatggtcatccgtgatttattaaatctatgtgaaataacaaagggcaaagataacaaagctgttattgcaagtaatatcatgtatgtcgtaggacagtacccacggtttttaagagctcattggaagtttctaaaaactgttgtgaataagttgtttgagtttatgcatgaaacacatcctggagttcaggatatggcctgtgatacattcttgaaaatagtccaaaagtgtaggcgaaaatttgttatcacccaggttggggaaaatgagccattcgtgtctgaacttttatctggcctttcaactacaattgcagatcttgaaccccatcaaatacacaccttctatgaatctgttggcagcatgattcaagcagaatctgattcacaaaagagagatgaatatcttcaacggttgatggtgcttccaaatcagaaatggatggaaattattgggcaggcacgtcaaaatgctgatttccttaaggatcaagatgttattcgaactgtgcttaatgtgttgcagacaaatacaagtgttgcatcttctttaggaacatatttcctgcctcaaatcacattgatctttttggacatgttgaatgtttacaggatgtacagtgagcttatatcaaagagtattgcagaagggacaccttttacatctagaacctcatatgttaaacttctgcgttcggttaagagggagacacttaagctgattgagacatttttggacaaggctgaagatcaaccacaaattggaaaacaatttgtgccaccaatgatggatcctgttctgggagattatgccaggaatgtgcctgatgcaagggaatcagaggttttgtcactttttgccacaattataaataaatataaagcttcaatgattgaagacatcccgcacatatttgaagctgttttccagtgtacactagaaatgattacgaaaaactttgaagattacccagagcataggctaaaatttttctctttactgcgcgccatagctactcattgttttcctgcattgatatgcttgtcaagtcagcaactgaagtttgttatggattcaatcatatgggcatttcggcatacagaaagaaatattgctgaaactggtctgaaccttttgttggagatgctgaacaagtttcaggcttcggagttctgcaatcagttttatcggacttattttttgacaatagagcaagagatatttgctgtcttgacagacacttttcataagcctgggttcaaattgcatgtcttggtgcttcaacatttattatgtctggctgaatctggtgccctgactgagcctctatgggatgctgctacaaattcatatccatacccaagtaatggtgcttttgtgcgcgagtacacaattaaacttttaagcacgtcatttcccaacatgactgctgcagaggttacccaatttgttaatggactttttgagtccacaaatgacctctccacattcaaaactcacatacgggattttcttatacaatcaaaagagttttcagctcaggataacaaagatctttatgccgaagaagccgcagctcagagagagagagaacggcaaagaatgctttctattccagggcttattgccccagttgagttgcaagatgaaatggtggactcatagctataggctaatcaacatgagagtaaataggagcgcatgtttacttgtgtcgcatgcacattcattcaaacaaacaccagatgctgtgagaacagatgcatcattgtcctatttattatatagttttgtttttgcgctcttcccaatatttcatgttgggacttgtttgcaatagattcctgatttcagaggttaggctggcaataccgccttgtctattggttgagtgtagatcacaatagatactgacattagtaagtgtttagttggggcagcattccatagaattatgacaggatgagtgacccaatttctagtattggtgacttcctaaactctggtggattgtgcagaaaacccctgtggtttgatattttgttgttttttcaccga

SEQ ID NO: 552 - DNA, 3559 bp, Medicago truncatula
cttcttcttcttcttctccgatggccgctgagaagctcagagatttgagctctccgatcgatgttcccttactagacgccaccgtcgccgccttctacggcaccggatctaagcaagagagaagtgctgctgattcaattttgcgggacttgcaaaataatcctgatatgtggctgcaagtcatgcatattttgcagaatactcaaaatctcaataccaagttttttgcattgcaggttcttgaaggcgtaattaaatatagatggaatgccttacctgccgagcagcgagatggaatgaaaaatttcatctctgatattattgttcagctttctagcaacgaggcctcattccgaacggaaaggttgtatgtcaacaagctcaacattatattagttcagattttgaagcatgagtggccagcaagatggcgaagctttattcctgatcttgtcgcagctgctaaaactagtgaaacgatctgtgagaattgcatggctatattgaaacttttgagtgaagaggtttttgatttttcaagaggagaaatgacacagcagaagataaaagagcttaaacaatcattgaacagcgaatttcaactcatacatgagttatgcttatatgtgctatcggcatcccaaagggctgagctgatacgtgctacactatccacattgcatgccttcttatcatggattcccttgggttatatatttgaatcaccgctgcttgagacactcctgaagtttttcccagttccagcatatcgaaatcttacgctgcaatgtttaacagaggtggcatcccttcaatttgggaatttttatgacgtgcaatatgtcaagatgtatggtatattaatgggccaattgcagactatactgccgcctaacacaaatatccctgaggcatatgcacatggcaatagcgaagaacaagcatttatacagaacctggcgctgttcttcacctcattttttaaggttcacatccgcatcctggaatccactcaagagaatataacaactttgcttttgggccttgaatatcttatcagcatttcatatgttgacgatactgaggtttttaaggtgtgtttggactactggaattccttggtgtcggagctgtttgagccacatcgaagtttggataatcctgcagctactgcaaacttgatgggacttcaggtatcatcaatgcttcctggtatggttgatgggcacggttctcagcttctccaacgtcggcagctttatgctggtcccatgtcaaagttgagaatgcttatgatctgtcgaatggctaaacccgaagaagttctcatagttgaagatgaaaatgggaatattgtccgtgaaaccttgaaggacaatgatgttcttgttcaatataagattatgagggagactcttatttacttggcacatcttgaccatgatgatactgaaaagcagatgctgaggaaattaagtaaacaactcagtggtgaggattggacctggaacaatttgaatacactttgctgggcaattggatctatatctggttccatgatagaagagcaggaaaacagatttttggttatggtaattcgtgatttattaaatctatgtgaaatcacgaagggaaaagataacaaagcagttattgcaagtaatatcatgtatgttgttggccagtatccccgatttttaagagctcattggaagtttcttaaaactgttgtgaacaagttgttcgagtttatgcatgagacacatcctggagttcaggatatggcgtgtgacacttttttgaaaatagttcagaagtgcaagcgtaagtttgtgatcacccaggttggcgaaaatgagccatttgtatctgaacttctatcaggccttccaatcactattgcagatcttgaaccccatcagatacactccttctatgaatctgttgctcatatgattcaagcagagtctgattcacagaagagagatgaatttcttcagcggttgatggagcttccaaatcagaaatggatggaaattataggccaggcacatcaaaatgttgactttttgaaggatcaagatgtaatacggactgtgcttaatatattgcagacgaatacaagtgttgcatcttctttagggacatttttcctgccccaaatcacgatgatctttttggacatgttgaatgtgtacagaatgtacagtgagcttatttctaaaagtattttagaaggggggccttatgcatccaaaacatcctatgtgaaacttctacgttcggttaagagggagacacttaaattgatcgagacattcttggataaggctgaagatcaaccacagattggaaaacaatttgtgccgccaatgatggatcctgttctgggagattatgctaggaatgctcctgatgcaagggaatcagaggttttgtccctttttgccacaatagtaaacaaatataaagctacaatgattgaagatgtacctcgcatatttgaagctgtttttcagtgcacattagagatgattacaaaaaactttgaagattaccctgagcaccggcttaagttcttctctcttctccgtgccatagctacccattgttttcctgcactgatctgtttgtcaagccagcaattgaagcttgttatggattcaatcatgtgggcatttcggcacacagaaaggaatattgctgaaacaggcctgaacctgttgttggagatgctgaagaagtttcagggttctgagttctgtaatcagttctaccggacatacttcttgacaactgagaatgagatatttgctgttttgaccgatacttttcataagcctgggttcaaattacatgtcctggtgcttcagcatttgttttgtctgctagaaactggtgtgctaactgagcccctttgggatgttgctacaagtccacagtcatacccaagtaatgcagtttttgtacttgagtatactataaagcttctaagtgcttcttttccgaacatgacaacagctgaggttacccaatttgttaatggactatttgagtctacaaatgatctctccacatttaaaacccatatacgagattttctgatacagtcaaaagaattttcagctcaggataacaaagatctctatgctgaagaggctgcggctcagagagaaagagaacggcaaagaatgctttctattccagggctgattgccccaatcgagttgcaagatgaaatggtggactcatagagttttagctagccgggggatatagacttgtccatgtggtgagtgtagattattgatttactaattgaggattatgttgggtcattttaaggaattcatgtagtcatctttgtattgaacaaaaatggaagactccttcggagtgatgatgactctttaggtgtgacctaacttctggcggtttgtgcagaaaacccttgtggttttatattttgtatttttttccttcaattgatttttaggggtattgatgtaccgagtgcacttactatatggtttcatgaatattagtgttatatatgccc

SEQ ID NO: 553 - DNA, 3892 bp, Populus trichocarpa
ttctctctctgatttctctctctaaactgtttgctcactacaacaaacataaaacccttccccgctcccttctttctctttttttttctctctctagaagctcgccttttcgtttaatctctctcttagggtttggtggtagtagtagtggaagcagctagggttttgtgtgggtttaaaatcagtagtaatgacttctttggttatggcggcagagaaatttagggatttaagtcaggcgattgatgttcctttacttgatgctactgttgctgccttctatggcactggatctaaagaagagagggcagctgccgatcgcattttgcaggacttgcaaagcaatccagatatgtggcttcaagtggtgcacattctacaaaatacaaagaacctaaacaccaagttctttgccttgcaggtcctagagggtgttataaaatatagatggaatgcattgcctgttgaacaacgagatggaatgaaaaattatatttcagaagtcattgtacagctttcaagtaacgaggcgtcttttcgaatggaaaggctgtatgtaaacaagctcaatgttactttggtccagattctcaagcatgagtggccagctaggtggcgaagctttattcctgatcttgttgcagcggcaaaaactagtgaaactatatgtgagaattgcatggttatattgaaacttctaagtgaagaagtttttgatttctcacgaggagagatgactcaacagaagatcaaagagcttaaacaatcattaaacagtgagtttcaactcatccatgagttatgcttatatgtcctatcagcctcccaaagaaccgagcttattcaagcaacattgtccaccttgcatgcttttctttcttggattcccctgggctatatttttgaatctcccctgcttgaaacacttctgaaattttttcccatgccatcttatcggaaccttacccttcagtgtttgacagaggttgcggctcttaattttggggatttctataacatgcagtacattaagatgtataattttttcatggtccagttacaggccattcttccatcaaccaccaagatcccagaggcttatgcaaatggatctagtgaagaacaagcattcattcagaatctggcactgtttttcacttcgttttacaagtctcatattcgggtgctggagtcttctcaggagaatatatctgctctgctaatgggtcttgagtatctaattaatatctcatttgttgatgacactgaggtttttaaggtttgcttggactattggaactccttggttttggagctttttgagccacaccataatttggacactcctgcagccactgtaaacatgatgggattgcagatgcctttgctacatggcatggttgatggtttagggtcacaaattttgcagaggaggcagctttatgctgctccaatgtccaaattgagaatgcttatgatctgtcgcatggctaaacccgaggaggttctgatagttgaagatgaaaatggtaatattgttcgtgaaaccatgaaggacaatgatgttcttgttcaatataagattatgagagaaacattaatctatttgtcacatcttgatcatgaggatactgaaaagcagatgttgaagaaattaagtaaacaactgagcggtgaagattggaactggaacaacttaaacactttatgctgggcaattggatccatttctggttccatgatggaggaacaggaaaaccgatttcttgtgatggtcattcgtgatttgctgaatttatgtgaaatcacgaaagggaaggataacaaagctgttattgcgagtaacatcatgtatgtcgttggccagtacccaagatttctcagagctcactggaagttcctgaaaactgttgtcaataaattgttcgaatttatgcatgaaactcatcctggagttcaggacatggcctgtgacacattcttgaaaattgtccagaaatgcaagcggaaatttgttattgtacaggttggagaaagtgagccatttgtatctgaacttctatctggccttccaacaactgttgctgatctcgagccacatcagatacatacattttatgaatctgttggccatatgattcaagcagaatctgatctacagaagagagatgaatacatgcagaggttgatggatctccctaaccagaaatgggcagaaattataggacaggcacatcaaagtgtagattttctgaaagatcaagaagtgatcagaactgtgcttaatatattgcagaccaatacaagtgttgcaaattctcttgggacatactttttatctcaaatttctcttatatttttggacatgcttaacgtgtacagaatgtacagtgagcttatatcaagcagtattgcagaaggagggccttatgcatctaaaacatcctatgtgaaacttttgcggtctgttaagagggagacacttaagctcatcgagacatttttggacaaggccgaagatcaaccacaaattgggaagcagttcgtgcccccaatgatggatcctgttcttggtgattatgctaggaatttgccagatgctagggaatcagaagttttgtcactttttgcaacaattataaacaagtacaaagctgcaatgatagaagatgtacctcgaatatttgaagctgttttccagtgtacattggagatgataaccaaaaatttcgaggattatccagaacatcgccttaagttcttttcgttacttcgtgccatcgctgcacattgtttccctgccttgattcgtttgtctagtgagcaactgaagcttgtgatggattcaattatatgggcattccgtcatacagagaggaatatagctgagactggtctaaacctattgttagagatgctgaagaactttcaggcgtctgagttctgtaatcagttctacaggtcatactttttgacaattgagcaggaaatatttgctgtattgacagatacatttcacaaacctggttttaagttgcatgttttggtgctacaacacttattttgctcggcggagagtggtgctttgtcagagcctctgtgggatactacaacagtcccttatccatatttgaataatgctatgtttgttcgtgagtacaccattaaacttttgggcacatcattccctaacatgactgcatcagaggtcactcaatttgttaacggactatttgagtcaaaaaacaacctgtccatattcaagaatcacattcgagactttctcgtgcaatcaaaggaattttctgctcaggataataaagatctctatgcagaagaggctgctgttcagagggaaagggagcgacaaagaatgctttccattccagggcttattgcccctaatgaaatacaagatgagatgttagattcttagagagctattttttgcagcagaagctaatttcatgaatacaactcggggagttgctgtgggcgtcgtgatttgtttacctggcagtggatatgaacaggtacagcatttttttcccatgattctccagagttttcctttgtgttgaaccaggtacatcacaaaggtgccttgctttggaggtttggcagctggctatgctgcctatatatctagtagctatgctgggtgtagaatatttaggggctgatgtaggaatacgttgagtcattttacggtttgtgaatccagcttgagacttctcacgatgatggatgggatcaaactgtttaaatgactcctgaattgttgattgattcatcctagtgcatgctaatgttggcgagttgtgcaggaattgttttgttgggaattctgttttcgagatttttatttatagttcccgacttcatcaaaagt

SEQ ID NO: 554 - DNA, 3802 bp, Populus trichocarpa
aagcagtctttcgcgcatatataaatataaattatcctctctctctctctctctctctctctctctaaactgttcgctcactacaacgaacataaaacccttccactttctctctcttttttccctctctagaaacaccgccttcccgtttagtctctctcttagggtttgctggtcgaagtagcagtggtggaagcagcgagggtttttgtgcgggtttgaaatccagtaataatggcttctttggttatggcggcagagaaatttagggatttaagtcaggcgattgatgttcctttactggatgctactgtagctgccttctatggcactggatccaaagaagagagggtagctgctgaccgtattttgcaggacttgcaaaacaatccagatatgtggctccaagtggtgcacattctacaaaatacaaagaacctcaacaccaagttctttgccttgcaggtcctagagggcgttataaagtatagatggaatgcattgcctgttgaacaacgagatggaatgaaaaattacatttctgaagtcattgtacagctttcaagtaatgaggcctcttttcggatggaaaggctatatgtaaacaagctcaatgttactttggttcagatactcaagcatgagtggcctgctagatggcgaagctttatccctgatcttgttgctgcagcaaaaactagtgaaactatttgtgagaattgcatggttatattgaaacttcttagtgaagaagtttttgatttctcacgaggagagatgactcaacagaagatcaaagagcttaaacaatcattaaacagcgagtttcaactcatccatgagctatgcttgtatgtcttgtcagcttcccaaagaaccgagcttattcgagcaacattgtccaccttgcatgcttttctttcttggattcctttgggttatatttttgaatctcccttgcttgaaacacttctgaaattttttccaatgccatcttatcggaaccttacccttcagtgtttgacagaggttgcggctcttaattttggggatttctataacatacagtatgttaagatgtataattttttcatggtccagttgcaggccattcttccactaaccactaatatcccagaggcttatgcaaatggatctagtgaagaacaagcattcattcagaatctggcgctgtttttcacctcgttttataagtctcatattcaagtgctggagtctacgcaggagaacataactgctctgctaatgggtctcgagtatctaattaacatctgttatgttgatgacacagaggtttttaaggtttgcttggactattggaactccttggttttggagcttttcgaggcacgccataatttggacaaccctgcagtggctgtaaacatgatgggactgcagatgcctttgctacatggcatggttgatggtttagggtcacaaattctgcagaggaggcagctttatgctactccaatgtccaagttgcgaatgcttatgatctgtcgtatggctaaacctgaggaggttttgatagttgaagatgaaaatggtaatattgttcgtgaaaccatgaaggataatgatgttcttgttcaatataagattatgagggaaacactaatctatttgtcacatcttgatcacgaggatactgaaaagcagatgctgaagaaattaagtaaacaactgagtggtgaagattggaattggaacaatttgaatactttatgctgggcaattggatccatatctggttccatgatggaagaacaggaaaacagatttctagtgatggtcattcgtgatctactgaatttatgtgaaatcacgaaagggaaagataacaaggctgttattgcaagtaacatcatgtatgttgttggtcagtacccaagatttctcagagctcactggaagttcttgaaaactgttgtcaataaattgtttgaatttatgcatgaaactcatcctggagtgcaggacatggcttgtgacacattcttgaaaattgtacagaaatgcaagcggaaatttgttattgtacaggttggagaaagtgagccgtttgtatctgaacttctagcaggcctaccaacaactgttgctgatcttgagccacatcagattcatacattttatgaatctgttggccatatgattcaagcagaatctgatccacagaagagagatgaatacctgcagaggttgatggatcttcctaaccagaaatgggctgaaattatcgggcaggcacgtcaaagtgtagattttctgaaggatcaagatgtgatcagaactgtccttaatataatgcagaccaatacaagtgttgcaagtgcccttgggacatactttttatcccaaatttctctaatctttttggacatgcttaacgtatacagaatgtatagtgagcttatatcaagcagtattgcagaaggagggccttatgcatctaaaacatcttatgtgaaacttttgcgatctgttaagagggagacacttaagctcattgagacatttttggacaaggccgaagaccagacacaaattgggaagcagttcgtgcccccaatgatggatcctgttcttggtgattatgctaggaatttgcctgatgctagagaatcagaagttttgtcactttttgcaacaattataaacaagtacaaagctgcaatgatagaagatgtacctagaatatttgaagctgttttccagtgtacgttggagatgataaccaaaaattttgaagattatccagaacatcgccttaagttcttctcattactccgtgccattgctacacattgtttccctgccttgattcgtttgtcaagtgagcaactgaagttagtgatggattcaatcatatgggcattccgtcatacagagaggaacatagctgagactggtctaaacctattggtggagatgctgaagaactttcaggcttcagagttctgtaatcagttctacaggtcatactttttgacaattgagcaggaaatatttgctgtcttgacagatacatttcacaaacctggttttaagttgcatgtcttggtgctgcaacacttgttttgcttggtcgagagtggtgctttgacagagcctctgtgggatgctgcaacaatctcttattcatacccaaataatgcaatgtttgttcgtgagtataccattaaacttctgggtacatcattcccaaacatgactgcatcagaggtcactcaatttgttaatggactatttgagtcaagaaacgacctgtctgcatttaagaatcacatccgagactttcttgtgcaatcaaaggaattctccgctcaggataataaagatctctacgctgaagaggctgctgctcagagggaaagagagcgacaaagaatgctttccattccagggcttattgcccctaatgaaatacaagatgagatgttagattcatagaaagcaatttttgcagcaaaagctaactttatgaaatataactcagggagttgctgtgggcatcggatatgagcagatgcaacattttccccttgattccccaaagttttcttgtttcgaaccagttagatcatgaaggtggcttggtgtgggggttataggctgctggctttactgcctttactggttgggctaggtttagagtatttaggggttgatgtaggatcatttgtacggtttgttggatccagcttaagactgtattcacatggacggatgggatcaaactgtttaaatgacacattttgcattgttgattgat

SEQ ID NO: 555 - DNA, 6312 bp, Oryza sativa
gtactttccccgcaaccccaaacaacaaggaaggaagacgctcctcccctcccatctcttaaaccccaaaaaaaccaaaataaaaatcctcctcctcctccgcctccgcttcccttcccttccccgatagaaatccatccctcccgccgccgccgccgccgccgctcctagggttccggcacctccccgaatccccccctcacttcgacccctgttcgcttcacccgccgccgccatggcggagaagctgagggatctgagccagcccatagacgtcccgctgctggacgccactgtcgccgccttctacggcaccggatctaaggaagagaggaatgccgctgatcagatactacgggatctacagaataatccagatatgtggctgcaggtggtccacattctgcagaattctcacaacttgaacaccaagttctttgccctccaagtacttgaaagtgttataaagtataggtggaatgcattgccaactgaacaacgtgatggcatcaagaattacatatctgatgttattgtccagctctccagtaatgaggcttcttttcggcaagagagactttatgttaataaactcaacattatactggtgcaggttctgaagcatgagtggccagctaggtggtcatctttcgttcctgaccttgttgctgctgcaaagagtagtgaaaccatatgcgaaaattgcatggctatattgaagcttttaagcgaagaaatttttgatttttcaagaggtgaaatgacacaacagaagattaaagaactgaagtcatcacttaacagtgaatttcgtcttattcatgagctatgtttatatgtcctatctgcaacacaaagacctgagctcatccgtgctacactggctacacttcatgctttcttatcatggataccagtgggcttcatatttgagtcacctttgctggagacattactgaagttctttcctatggctgcttatcggaaccttacactccagtgccttacagaggtcgctgctcttcagtttggtgatttttataatgtgcagtatgtgaagatgtatacgattttcatgatgcagttgcaggctattcttcctcctggaacaattcctgatgcttatgctaatggctccagtgaagaacaggcattcatacaaaatctagctctttttttcacttctttcttcaagaatcacatgcgcatattggaggcatctccagaaaatagagctgcattacttctgggccttgagtacctcattggaatttcatatgttgatgacacagaggtttttaaggtgtgtttggattactggaatgtgtttgttttagagctatttgaagcacacaatcaaatggagcctgcagcatctgtaaacatgatgggacttcaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataagattatgagggaaacactgatctacttgtctcatcttgatcatgaggatacagagcagcaaatgctgaagaaattgagtaagcaattaaatggagaagactggagttggaataacctcaatactctctgctgggcaatcggatcaatatctggttctatggtggaggaacaggaaaataggttcttggtaatggttattcgcgatttattaaatctctgtgaaatcacaaaggggaaggataataaagctgtgattgccagtaacatcatgtatgttgttggtcagtacccaagatttctcagggctcattggaagttcttgaaaacggtggttaacaaactatttgagttcatgcatgagatgcatcctggagttcaggatatggcgtgtgatacttttctgaaaattgttcagaaatgcaagcgcaaatttgtcacacaacaggtgggcgagaacgaaccatttgtttctgaactgttgtccagccttgccacgacaattggtgatcttgagccgcaccagattcatacgttttatgaatcggttggccacatgattcaagctgaatctgataacactaagagagatgaatacctcaaaagactgatgagcctccctaatcagaaatgggccgagataattggacaggcaagccaaagcattgatatcctgaagaaccaggatgttattagatctgttcttaacatcctgcagacaaacacaagtgttgctagctcacttggaccacactttttcccgcaaatttccctaatctttcttgacatgttgacagtttacagaatgtacagtgagcttgtatcaagcaccattgctgaagggggaccttttgcctcaaggacctcctttgtaaaactccttagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaaatacaaaggtgaaatgcttgaagacgtgcctcgcatatttgaggctgttttccagtgcactcttgagatgatcactaaaaactttgaagattacccggagcatcgcctcaaatttttctctttgcttcgtgcgattggcacccattgcttccaagcattaattcagctttcaagtcagcaattgaaacttgtgattgactctatcaactgggcatttagacatacagagagaaacatcgcagagactggtctcagtctattgctggaaattttaaagaactttcaggcctcaggattccaaaatcaattctacaaaacttattttttgaatattgaacaagagatctttgcagttctgacagacacattccacaagcctggtttcaagcttcatgttttggtgctgcagcacttattttgtgtggttgatggtctgacggagcctctctgggatgcatcctcagtaccataccaatatactgacaacgctatgtttgtccgagattacacaataaaacttttaggttcatcatttcccaacatgacacctactgaggttacaaaatttgttgatgggcttcttagttcaaaacatgaccttccaagcttcaaaaaccatattagggatttcctggtgcaatcaaaggagttctcggctcaggataataaggatttgtatgctgaagaggctgctgcacaaagagagagggagcgtcaacgaatgcttgccattccagggcttattgccccaagcgaattacaagatgagatgctactgcgacttttgttttacgacgcagtgtgttatgttagagatagaggtgcttggatttctccttgcatctgtatcaaagacatactcacccaagtcgtcaatcttgaaacggcggctgcgacatggagagtgatcacaacgatgctctcctcgcaatcccgtgcgcgtgctctgaacacgcggcttgcactgtcgacgacccgcaagggcgatctcagtgtcacggagtacatcggcaagatgaagacgctggctgacgagatgtcatccgccggcaagcccctcgatgacgaggagatgatgtcgtacatcctccccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccggcgcgtttcgcggccgtggcggtggtcgcggcgatcgcggaggccgggggcgaggaaacggtggcggcgcgcgcttctccaacaaaccgcgctccacctgtcagctatgtggcaagattggacatgtggtggcagactgctggtataggtatgatgaaaatttcattccagattcaaaaacagcagctgcggcttcctatggtgtagatacaaattggtacatggacaccggagccaccgaccacatcacaggagaactggacaagctgacaacccatgagaagtacaacggcaaagaacagattcacacggcaagcggtgcagccgttgataatcatgcctttgttgaagttcatcctcgtttctttgccattaaggatcaggtcacgaagaatcttcttcttagaggaccgtgccgcaatggactgtacccgttgccaacatcttcattggccacatccaagcaagtccttggtgccatcaagcccacaatgtcaaggtggcatagccgtctaggtcatccttctctagctattgttcagaaagttgttagtagcaataatctcccatgtttaggagatgtcaatgagtcaggagtctgtaatgcctgccaacaggccaagagtcaccagctaccctatccaaaatcctttagtgtgtcaaataatcctctagaacttgtgttttcagatgtgtggggacctgctcctacttctgttgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaatcgcacacctagtaagcagggggagcagtcgcatgcagccacgtcgccaagcagccatcatgatggggggagcgacagccctctgaccggcggatcgtctgcacccgacacagccgtggtcgagcccgcacggccggtcactcatctccagcgaggtataagaaaacagaaggtttatactgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggggatggtgccttcgccaactagatgtgcaaaatgcttttctgcatggataccttgaagaagagatagaaggcagtatctgctttgctggcagatttgagtcaagaatttgcactcaaagatttgggggatctgcattacttccttggaatagagaaaaactgtcagctcatagtggaactgctctaggagaaacagatgcaactagatacagaagtatagttggagctcttcagtatctgactttgactaggcctgatatttcatttgcagtaaataaggtctgtcagtttttacatagtccaactatagatcattggatggcagtgaagaggatattaagatatgtgaaattctcagttgatcttggtcttaagataagtcgttcatcatccactcttgttagtgcttttttagatgctgattgggcaggatcaattgatgacagaagatcaactggaggttttgctgtgtttctggggtctaatttggtttcctggagtgcaagaaaacaggctacagtatcaagatcaagtacagaagctgaatacaaagctgttgcaaatgcaacggcagaggtaatgtgggttcaggctctacttaaagagctaggaataaattcacctgaaactgcatgtatgtggtgtgataatctgggagctacttacttggctgttaatcctgtgtttcatgcacgaactaaacatattgagatagactatcattttgtcagagagagggttgccagaaagcaattagaaatcaagtttatatcttcaggtgatcaagttgcagatgggtttactaaacctctcggtgctccacaacttaggaatttcagatacaatcttaacttagataagttatga

SEQ ID NO: 556 - DNA, 3878 bp, Solanum phureja
aagctgtctctctgtttatgttttctccccttttggcctctttctagaaactcatgttttttacaaaatccacatctttgaaaacacctttttaacaattgaggcgctcactttttctttgcttagggttttcattctcgtttctagggttttactgctttgcttgtgattacttctagggtttatcactctgttcgttcgtccgttctcaccatggcggcggagaagctgagagatttgagccagcccattgatgtttcgttgcttgacgctactgttgctgctttctatggcaccggatctaaggaagagagagctgcagcggaccatattttgcgcgatttgcaaaataacccagatatgtggcttcaagtggttcacattctatcgagcacacaaagcctgaatactaagtttttcgctttgcaggttctagaaggtgtaataaagtatagatggaatgcattgcctgtcgaacaacgagatggaatgaaaaactatatttctgaagttattgtgaagctttccagtgatgaagcatctctccggcgggaaaggctgtatattagcaagcttaacataattttggttcagattttgaagcacgagtggcctgcaagatggcgaagcttcattcctgacttagttgcggctgcaaagacaagcgaaacaatatgtgaaaactgcatggcgatattgaagcttctaagcgaggaggttttcgatttctcaaggggtgaaatgactcaacaaaagatcaaggagctcaaacaatctttaaacagcgagtttcaactcatccatgagctatgcttgtatgtgctatcagtatcccacagaactgagctcatcagggctacgcttgctacacttcatgctttcctttcatggattccgcttggctatatttttgaatcaacactgttggaaatattgcttaaatttttccccatgccatcttatcgcaatctcacacttcagtgtctaacagaggttgctgcccttaattttggggatttttataacgaacagtatgtcaagatgtacaccatattcatggggcagttgcagagtgttcttccagttaatacaaacattccagaggcgtatgcaaatggaagcaacgaagagcaggtttgtttgagacacattgtctcttacaagctactttgtatgcagtctcatatacgtgtgctagaatcatcacaagagaatataagtgccctcttgttggggcttgagtacgttattaatatctcgtatgtggatgatacagaggtttttaaggtttgcttggactactggaattccttagttcttgagctgtttgaagcagcacatcataatcttgataatcctgcaatgactgcaaacctgatggggcttcagatgccactgctttctggcatgaatgatggtcttggagcgcaacttatgcagaggagacaactttattctggtccaatgtcaaagttgaggttacttatgatatctcgcatggcaaaacctgaagaagttctcattgtcgaagatgaaaatggaaacattgtccgtgaaacaatgaaggacaatgacgtccttgtgcaatacaagatcatgagggaaactctgatctacttgtcacatcttgatcatgacgatactgaaaagcagatgctgaagaaacttagcaaccaactcaatggcgaggactggtcgtggaacaatctaaatacattatgttgggcaattggttccatatctgggtcgatggtggaagagcaggagaacagattccttgtcatggtgatacgcgatttgcttaacctatgtgaaatcacgaaaggaaaagacaacaaggccgtaattgcaagcaatataatgtatgttgttgggcaatatcctagatttttgagagctcattggaagttcttgaagactgttgtgaacaaattgttcgagttcatgcatgaaacacatcctggagtgcaggatatggcctgtgatacgtttttgaaaattgttcagaaatgcaaacgcaagttcgttgtagtccaggttggagaaaatgagccatttgtttcagaacttttaaccactcttcccacaaccattgcagatttagaacctcatcagattcataccttctacgaatctgttggtcaaatgattcaagcagaacctgatccccaaaaaagagatgagtatctgcagaggttgatggagcttccaaatcagagatggaatgaaattataggacaagcacgacaaagtgtggactacctgaaagatcaagatgttattcgagctgttctaaatatattgcagacaaatactagtgctgctagctcacttggaacttatttcttacctcaaattactctgatcttcttggacatgctcaatgtttatagaatgtacagtgagcttatatctacaagcatcgcacaaggagggccctatgcctcaaggacatccattgtgaaactcttgcgctcggtaaaaagggaaacattaaagcttattgaaacatttttggacaaggctgaagatcaaccacacatcgggaaacaatttgtgccgccaatgatggacccagttttaggagactatgcaaggaatgtgcctgatgctagggaatctgaagttctgtctctttttgctacaattataaacaagtacaagggtgctatgattgaggatgtccctcgaatatttgaagctgctttccagtgtactctggagatgatcacaaagaactttgaagattatccggagcatcggctcaagttcttctcattacttcgtgcaattgctacacactgttttgctgctttaatacggctgtcgagtgagcaattaaaacttgtcatggattctataatatgggcttttcggcacactgagaggaacattgctgaaactgggcttaatcttttgctggcaatgctgaaaaattttcagaattctgagttcgctaaccagttttataggacttactatttgacgatcgagcaagaaatttttgctgttttgacagacacgtttcataagcctgggtttaaattgcatgtattggtgctacagcatttattttgcatggtagctatgttgtctgagccgctatgggatgcatcgacagtgcctgtttcatatccaaataatgttgaatttgttcgcgaatacaccattaagcttcttagtacatccttccccaacatgacctctgctgaagtgactcaatttgtcagtgggctatttgattcaacaaatgaccttcccacattcaagaatcacataagggacttccttgtgcaatcgaaagagttctctgctcaggacaataaggacctctatgccgaggaagcagctgctcagagagagagggaacgtcagcggatgcgttctattcctggtctaattgcacccaacgagatacaagatgaaatggtggattcatgagattcagattcacatatacccgtttatacccctgaaggcggtgtgggtgcttggagtgtttaaatcacaaactttagtggccagcacatcctattttttttttttcaagttctgttgtgttgcaaaaattctcacattagtactgaaagtgatctctcggtcttgtggcagtgattcaaggaaagtgttggctgggtctaggtagttagatcctaatctaggaatacaacatgtgtatggacattcatggtttcattttcgatactgtagttggctagaggaattgatggattatttagttgacctcgacatctgccatcgagagtaggtttattaatgtatacaggcattggccggttgtgcagtaatcatttttggtttttggtggacaacggcagtgtatttttacacaatatgcagaagtatatttttagtta

SEQ ID NO: 557 - DNA, 3945 bp, Sorghum bicolor
gccgctatggcggagaagctcagggatctgagccagccgatagacgtgacgctcctcgacgccacggtcgccgccttctacggcaccggatctaaggaggagaggagcgccgctgatcagatactacgtgatctacaaaataacccagacatgtggctacaagttgtgcacattctgcagaattcccagaatctcaacaccaagttctttgcactgcaagtacttgaaagtgttatcaagtacaggtggaatgcattgcctgttgaacaacgtgatggcataaagaattacatatccgatgttattgtgcagctttccagcaatgaagttacctttcgtcaggagaggctttacgtcaataaactcaatattattttggtgcagcttctaagcgaagaaatttttgacttctcaagaggtgaaatgacacaacaaaagatcaaagaactgaagtcttcacttaatagtgaattccggctcattcatgagctatgtttgtatgtcctatctgcaacgcaaaggccagagctcatccgtgctacattggcgacactccatgctttcttatcatggatccccgttggattcatcttcgagtcaccattgctggagacattactgaagttcttccctatggctgcttatcggaatcttacacttcaatgcctgacagaggtcgcagctcttcaatttggtgatttttataatgtgcagtatgtgaagatgtatacatttttcatgattcagttgcaggctattctccctcctgaaaaaatcccagacgcatatgctaatggttccactgaagagcaggcgtttatacaaaatctcgcactcttcttcacatccttctttaagaatcacatgcgtatactggaaataactcaagaaaatgctgctgctttgcttatgggtctcgagtaccttattggaatttcatatgttgatgatacagaggtttttaaggtctgcttggattactggaatgtgtttgtcttagagttatttgaagcacacaaccaaatggaacctgcagcaactgtaagcatgatggggcttcaggcacagatggttcctggaatggtagatgggaccggcactgctgttcaacagaggagacagctttactctggtccactctcaaaactacggatgctgatgatttgtcgaatggcaaagcctgaggaagtacttattgttgaagacgaaaatggcaatattgtacgtgagacaatgaaggacaacgatgttcttgttcagtacaagatcatgagggaaacattgatctatttatctcatcttgatcatgaggatacagagcaacagatgttgaagaaactaagcaagcaattaaatggagaagactggagttggaataatcttaatactctctgttgggccattggatcaatatcaggctctatggtagaggagcaggagaatagatttctggttatggttatccgtgatttgctaaacctctgtgaaatcacaaagggaaaagacaataaagctgtgattgcaagtaacatcatgtatgttgttggtcagtatccaagatttctcagagctcattggaagtttttgaaaaccgtggtcaacaaattgtttgagttcatgcatgagatgcatcctggagttcaggatatggcatgtgataccttcttgaaaattgttcaaaaatgcaagcgcaaatttgtgacgcaacaggtgggcgagaatgaaccatttgtttctgaacttctgtccaaccttgctacaacaattgctgatcttgagccacatcagattcacacgttttacgaatcagttggccatatgattcaagctgaatctgacaacactaagagggatgaatacctcaagagattgatgagccttcctaatcagaagtgggcagaaataattggacaggcaagccaaagcattgatatcctgaagaaccaagatgttatcagatcagttctcaacatcctacagacaaacacaagtgttgcgagttcccttgggccacacttcttcccacagatttcgctaattttcttggacatgcttacagtctacagaatgtacagcgagcttgtatcaagcacgattgctgaaggaggaccctttgcctcaaggacatcatttgtaaaactcttgagatctgtcaagagggaaaccctaaagttgatcgagacttttgtggataaggcagaagatttaccacatataggaaagcagtttgttccaccaatgatggatcccgtacttggtgattatgctagaaatgtacctgatgcaagggagtctgaagttctgtcgttgtttgcaacaatcattaacaagtacaaaggggaaatgcttgaggatgtacctcgtatatttgaggctgttttccagtgcactcttgagatgattactaagaactttgaagattatcctgagcaccgcctcaaatttttttctttgcttcgcgcaattggtactcattgcttccaagcattaatccagctttcaagtccgcaattgaagctcgtgattgattcgattaattgggcattcagacatacagagagaaatattgcagagactggccttagtctattgttggaaattttgaaaaattttcaggcttcaggattccaaaatcaattctacaaaacttactttttaacaattgagcaagagatttttgcagttctcacagacacattccacaaacctggtttcaagctccatgttttggtgctgcaacacttattttgtgtggttgatggtctaacggagcctctatgggatgcttcttcagtaccatatcaatatacagacaatgccatgtttgttcgagattacaccataaaactcttaggaacatcattccctaacatgacagtaaccgaggtgaccaagtttgtagatggccttcttagttcaaaacatgatcttccaagtttcaaaaaccatattagagacttcctggtgcagtcgaaggagttctcagctcaggataacaaggatctatacgcggaagaggctgctgcccaaagagaaagggagcgccaacgaatgcttgccattccagggctcattgcccctagcgaattgcaagacgagatggtagattcatagtgtttcttgtcgattcagctttcgctaatgtagcttcctgtttgttggtctggcctcggaatgcctctggagccctcgacttccaagtgcccgagttttcttacagggtggtgaaagaaggtgcctgctgtaattttatttttggttacctccacatgacgctgattccaagatttgtggtagtagacttgggaacggactagtcagttttgccgcaggaggtgtctgggactgttgctgggtctcagcagctgtgcttgactggatgtgttagcagcggctcttgtgctcagtgtatttggctaacattggtgcgtgtgctttgcccatgatatatcgtggtacagcattgtatgcttctttagttgaagtttatagatggatggagatttctgtatccggacactatccaaagctgataggaaccttgttatatctgtagtttactattctgtgagatgtctcatacacattccccacacctcttccctattttttgggtgcatttgaatgtgtagattttctgtatcttaaagcttgggtggatcgtgtatgtgtgcctcagccagttgtctgaagcacatctgaaaaaggtattactgaaggaatgtatgcttttttttttttgaggagtgaatagatagctactgtttcttgttttgttagcaccctggtgcggttattatggtgatcttgtttgtgataacatagtccttgtttagatccatttgtttttggatttggacactagcacattcgtttgtatttggtaattattgctcaaccatgaactgatttgtttcgtaaattataagcaaattgtgtaattaa

SEQ ID NO: 558 - DNA, 3666 bp, Sorghum bicolor
ccccgagctcgccgccgcggacgccatggcggcggagaagctgcgggatcttagccagcccattgacgtgcggctgctcgacgccaccgtctcagcgttctatggcaccggctccagagaggagaggcatgcggcagatcaaatcttgcgggagctgcagaataatccagatatgtggctacaagtggttcacattctgcagaactcccaaaatttgaataccaagttctttgctctccaagtacttgaaaatgttatcaaatataaatggaacgctttgccagtggaacaacgtgatggtatgaagaattatatatctgatgtcattgttcagctctcaagcaacgaggtttcctttcgacaagagagactttatgtcaataagctcaacattattctggtgcaggttttaaagcatgagtggcctgccaggtggacaaccttcatccctgaccttattgcagcagcaaggagtagtgaaacaatatgcgagaattgtatggcaatactgaagctgttgagtgaagaaatttttgatttctcaagaggggaaatgacccaacaaaagatcaaagagctaaagacttcactaaatagtgaatttcgtcttattcatgagctctgcttatatgtcctgtctgtgtcacaaagacctgaacttgttcgtgctacattggccacacttcatgcttttctgtcatggatccccatcagtttcatatttgaatcacctctgctggagacacttttgaagtttttccctgttgctgcttaccggaatcttacacttcaatgcctaacagaggttgctgctcttcattttggtgatttctatgacatgcaatatgtcaagatgtatgaagtctttatgttgcagctccaggctattcttccttgtggaacaatttcagatggctatgccaatggttctaatgaagaacaggcatttatccaaaatcttgcacttcttttgacatccttctttaagaaccacatgcgcatactggaaaagactcctgaaaatagagctgcattgcttttgggccttgactacctccttgaaatttcatttgtcgatgacacagagatgtttaaggtctgcttggattactggaatctgtttgttttagaattatttgaaacatacaaccaagtggagcgattgatggaacttcagactcagcggattcctggaactgatgatggtacgctcatagctgttcaacagaggaggcaactttatgcaagatcactttcgaagttaagaacgttaatgatctgtcggatggcaaagccagaggaggttttgattgttgaagatgagaatgggaatattgtacgagaaacattgaaagataatgatgtccttgttcagtacaagatcatgagggaaacactaatatacttgtcacatcttgatcacgaagatacagaacagcagatgttgaggaaattaagcaagcaattaaatggtgaagactggagctggaataacttaaatactctatgctgggcaattggatccatttctggttctatggtggaggaacaggaaaacaggtttttagttttggttattcgtgatttgttgaatctttgtgagattatgaaagggaaagataacaaagctgtaatagcaagtaatattatgtatgttgtggggcaatacccaaggtttctaagggcgcactggaagtttttaaaaacagtggtcaacaaattatttgagttcatgcacgagacgcatcctggagttcaggatatggcatgtgacacattcctgaaaattgttcagaagtgcaagcgcaagtttgtgacactccaggtcggtgagaatgaaccatttgtttctgtgctgctgtccaaccttcctaccacaatagcagatcttgagcctcatcagatccatacattctatgaatcggttggtcagatgattcaagccgaatctgacaatactaagagggaggagtatctcaagagattgatgagcctacctaatcagaaatgggttgaaataattggggaggctggccgaagcactgatattttgaaaaaccaagatgtcataagatctgttctgaacatcttacagacgaacacaggtgttgcatgctcacttggaccttattttttcccacaaatttcagtaatcttcctggacatgttgacagtgtatagaatgtacagtgaactggtgtcaaacactatttctgaaggagggccttttgcttcaaagacatcatttgtaaaacttctgagatcagtaaagagggagacattaaaattgatcgagacttttctggacaaagctgaagatttaccacacttgggaaaacagtttgttcctccaatgatggatcctgttctaggtgattatgctagaaatgtgcctgatgcaagagaatctgaagttttgtcattatttgcgataattataaacaagtacaaaggtgagatgcttgaggaagttcctcgcatctttgaggctgttttccagtgtactcttgagatgatcaccaaaaactttgaagactatcctgagcatcgccttaaattcttttccttgcttcgtgcaattggtacacattgtttccaagcttttattcagctctctagtcagcaactaaagcttgttatggattccataagttgggcatttcgacatacagagagaaatattgctgagaccggtctaagcctgttattggaaattttgaagaacttcgaggcttcagggttccaaaatcagttctacaagacatacttcttaaatatcgagcaggagatatttgcagtgctcacagacacattccacaaacctggtttcaagcttcacgtttctgtgcttcaacatttgttctatgtggttgatggtctaacggagcctctctgggatgcctcagcagttccttctcaattcataaataatgcaatgtttgttcgagactacactattaaacttctcagctcatcctttcctaacatgacgcctgtagaggtagcaaagtttgttgatggactttttagttcaaaaactgatcctccaaattttaagaaccatataagggattttcttgttcaatcgaaggagttctctgcccaggataacaaggatctatatgctgaagaggctgctgctcagagggaaaaggaacgccaacgtatgctttccattccagggctcatcgccccgaatgaattgcaggatgagatggtggattcatagtgctaccttagtatgacattcaatgtcttgcttcacttctggagcccttgtgttgaaggcccaattgtttttctagggtgatgaaagaagtgctccgtttagttttaacattcttcatagttacactactggttcaggggtttctgaagtagatagttgaaggatttagttgtctgagctgtttcagactgccagtggtatattggggggaggtcttgggttcaatgtatttagcttggagtgttgtttgtgccacactaattatttacagtatgatgaagcctcgatggcaccacatgccaagtgtggcttcattttcttttcttatacataatagaatgatttccttttactgtagtgtcttggtaatcatgttgaaatcattgtacactatgtaagtttattactgcgagaactgttttcttgttccattgcgt

SEQ ID NO: 559 - DNA, 3224 bp, Glycine max
ccatggccgccgagaagctcagagatttaagccaacccattgatgtgcctttactcgatgccactgtcgctgccttctatggcaccggatccaaggaacagagaactgctgccgatcagattttgcgcgatttgaaaaataatccagacacgtggcttcaagtcatgcatattttgcagaacactcaaagcctaaataccaagttctttgccttgcaggttctagaaggtgtaattaaatatagatggaatgcattacctgttgaccagcgagatggaatgaaaaatttcatctctgatgttattgtacagctttctggtaatgaggcctcatttcgaacagaccggttgtatgtcaacaaactcaatattatattagttcagattttgaagcatgaatggccagtgagatggagaagcttcattcctgaccttgtttcagcagctaaaactagtgaaacaatttgcgagaattgtatggcaatattgaagctcttgagtgaagaggtttttgatttttcaagaggagagatgactcagcagaagataaaagagcttaaacactcattgaatagtgaatttcagctcatacatgagttgtgcttatatgtgctatcagcgtcccaacggactgagctcatacgggcaacactgtctacattgtatgcattcctatcatggattcctttgggatatatatttgaatcaccattgctcaagacactgctaaaatttttcccaattcctgcatatcggaacctgactttgcaatgtttaactgaggtagcagcccttcaatttgggaattactatgatgcccatattaagatgtataatatattcatgggtcagttgcagaccatacttccgcccactactaatatacccgaggcatattcacatggttcaagtgaggaacaagcatttatacagaatttggcactgttcttcacctcattttacaaggcaggttcacgttcgaattctggaatccactcaagagaatatatctgctttgctattgggtcttgaatatcttattaatatctcatatgtggatgatactgaggttttcaaggtctgtttggactactggaatgtcttggtttcagaattgtttgagccaaaccgtagcttggaaaaccctgcagcagcaaacatgataggacttcaggtgcctggtatgattgatggcattggttcacagcttcttcagcaccggcagctttatgccggtcccatgtcaaagttgagaatgcttatgatctgtcgtatggccaaaccagaagaggttctcatagttgaagatgaaaatggtaatatagtccgtgaaacaatgaaggacaatgatgttcttgttcaatacaagattatgagggagactcttatttacttgtcacatcttgaccatgatgatactgaaaagcagatgctgagaaagttaagtaaacaacttagtggtgaggactggacatggaacaatttgaacacactgtgctgggcaataggatctatatctggttccatggtggaagaacaggaaaatagatttttggttatggtcattcgtgatttattaaatctatgtgaaatcacaaagggaaaagataacaaagctgttattgcaagtaatatcatgtatgttgtggggcagtatccccggtttttaagagctcattggaagtttctaaaaactgttgtgaacaagttgtttgagtttatgcatgagtcacatcctggagttcaggatatggcctgcaacacatttctgaaaatagtccagaagtgcaagcgtaaatttgtaatcacccaggttggagaaaatgagccatttgtttctgaacttctatctggccttccaaatacaattgcagatcttgaaccccatcaaataaacacgttctatgaatctgttggtaacatgattcaagcagagtctgatgcccagaagagagatgaatatcttcaaaagttgatggtgctcccaaaccagagatggatggaaattatagggaaggcacatcaaaatgctgattttctgaaggatcaagatgtaatccgaaatgtgcttaatatattgcagacgaatacgagtgttgcatcttctttaggaacatatttcctgccacagatcacattgatctttttggacatgttgaatgtgtacagaatgtttagtgagcttatatcaaaaagtattgcagaagggggaccttttgcatctagaacatcctatgtgaaacttctacgttcggttaagagagaaacacttaaactagttgagacattcttggacaaggctgaagatcaaccacaaattggaaaacaatttgtgccaccaatgatggatcctgttctaggagattatgccagaaatgtgcctgatgcgagggaatcagaggttttgtcacttttttccacaattgtaaacaaatataaagctgccatggttgaagatgtcccacaaatatttgaagctgtattccagtgtacactggagatgattacaaaaaattttgaagattacccagagcatcggctaaaattcttctctttactgcgtgccatagctactcattgtttccctgctttgatctgcttgtcaagtcagcaactgaaacttgttatggattcaataatatgggcgtttcggcatacagaaaggaatattgctgaaactgggctgaacctcttgttggagatgctgaagaagtttcaggaatcagagttctgtaatcagttttatcgaacatactttttgacaattgagcaagagatatttgctgtcttgacagacacttttcataagcctgggttcaaatttcatgtcttggtgcttcaacatttgttctgtctggcagaaactggtgccctaactgagcctctttgggatgctgctacaaatccttattcatacccaagtaatgcagcttttgtacgcgagtttacgataaaccttttaagcacttcatttccaaacatgactgcttcagaggttactcaatttgttaatggcctttttgagtccaccaatgacctccccacatttgaaacccacatacgagattttcttgtacaatccaaagaattttcagctcaggataacaaagatctttatgctgaagaggctgcagctcagagagagagggaacgacaaagaatgctttctattccaggacttgttgccccgagcgagttgcaagatgaaatggttgactcatagat

SEQ ID NO: 560 - DNA, 3674 bp, Glycine max
agaaatgccgccgatcagattctgcgggacttgcaaaataatccagatatgtggcttcaagtcatgcatattttgcaaaatactcaaaacctgaataccaagttcttcgccttacaggttctagaaggcgtaattaaatatagatggaatgcattacctgttgagcagcgagatggaatgaaaaatttcatatctgatgttattgtacagctttctagcaatgaggcttcatttcgagcggaaaggttgtatgtcaacaaactcaatattatattagttcagattttgaagcatgagtggccagcaagatggcgaagctttattcctgaccttgtttcagctgctaaaactagtgaaacaatttgtgagaattgtatggctatattgaaacttttgagtgaagaggtttttgatttttcaagaggagagatgactcagcagaagataaaagagcttaaacaatcattgaacagtgaatttcaactcatacatgagttatgcttatatgtgttatcggcatcccaaaggactgagctcatacgagctactctatctacattgcatgccttcttatcatggattcccttgggttatatatttgaatcacccttgcttgagacactcctaaaatttttccctgtcccagcataccggaacctcaccttgcaatgtttaactgaggtggcagcccttcaatttgtgaattattatgatgtgcagtatgtcaagatgtataacatattcatggtccagttgcagggaatactcccgccaactacaaatatacctgaggcatatggacagggttcaagtgaggaacaagcatttatacagaatctggcactgttcttcacttcattttacaaggcaagtcttattttttcttttcacattcgcatcctggaatccactcaagagaatatagctgctttgctagtgggccttgaatatgtgatcaacatttcatatgtggatgatactgaggttttcaaggtctgtttggactactggaattccttggtatcggagctgtttgaaccacaccgaagtttggataatcctgcagctgctgcaaccatgatgggacttcaggtaccagcaatgctccctggtatggttgatggacatggttctcagctccttcagcgccggcagctttatgctggtcccatgtcaaagttaagaatgcttatgatctgtcgaatggctaagcctgaggaggtgctcatagttgaagatgaaaatgggaacattgtccgtgaaaccttgaaggacaatgatgttcttgttcaatataagattatgagggagactcttatttacttgtcacatcttgaccatgatgatactgaaaagcagatgttgaggaaattaagtaaacaactaagtggtgaggattggacatggaacaatttgaatacactctgctgggcaattggttctatatcaggttccatgatggaagaacaggaaaacagattcttggttatggtcattcgcgatttattaaacctatgtgaaatcacaaagggaaaagataacaaagctgttattgcgagtaatatcatgtatgttgttgggcagtatccacggtttttaagagctcattggaagttccttaaaactgttgtgaacaagttgtttgagtttatgcatgagacacatcctggagttcaggatatggcctgtgacacatttctgaaaatagtccagaagtgcaagcgaaaatttgtaatcacccaggttggggaaaacgagccatttgtgtctgagcttctgacaggccttcccatcactattgcagatcttgaaccccatcagatacattccttctatgaatctgttggtcacatgattcaggcagagtctgatgcacagaagagagatgaatatcttcagcggttgatggagctcccaaatcagaaatggatggaaattattgggcaggcacatcaaaatgttgattttttgaaggatcaggatgtaatccggacagttcttaatataatgcagacgaatacaagtgttgcaacttctttagggacatatttcttgccccaaatctcgttgatctttttggacatgttgaatgtgtacagaatgtacagtgagcttatttcaaagagtattacagaaggtggaccttttgcatctagaacatcctatgtcaaacttctacgttcggttaagagggagacacttaagctgattgagacattcttggataaggcagaagaccagccacaaatcggcaaacaatttgtgccgccaatgatggatcctgttcttggagattactccaggaatgttcctgatgcaagggaatcagaggttttgtcactttttgcaacaattgttaacaaatataaagctgcaatgattgaagatgtacctcgcatatttgaagctgtttttcagtgcacacttgagatgattacaaaaaattttgaagattacccagagcatcggctcaagttcttctctctactccgtgccatagctactcattgttttcctgcattaatctgcttgtcaagtcagcaactgaagcttgttatggactcaatcatatgggcatttcggcatacagaaaggaatattgctgaaactgggcttaacctgttgttggagatgctgaagaagtttcagggctcagagttctgtaatcagttttatcggacatactttttgacaattgaacaagagatatttgccgtcttgactgacacttttcataaacctggattcaaattacatgtcttggtgctacagcatttgttctgtttgctagaaactggtgctctaactgaacctctttgggatgttgctacaagtcaatattcatactcaagtaatgctgtgtttgtacgtgagtttaccataaaacttctaagcacttcatttcccaacatgacatcagcagaggttacccaatttgttaatggactatttgagtccaccaatgatctttccacctttaaaaatcacatacgagattttcttattcagtcaaaagaattttcagctcaggataacaaagatctatatgcagaagaggctgcagctcagagagagagagaacgacaaagaatgctttctattccagggcttattgccccaagcgaattgcaagatgaaatggtggactcatagataggctaaacagtggtgggcattttaacttgtttcacaggctttgattcaatccattgccaggtcctttaagaagagatgcagcgtttttctccaacattagtttcccccctcttcccaatattttaagttgggactggtttggcagttcctgatttcagaattttcgctggccggggatactgccttgtccgttgggtgagtgtagattattcaattactaattggggctgataatatttgtaagggattcatgaaggcatctttatatagaatcgcaggatggaagactcgttcctgagtattgatgactccttaggtgacacctccttaacctcgggcggtttgtgcagaaaacccttgtggtttgatattttgtattttttccctcaccaattaatttttagggatattgatgtacaatgagcgcacttaatatatggtttcgtgaactggtgtgctatataatgtgttcatttcctcccaatagttttttttaatgcttctgctctcagttttaa

SEQ ID NO: 561 - DNA, 3940 bp, Solanum lycopersicum
aagctgtctctctgtttatgtttttctccccttttggcctctttctagaaactcatgttttttttttacaaaatccacatctttgaaaacacctttttaacaattgaggcgctcactttttctttctctgcttagggttttccttctcgtttctagggttttactgctttgcttctgatttcttctagggtttatcactcactctgttcgttccttcgttctcaacatggcggcggagaagctgagagatttgagtcagcccattgatgtttcgttgcttgacgctactgttgctgctttctatggaaccggatctaaggaagagagagctgcagcggaccatattttgcgtgatttgcaaaataacccagatatgtggcttcaagtggttcacattctatcgagcacacaaagcctgaatactaagttttttgctttgcaggttcttgagggtgttattaagtatagatggaatgcattgcctgtcgagcaacgagatggaatgaaaaactatatttctgaagttattgtcaagctttccagtgatgaagcatctctccggcgggaaaggctgtatattagcaagctaaacataattttggttcagattttgaagcacgagtggcctgcaagatggcgaagcttcattcccgacttagttgcggctgcaaagacaagcgaaacaatatgtgaaaactgcatggcaatattgaagcttctcagcgaggaggttttcgatttctcaaggggtgaaatgactcaacaaaagatcaaggagctcaaacaatctttaaacagcgagtttcaactcatccatgagctatgcttgtatgtgctatcagtatcccacagaactgagctcatcagggcgacgcttgctacactgcatgctttcctttcatggattccgcttggctatatttttgaatcaacactgttggaaatactgcttaaatttttcccattgccatcttatcgcaatctcacacttcagtgtctaacagaggttgctgcccttaattttggggatttttataatgaacagtatatcaagatgtacaccatattcatggggcagttgcagagtgttcttccacctaatacaagcattccagaggcctatgcaaatggaagtaacgaagaacaggtttgtctgagacacgttcttctcttactagctactttgtatgcagtctcatatacgtgtgctagaatcatcacaagagaatataggtgccctcttggtgggacttgagtatcttattaatatctcttatgtggatgatacagaagtttttaaggtttgcttggactactggaattccttagttcttgagctgtttgaagcagcacatcataatcttgataatcctgcaatgactacaaacatgatgggccttcagatgccactgctttctggcatgaatgatggtcttggagcacaacttatgcagaggagacagctttattctggtccaatgtccaagttgaggttacttatgatatcacgcatggcaaaacctgaagaagttctcattgtcgaagatgaaaatgggaacattgtccgtgaaacaatgaaggacaatgacgtccttgtgcaatacaagatcatgagggaaactctgatctacttgtcacatcttgaccatgacgatactgaaaagcagatgctgaagaaacttagtaaccaactcaatggtgaggattggtcatggaacaatctaaatacattatgttgggcaattggttctatatccgggtcgatggtggaggagcaggagaacagatttcttgtcatggtgatacgcgatttgctgaacctatgtgaaatcacgaaaggaaaagacaacaaggctgtaattgctagcaatataatgtatgttgttgggcaatatcctagatttttgagagcccattggaagttcttgaagactgttgtgaacaaattgttcgagttcatgcatgaaacacatcctggagtgcaggatatggcctgtgatacgtttttgaaaattgttcaaaaatgcaagcgcaagttcgttgtagtccaggttggagaaaacgagccatttgtttctgaacttttaaccactcttcccacaactattgcagatttagaacctcatcagattcataccttctacgaatctgttggtcaaatgattcaagcagaacctgatccccaaaaaagagacgagtatctgcagaggttgatggagcttccaaatcagagatggaatgaaattattggacaagcacgacaaagtgtggactacctgaaagatcaagacgttattcgtgctgttctaaatatattgcagacaaatactagtgctgctagctcacttggaacttatttcttacctcaaatttctctgatcttcttggacatgctcaatgtctatagaatgtacagtgagcttatatctacaagcatcgcacaaggcggcccctatgcctcaaggacatccattgtgaaactcttgcgctcggtaaaaagggaaacacttaagcttattgaaacatttttggacaaggctgaagatcaatcacacattgggaaacaatttgtgccgccaatgatggacccagttttaggtgactatgcaaggaatgtgcctgatgctagggaatctgaagttctctccctttttgctacaattataaacaagtacaagggggcaatgattgaggatgtccctcgaatatttgaagctgctttccagtgtactctggagatgatcacaaaaaactttgaagattatccggagcatcgactcaagttcttttcattacttcgtgcaattgctacacattgttttgctgctttgataaggctgtcgagtgagcaattgaaacttgtcatggattctataatatgggcttttcggcacactgagaggaacattgctgaaaccgggcttaatcttttgttggcaatgctgaaaaattttcagaattctgagtttgctaaccagttttataggacttactatttgacgatcgagcaagaaatttttgctgttctgacagatacttttcataagcctgggtttaaattgcatgtattggtgctacagcacttattttgcatggtagttatgttgtctgagcctctatgggatgcttctactgtgccttgttcatatccaaataatgttgagtttgttcgcgaatacaccattaagcttcttagtacatccttccccaacatgaccgctgctgaagtgactcaatttgtcagtgggctatttgattcaacaaatgaccttccaacattcaagaatcacataagggacttccttgtgcaatcaaaagagttctctgctcaggacaataaggacctttatgccgaggaagcagctgctcagagagagagggaacgtcagcggatgcgttctattcctggtctaattgcacccaatgagatccaagatgaaatggtggattcatgagatccacaatgttcacatatacccgtttgtaccctgaaggtgatgtgggtgcttggagtgtttaatcacaaactttagtggccagcatatcctcatcttttctttttttttaaagttccgttgtgttgcaaaaattctcacattagtactgagtgatctctcggtcttgtggcagtgattcaagggaagtgttggctgggtctaggtagttagatcctaatctaggaatacaacatgtgtatggtccattcatggtttcattttcgatactgtagttggctagaggaattgatggatttatttagttgacctcgatatctgccatcgagagtaggtttattaatgtatacaggcattggccggttgtgcagtaatcatttttggtttttggtggaaacggcagtgtatttttacacaatatgcagaagtgtatttttacacaatatgcagaagtatgaatttttactagttgctttattactggt

SEQ ID NO: 562 - DNA, 803 bp, Lolium multiflorum
ccaccgttccacgtctccctcccttggactcacgaaaatggcgaacccttctcaatcccgcgtcgccctcctcctcccagtcgcggccctcctcgcggcggccctcctcctcccgctcgcccgctccgacgccgacgccggatccaaccccaccaccgcgtacgacgagctccgcctccgcggcttcccgcggggcctgctcccggccaacgtccgcggctacacgctcgacgccggctcgggggacttcgccgtagacctcgtctccagctgccgcatcgtgcttcccgcggggagctacctcgccaacttcaacgaccgcctcaccggccacctcgacgacggtcgcatctccgggctcagcggcatcagcgtcaaggccttcttccgctggtggtcaatcaccgggatccgcgccgatggggacgagctcgtcttcgaggtgggctccgtctccgccaaattccccgctcgccacttcaacgccagcctcgaatgccccgccaaggccgactcttagtagtactacaacaaggcacccttgcatgtctcatgatattggcatgatcaagccgcctcgacatcaagcaccattatagttttcaatctcttcgcgttgtttgtaaaactgcctctgtatataagtctgaatcgctaagacaaccactccactctccacacgaagaaagcgcaataatgtaaccggttatctcaccggattgttcgtcggtcatagccctgggaactggtaacggttattgtttcagttcgtaatatatatgacttccggtgcaaaaaaaaaa

SEQ ID NO: 563 - DNA, 503 bp, Antirrhinum majus
  misc_feature (469)..(470): n is a, c, g, or t
  misc_feature (472)..(472): n is a, c, g, or t
  misc_feature (477)..(478): n is a, c, g, or t
  misc_feature (487)..(487): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (497)..(499): n is a, c, g, or t
gaaaaacgaacagaacaaatcgatcaaaaaaatcgtcaaaaaatggatgctctcgatacagttttcgatccgttgagagatttcgcaaaggacagcgttcgtctggttaagcgttgccacaagccagatcgcaaagaattcacgaaagtggcgactcgaacggcgatcgggttcgttgtgatgggattcgttggctttttcgtcaaattgatttttatcccgatcaacaacatcattgttggtgctacttaattttgtgagagttgcaggatgctgtttggcttgagaacctcgacagagataaccagaaagcagggaagagtagaaggatgccagtttttatgattagttaacatattctcaaactatgtagaacttctccatgcaagattttacaacttcagcttttatattgaatacattttaatgttggttttaaaaaaaaaaaaaaaaaaaaaaaaaaaaaaannanaaaannaataaaatnatnantanannnaaaa

SEQ ID NO: 564 - DNA, 563 bp, Malus domestica
cgtctccgactcctgcatatctctctccctcctctctcccagtttgctcatagaaaatggacgccattgactcagtggtggatccgctcagagagttctccaaggacagcattcgccttgtcaagcgctgccacaagcccgatcgcaaagaattctccaaggtcgcgctccggacagcgattgggttcgtggtgatgggattcgttggcttcttcgtgaagctgatcttcatccccatcaacaacatcatcgtcggatctgtttagatcatgctgaagatcaagttagacagatgatagatgcagcggaccttaataaagcattagcttttagttctcatgtgttccttgtttctgtaaaaccatgatacatgtattttcttgtttttgatatttgggaccttgtgaacttgtctctttgtcgtttaatcaaaaattgtgttgttctggattcgcttacttgatcattgtacattttaaccaataaaatgtcggagggatgatcgtgtgtaaaacgataaagaagtattgaatgtgatggtctcgagcaatggattcagtagc

SEQ ID NO: 565 - DNA, 490 bp, Malus domestica
gctctctctctctctctctctcctacatctctctctctctctctctctctctctctctctctccgtctcccgatttgctcagagataatggacgccatcgactcagtggtggatccgctccgagagttctccaaggacagcattcgcctcgtcaagcgctgccacaagcccgatcgcaaagaattctccaaggtcgcgctccggacagcgatcgggttcgtcgtgatgggtttcgtcgggttcttcgtcaagctgatcttcatccccatcaacaatatcatcgtcggatctgtttaggtcatgctgaagatcaagttagacagatgaaaggtgcagcaaatctaaagaaagcattagcttttagttctcatttgttccttgtttctgtaaaacaatgatacgtgcactccctagttttcgacattgggaccttgtctctttctcgtttaatcgaatttttgttgttctggattcgtttaaaaaaaaaaaa

SEQ ID NO: 566 - DNA, 383 bp, Malus domestica
cgtctgtgtataaagatcccctgtttcctctcaattcaactcataacttcactattctgttcgtgttcttcgttccctcaattcttcagctcgtcggaaaaaatgcacgccctcgattcagtgttcagtccgctgagagagttctcgaaggacagcgtccgcctcgtgaagcgctgccacaaacccgaccgtaaagagttcacgaaggtggcgctacgtacggcgatcggattcgtggtgatgggattcgtcggatttttcgagaagctgatcttcatcccgatcaacaacatcatcgtcggaactgcttaggtcgtttggcactttcaagtaaatgaaagtctggcagtgagcgctaaggagggccaagatctaccatcacg

SEQ ID NO: 567 - DNA, 395 bp, arabidopsis lyrata
tgttcagaccgaatcaatctgcattggagaattatggctgaggggaagtcaacggaacaaaagtataaaaactaaaatgtcaaataaaagagacccaattttccatcttaaacgacgaagctcctgaaaccctaatttcaaataccaattccgatctaagaagtcatggaagccattgattccgcaatcgatcctctcagagatttcgctaagagcagtgttcgtctcgtacagcgctgtcacaaacccgatcgcaaagaattcaccaaagttgctgtgcgtacggcgattggatttgtggtgatgggatttgttggcttctttgtgaagctcgtattcatcccaatcaacaacatcatcgttggttctgcttagtgtactttctttacgaggta

SEQ ID NO: 568 - DNA, 551 bp, arabidopsis lyrata
cgaaaactcccattttgttttctcttcagaacaaataataaaacgtagtaacacaaaaaaaaaaaaaaaaagcgacatggacgccattgattccgtcgtggatccgcttagagactttgccaaggacagcattcgcctcgttaagcgttgtcacaagccagatcgcaaagaattcacgaaagtggcagtgcgtacagcaatcgggttcgtagtaatgggattcgtgggattctttgtgaagctcatctttattcccatcaacaacatcatcgtcggtgctacttagataacaagggaagataaaaagatggagacgggtagttacagctttgttgtttcatgaagacacttcacagtttttttgttttttttttttgttcagatactcgaaaagaggaaacattttgtgaacctagtttaaccacacatttgagatcaatctctagtaatttgcattctgtttaatgtatgtcactgtttattacgctgttccgtaagaaaattaaaagctttggtgaatgtggatgaggctaaacctttagttatgttga

SEQ ID NO: 569 - DNA, 461 bp, arabidopsis lyrata
caattttcagatcattcaaatcgaagctaaagatcgccgccatggacgccattgattccgtcgttgatcctctcagagacttcgctaaggatagtattcgtctcgttaagcgttgccacaagccagatcgcaaagaattcacgaaagttgcagttcgtaccgcgattgggtttgtggtaatgggattcgttggcttctttgtgaagctaatctttattccgatcaacaacatcatcgtcggtgccacttagaaagcaacggatacacaagtcagttctatgttttgagaaaggaagatttagaggctttcttgtttccaagagaaggcacaagtcagttctgtgttttatgtaatcggatttcatttgtttcaatgtttttttttggttcttcttttttgttcacagctgaaaaatcggacgtgttttgaatgtagagcaaactaatttagaaagctgtgg

SEQ ID NO: 570 - DNA, 603 bp, Arabidopsis thaliana
tgttcagaccgaatcaaatctgaattggagaaattatggtggaggcgaaagtcaacggaactaaagtataaaaccaaatgtcaaaaataaaacccaattttcatccttaaacgaacctgctgaaaccctaatttcgattaccaattccgatctaaaaagaagtcatggaagccattgattccgcaatcgatcctctcagagatttcgctaagagcagtgttcgtctcgtccagcgctgtcacaaacccgatcgcaaggaattcacgaaagtagctgtgcgtacggcgattggatttgtggtgatgggattcgttggattcttcgtgaagctcgttttcatcccaatcaacaacatcatcgttggatcttcttagtgtagtactttctttacgaggcaatgctccgaggagtaggaggagaagaacgaaccaaacgacattatcagccctttgaggaagctcttagttttgttattgtttttgtagccaaattctccattcttattccattttcacttatctcttgttccttatagaccttataagttttttattcatgtatacaaattatattgtcatcaagaagtatctttaaaatctaaat

SEQ ID NO: 571 - DNA, 555 bp, Arabidopsis thaliana
cgaagactcacaatttgtttttcattcagaacaaataataaaaacgaaacacacaaaaaaaaaaaaaaaaaagaagggacatggacgccattgattccgtcgtggatcctcttagagactttgccaaggacagcattcgcctcgttaagcgttgtcataagccagatcgcaaagaattcacgaaagttgcagtccgtacagcaatcgggttcgtagtaatgggattcgtgggattctttgtgaagctcatctttattccaatcaacaacatcatcgtcggtgctacttagataacaaagggaagataaaagatggagaagggtagttacagctttgttgttttcatgaagacacttcacagtttttttcttttttcttgttcagatactcaaaaagaggaaacattttgtgaacctagtttaaccacacatttgggatcaatctctagtaattttctttctgtttaatgtatgtcactgtttatttcactgttccgttagaaatttgaaagttttggtgaaggtggatgaggctatacccttagttgtggtgatg

SEQ ID NO: 572 - DNA, 499 bp, Arabidopsis thaliana
aaagaatagaaacagtgagattcaatttcaattttcagatcatttgaatcgaagctaaagaatcgccgccatggacgccattgattccgtcgttgatcctctcagagacttcgctaaggatagtattcgtctcgtcaagcgttgccacaagccagatcgcaaagaattcacgaaagttgcagttcgtaccgcgattgggtttgtggtaatgggattcgttggcttctttgtgaagctaatcttcattccgatcaacaacatcatcgtcggtgccacttagaaagcaaaggatacacaagtcagttctatgttttgagaaaggaagatttagaggttatcgtgttttaagtgaaaggcacaagtcagttctgtgttttgtgtaatcggatcccatttgtttcaatgtttttttggttcttcttttttgttcacaactgaaaaatcgacgtgttttgaatgtagagcaaactaatttaaaaagctgtggatttcgtagtcc

SEQ ID NO: 573 - DNA, 477 bp, Artemisia annua
  misc_feature (8)..(8): n is a, c, g, or t
  misc_feature (33)..(33): n is a, c, g, or t
  misc_feature (53)..(53): n is a, c, g, or t
  misc_feature (90)..(90): n is a, c, g, or t
  misc_feature (92)..(92): n is a, c, g, or t
  misc_feature (200)..(200): n is a, c, g, or t
  misc_feature (203)..(203): n is a, c, g, or t
  misc_feature (227)..(227): n is a, c, g, or t
  misc_feature (314)..(314): n is a, c, g, or t
  misc_feature (358)..(358): n is a, c, g, or t
cctaattnttcccatccagatcccaatttcaanaccctaaccttcacacacanccagatccaatcaaatcaaacccaaaaatggacgctntngattcagtattcgaaccactaagagagttctcaaaagacagctaccgtctagtcaaaagatgccacaaacctgatcgcaaagagttttcgaaagttgcggtccgtacngcnattggattcgttgtgatgggattngtagggttctttgtcaagctgatctttattcctatcaataacatcattgttggatctgtttagaggtgatacagctgtcaagggatncatgaaagacaatagttgtgcaaaatggtttaaagagagaactntgatgtattgccggaaacgtttcttttgttatgttcatgtagaatgagatcatgattttaatactttaatgttgaacttattttagtttttacattctgtgtttttgtttttttaaggg

SEQ ID NO: 574 - DNA, 434 bp, Brassica juncea
gacacctcttctgaaacgactattctcctgaaaccctaatttctcccaattcgatctgagaaactatggacgccattgaatcggcaatcgatccactcagagatttcgcaaagagcagtgtccgtctcgtccagcgctgtcacaaacctgatcgcaaggaattcaccaaggtggctgtgcgtacggcgataggatttgtggtgatgggattcgttggcttcttcgtgaagctcgtattcatcccaatcaacaacatcatcgttggatctacttaggatgcaatgcgcctagaagaaggaaagagactccaagacatgttgtgaaacctctctttattactctgtttttttctttctaggttacattttctcccttaaggcctaattttccctacttttttttttattaaatttacttcacttctttttgttagt

SEQ ID NO: 575 - DNA, 193 bp, Brassica juncea
  misc_feature (129)..(129): n is a, c, g, or t
aaagaaatcgccatggatgccatcgattctgtcgttgatcctctaagagactttgcgaaagacagcattcgtctcgttaagcgttgtcacaaaccagatcgcaaagaattcacgaaagtggcggtccgnacagccattggttttgtggtaatgggattcgtgggattctttgtgaagctcatctttattccca

SEQ ID NO: 576 - DNA, 393 bp, Brassica juncea
  misc_feature (252)..(252): n is a, c, g, or t
  misc_feature (258)..(258): n is a, c, g, or t
  misc_feature (333)..(333): n is a, c, g, or t
tgcaaatacgttttgccttttctgattatgtcgacagtgtcagtatcctcctaacattaatcagctcaccaattgcaaagcaaccaacgctttatcgccatggacgccattgattccgtcgttgatcctctcagagacttcgctaaggatagcatccgtctcgttaagcgttgccacaaaccagatcgcaaagagttcacgaaagttgcagttcgtacggcgatagggtttgtagtgatgggattcgttggnttcttngtgaagctcatctttattcccatcaacaacatcatcgtcggcgccacttaggaatcaaggaacagagttttgagngagaaagtttagagttttgctgttacaagaagtcacatggggttggagaaatcgagagaa

SEQ ID NO: 577 - DNA, 439 bp, Brassica juncea
  misc_feature (114)..(114): n is a, c, g, or t
ggattggccatcagaaactctgtgacgtttctttcaagagcacaaaaagagctgtgagattgagagatcatcgaaagcaaagccatggacgccattgattccgtcgtcgatccnctcagagacttcgctaaggatagcattcgtctcgttaagcgttgtcacaaaccagatcgcaaagaattcacgaaagttgctgttcgtacagcgattgggttcgttgtgatgggattcgtgggcttctttgtgaagctcatctttattccgatcaacaacatcatcgtcggtgccacttagggagcaaagaacagaatgggagaaaggcaaaaactagttttgagaaatgaaagctagagctttgctgttttcaacaattcgcacgttatgtttatgtaatcggatttcatttgtttctatccttttttttctttaattttgttca

SEQ ID NO: 578 - DNA, 419 bp, Brassica juncea
agaaaataagaaaaagaaaaacacaaattaaaaaaaaaaaatacgccatggatgccatcgattctgtcgtcgatcctctaagagactttgccaaggacagtattcgtctcgttaagcgttgtcacaaaccagatcgcaaagaattcacgaaagtggcggtccgtacggctattggttttgtggtaatgggattcgtgggattctttgtgaagctcatctttattcccatcaacaacatcatcgtcggggccacttaagattaccagctaagaatgagaagagaagggtagtcacagctttcttgcttgtttcaagacaaaaacttttttcttttttttgtgttaaaatgctcagagagaggaaacatttgttaaccacacatttgagattagtctccagtaattgcattctattttaat

SEQ ID NO: 579 - DNA, 567 bp, Brassica juncea
tgaacttttgtccaaccggtttcaaaaaaaaacaaacttttgtccaaccggggatatatatagatatttctttcttctaaaataagaaaaaaaaacacaaattaaactaaaaaagaaaaagtacaaagaaatcgccatggatgccatcgattcagtcgtcgatcctctaagagactttgccaaggacagcattcgtctcgttaaacgttgtcacaaaccagatcgcaaagaattcacgaaagtggcggtccgtacagctattgggtttgtggtgatgggattcgtgggattctttgtgaagctcatctttattcccatcaacaacatcatcgtcggtgctacctaagataaccagggaggatggagaagggtagtagttacagctttcgttgtttcaagaagacttctcccactttttttttcttgggttcagatactcgaaagagtaaaacttttgttacaaattgcagaattctatttaatatatgtcactgtttttatttcacttcgcggttgaaaattgaatggtttttgtgaatgtgagagagacaaggttaacacttggtg

SEQ ID NO: 580 - DNA, 270 bp, Brassica juncea
aaagaaagagccatggacgccatcgattccgtcgttgatcctcttagagatttcgcaaaggacagcattcgtctcgttaagcgttgtcacaaaccagatcgcaaagagttcacgaaagtggcggtccgtacagcgatcgggtttgtagtaatgggattcgtggggttctttgtgaagctcatcttcattcccatcaacaacatcatcgtcggtgccacctagataaccagcgaagaaagagaagagaagtgtagtaacagcttttgttga

SEQ ID NO: 581 - DNA, 263 bp, Brassica juncea
ttccgccatcgatccactcagagatttcgctaagagcagcgtccgtctcgtccagcgctgtcacaaacccgaccgcaaggaattcacgaaggtggctgtgcgtacggcgataggatttgtggtaatgggattcgtagggttcttcgtgaagctcgtattcatcccaatcaacaacatcatcgttggatcttcttaggcttaacactctttttaccaggctatgcgtcaaggagtaggaaggaaagagaccaaaacctgttgta

SEQ ID NO: 582 - DNA, 503 bp, Brassica oleracea
gtgagattgagattgagagatcatcgaaagcaaagccatggacgccattgattccgtcgtggatcctctcagagacttcgctaaggatagcattcgtctcgttaagcgttgtcacaaaccagatcgcaaagaattcacgaaagttgctgttcgtacagcgattgggttcgttgtgatgggattcgttggcttctttgtgaagctcatctttattccaatcaacaacataatcgtcggtgccacttagggagcaaagaacaaaatgggagaaaggcaaaaactagttttgagaaatgaaagctagagctttgctgttttcaacaattcgcacgttatgtttatgtaatcgtattcatttgtttctttctcttttttttttctttcattttgttcacgactgaaaaactggactcatcttgaatgtagatcaaactaatttagaaacttgtggcggaggatttcattgagacgccactataataatcccaaacatatttataaag

SEQ ID NO: 583 - DNA, 451 bp, Brassica oleracea
gaaaaacacaaattaaataaaaaaaaaaagaaaaagtcaaagaaatcgccatggatgccatcgattcagtcgtagatcctctaagagactttgccaaggacagcattcgcctcgttaagcgttgccacaaaccagatcgcaaagaattcacgaaagtggcggtccgtacagctattgggtttgtagtgatgggattcgtgggattctttgtgaagctcatctttattcctatcaacaacatcatcgtcggtgctacttaagatccagggagaggatggagaagggtagtagttaaaagcttttgttgtttcaagaagacattcacttcttttttttttttttgggttcagatgctggaaagaaagagtaaaacttttgttgcaaattgcagaattctgtttaatatatgtcactgtttttatttttacttgggtgttggaaattgcatggt

SEQ ID NO: 584 - DNA, 508 bp, Brassica oleracea
agaagctatggacgctattgattccgccatcgatccactcagagatttcgctaaaagcagcgcccgtctcgtccagcgctgtcacaaacccgaccgcaaggaattcacgatggtggctgtgcgtacggcgataggatttgtggtgatgggattcgtagggttcttcgtgaagctcgtattcatcccaatcaacaacatcatcgttggatcttcttaggctaatactctttttaccaggctatgcgccaaggagtaggaaggaaagagactccaaaacctgttgtgaaaccttgtattctgttttttttctaggttacattttctcccttgtggcctaattttctacacttgtttgaattttcttgtttcttttgatcttttcttgctattgcctaaacttacagagattttacttcttttttttttttgtataccaaaaaagtatagtcctcaagaactaggctttaaacacgaaatccgaaataaaaccaacccaagccatcatatt

SEQ ID NO: 585 - DNA, 526 bp, Brassica rapa
  misc_feature (382)..(382): n is a, c, g, or t
  misc_feature (515)..(515): n is a, c, g, or t
cccacgcgtccggaaactctgtgacgtttctttcaaagaaagcacaaaaagagctgtgagattgagactgagagatcatcgaaagcaaagccatggacgccattgattccgtcgtcgatcctctcagagacttcgctaaggatagcattcgtctcgttaagcgttgtcacaaaccagatcgcaaagaattcacgaaagttgctgttcgtacagcgattgggttcgttgtgatgggattcgtgggcttctttgtgaagctcatctttattccaatcaacaacatcatcgtcggtgccacttagggagcaaagaacaaaatgggagaaaggcaaaaactagttttgagaaataaaagctagagctttgctgttttcaacaattngcacgttatgtttatgtaatcgtattcatttgtttctttctctcttttttttcttttcattttgttcacgactgaaaaacttgactcatcttgaatgtagatcaaactaatttagaaacttgtggcggagganttcattgagac

SEQ ID NO: 586 - DNA, 510 bp, Brassica rapa
  misc_feature (169)..(169): n is a, c, g, or t
  misc_feature (190)..(190): n is a, c, g, or t
  misc_feature (211)..(211): n is a, c, g, or t
  misc_feature (217)..(217): n is a, c, g, or t
gcccctctctctctgttgacttgagcctctacacatcctgcaatcattttccccaattctctttttttctcttcgagccaaaccaaaaaaggaaagacaaattaaaaaacaaaggtcgtcaaagaaagaaagagccatggacgccatcgattccgtcgtcgatcctctnagagatttcgccaaggacagnattcgtctcgttaagcgttgncacaanccagatcgcaaagagttcacgaaagtggcggtccgtacagcgatcgggtttgtagtaatgggattcgtggggttcttcgtgaagctcatatttattcccatcaacaacatcatcgtcggtgccacctagataaccagctaagaaagagaagagaagtgtagtaacagctttcttgcttgttccaagaaaatgttttacagttttttttgtgtgtgttcagatgctcagaaagaggaaacattttgttaaccatacttttgaaattagtctccagtaattgcattctattttac

SEQ ID NO: 587 - DNA, 498 bp, Brassica rapa
agatcatcaaattcaaaagcaagcaacgaacgattatcgccatggacgccattgattccgtcgttgatcctctcagagacttcgctaaggatagcatccgtctcgttaagcgttgccacaaaccagatcgcaaagagttcacgaaagttgcagttcgtacggcgatagggtttgtagtgatgggattcgttggcttctttgtgaagctcatcttcattcccatcaacaacatcatcgtcggcgccacttaggaagcaaagaacagagttttgagagagggagaaattagagttttgctgttacaagaagtcatatgtcacttctatgttttcatgtcatcggattccatttgtttctatgtttttttttctttcttaatttgtccgcgactgagatttcaagaagttgtgacctaggatttcatgtatacacttggtctgtctctcttttattacacccccaaacctcgaccatggttaacaaaattgaaaggactgg

SEQ ID NO: 588 - DNA, 520 bp, Brassica rapa
ggagaaaataagaaaaaaaaaaacacaaattaaactaaaaaagaaaaagtcaaagaaatcgccatggatgccatcgattcagtcgtcgatcctctaagagactttgcgaaggacagcattcgtctcgttaaacgttgtcacaaaccagatcgcaaagaattcacgaaagtggcggtccgtacagctattgggtttgtggtgatgggattcgtgggattctttgtgaagctcatctttattcccatcaacaacatcatcgtcggtgctacctaagataaccagggaggatggagaagggtagtagttacagctttcgttgtttcaagaagacttctcccactttttttttcttgggttcagatactcgaaagagtaaaacttttgttacaaattgcagaattctatttaatatatgtcactgtttttatttcacttcgcggttgaaaattgaatggtttttgtgaatgtgagagagacaaggttaacacttggtgacaaaacttagacattaaaatctcca

SEQ ID NO: 589 - DNA, 598 bp, Musa acuminata
ggcttgccgagtgctcgatctcgatctcgagcttagggttttgctatctgcgatcgacatggatgccttggactccgcggtcgatcccttgagggagttcgccaaggacagcgtccgcctcgtcaagcgctgccacaagcccgatcgcaaggagttctcgaaggtggcggtccgcacggcgatcgggttcgtggtgatgggattcgtcgggttcttcgtcaagctgatctttatcccgatcaacaacatcattgtcggctccggttaggagcttaagtggccctaggggttgcgtgctgttggacgaggaaaatgtatttgccatcctattggttttcccttgctccagcatttttggtgtcactgggaagaaaacttggtacttgacttccatgtatgaacctcttactcgataacctgttacatgaaccttctctgtttggagagctatagatccaggttctggtatctgatatgtcgaatgtagtggtagcatttgtttgacatagttaccacattttgtttgcatggctatcatctgcaaaatgtggggcgttaaactaaaattcttaaagtgatgcgtggaatattcctctcc

SEQ ID NO: 590 - DNA, 563 bp, Musa acuminata
gggggtgcgccgtggatcttgcggtttcgtctctccatctcgatctcgagcttagggtttcgcgatccgcgatcgaaatggacgctttggactccgtggtcgatcccctgcgggagttcgccaaggacagccttcgcctcgtcaaacggtgccacaagcccgaccgcaaggagttcacgaaggtggcggtacgcacggcgatcgggttcgtggtgatgggattcgttgggttcttcgtcaagctgatctttatcccgatcaacaacatcatcgtcggttccggttaggtaatacgatgtaaacccttccggttccgatgtttctgatttaggagatggttttcgtgcggttgggtgattatcatagttcagattgcgaatacgacaaattgagaaattgtagttgcaatgcattaaaaaaaggggattatatttgtggttgatgtgggtcttacctcttatgtttttgtggttgatgtggatcttatctttcggattttggttgttcattagaaagtctgacaacttctttagaattcatagggtgtgtgctgtgatttggaa

SEQ ID NO: 591 - DNA, 423 bp, Musa acuminata
gacggtcgtcatcgttctcacttcggtctcgatctcgatctcgagcgtggggttttgtgatccgcgatcgagatggacgccctcgactccgccgtcgaccccttgagggagttcgccaaggacagcgtccgcctcgtcaagcggtgccacaagcccgaccgaaaggagttcacgaaggtggccatccgtacagcgatcgggttcgtggtgatgggattcgtagggttcttcgttaaactcatatttatccccatcaacaatatcatcgtcggttccggttaggttgcgggatataacgaattgggtgtttcgcattgtaggacaacaaaaatgtctctgccatcgtagaagagtttgctggttttgtcttccagcattttaactgttaaaggcacattttgggggaacatttgttggttttta

SEQ ID NO: 592 - DNA, 517 bp, Musa acuminata
gctctctctctctctctcgatctctttatcaagttttaggtttttcgatccgcgaccttctctgatcccgcgaatggatgccttggattccgtcgtagatcctctgagggaattcgcaaaagacagcctccgcctcgtcaagagatgccacaagcccgatcgcaaggagttcacgaaggtggcgatccgcacggcgatcggtttcgtggtgatgggattcgttggcttcttcgggaagctgatctttatcccgatcaacaacatcatcgtcggttcgggctaggactcgcgctctcgaattttcgggacaaagcatgaaagtttatatcgacctagaaattgatttcatctttggcattcttgactcgccgcagctttagcatcaaaggaacaaacaaagatattttattttactttttcgtgtatgcatttccaattttgtaacttttgctattttttcctgtttatgcgtgaaatttactgatgtagactctgatatatcatctttggtcgagac

SEQ ID NO: 593 - DNA, 537 bp, Hordeum vulgare
gcacgagggatcacgctttttcttgtggggaagaaaagttctataaaagaagccatcggcgacacccacccgcacaaatccaaacagcatcctcccgtcggcttcctccccctcacgcgcgcgacctcgtcgtcgtcggcttcgagatctcgccgcgcctcgcccgccatggacgccgtcgactccgtggtcgaccccctgcgcgagttcgccaaggacagcgtccgcctcgtcaagcgctgccacaagcccgaccgcaaggagttcaccaaggtggccgcgcggacggccatcgggttcgtcgtcatggggttcgtcggcttcttcgtcaagctcatcttcatccccatcaacaacatcatcgtcggctccggctaggttggaggacaacatgacgcgggggtagtgcggtgccggcagttgggcctgcggtgtgttgaagtaggcgcccaaagtttgttctgaagttgttgttaaagacctgttttgtgagaaattgtcaccagcttaatcatggtaatgagtatagatcttaaa

SEQ ID NO: 594 - DNA, 590 bp, Hordeum vulgare
cagcatcctcccgtcggcttcctccccctcacgcgcgcgacctcgtcgtcgtcgtcgtcgtcggctccgagatctcgccgcgcctcgcccgccatggacgccgtcgactccgtggtcgacccactccgcgagttcgccaaggacagcgtccgcctcgtcaagcgctgccacaagcccgaccgcaaggagttcaccaaggtggccgcgcggacggcgatcgggttcgtcgtcatggggttcgtcggcttcttcgtcaagctcatcttcatccccatcaacaacatcatcgtcggctccggctagggttggaggacaacatgacgcggggatagtgcgatgccggcagttgggcctgcggtgtgttgaagtaggcgcccaaagtttgttttgaagttgttgttgaagacctgttttgtgagaaattgtcaccagcttaatcatggtaatgagtatagatcttaaaagtagcgagttataaagtttatgttttgtcataattcccttgtgggtgcaaaggtcgatcgctgatcgcaagtgatgaatccttggtgaaacacgcaccaccggccaacaacttgggccacactcac

SEQ ID NO: 595 - DNA, 648 bp, Hordeum vulgare
cggcacgaggagcaaacccacctccaccttctgcatcccacctctccggcgagatctctctccgccccgcgccgcgccgcagccagccatggacgccgtggactccgtggtcgacccgctccgggagttcgccaaggacagcgtccgcctcgtcaagcgctgccacaagcccgatcgaaaggagtttaccaaggtggccattcggacggccatcgggttcgtcgtcatgggcttcgtcggcttcttcgtcaagctcatcttcatccccatcaacaacatcatcgtcgggtcgggctgatttggtcctccgcaggtgaggggccgcaggacgagaggatggtgttcattcatggaggcggcgctggctttcttgtcctcgtaccttaaagcaattcatttaggacttcattgtagaggaatctttcttgtcccttgtgttttcattcgaaacagttgtattggtagacctggagcagttttgaacctgataccggctagaccgtaatatcaagtaccgtgtcaaatgacaagaatgaaaccctatcgtttcctctcaggtgcattttcctatgatgcctttactttcatcaagctttatgtgtaattgtcccaaaggaaattattatgtgtcatggcatgcaaaaaaaa

SEQ ID NO: 596 - DNA, 576 bp, Hordeum vulgare
gctttttcttgtagggaagaaaagtttataaaagaagccatcggcgacacccacccgcacaaatccaaacagcatcctcccgtcggcttcctccccctcacgcgcgcgacctcgtcgtcgtcggctccgagatctcgccgcgcctcgcccgccatggacgccgtcgactccgtcgtcgaccccctccgcgagttcgccaaggacagcgtccgcctcgtcaagcgctgccacaagcccgaccgcaaggagttcaccaaggtggccgcgcggacggccatcgggttcgtcgtcatggggttcgtcggcttcttcgtcaagctcatcttcatccccatcaacaacatcatcgtcggctccggctagggttggaggacaacagggatagtgtgatgccggcagttgagcctgcagcgcccaaagtttgttctgaagttgttgttaaagacctgttttctgagaaattgtcaccagcttaatcatcgtaatgagtatagatcttaaaagtagcgagttataaagtttatgttttgtcataattcccttgtgggtgcaaaggtagatcgctgatcgcaagtg

SEQ ID NO: 597 - DNA, 538 bp, Phaseolus coccineus
gtaccttcatcactcagaattcatatttgttcatttctgaattcagatcgaaaggtagaagaaaaagagagagaatggacgccattgattccgtcttcgatccccttagagaattctccaaggacagtgtcagactcgtcaagcgatgccacaaacccgatcgtaaagaattctctaaggttgctgtgcgtaccgcgattggtttcgttgtgatgggattcgttcggtttttttgtcaagctcatcttcattccaatcaacaacatcattgtcggatctggttaggatgaggggaatttttcaattgcctcaggagtctaagttctcaaacatgaagaggcagaaagagttcccactttgttaggtcatcatgaacttaattgtagttttttgtactctatttttggtgtacacttgtatcttatcttcggaagcattacagttttatttgaaatatacaattttatttttccgtgttagacccttgacacattgttttgattcaggaaaaggatgaaaaaaagtagttgagaaacta

SEQ ID NO: 598 - DNA, 622 bp, Phaseolus coccineus
gggaaagatcgacacatatttgcattctcgtatccagtgtctgagagagaatggacgccattgattccgtcttcgatccactcagagaatttgccaaggacagcgtgaggctcgtgaagcgctgccacaagcccgatcgcaaagaattctccaaggttgccgtgcgtacggcaattggtttcgtcgtgatggggttcgtgggtttcttcgtgaagctcattttcattccaattaacaacattatcgtcggatctggttagggtcgggaactgcaaccgcctcaggacttcaaggtgtcaagaaaaaggaggcagaaagaattcccccatgaatagtaattaatcttagttctgttatatttcatttttttgtttttccttattactggaaggaagcaaggaaagtttgtgctttcttttgttatatatacctttgacacattgttttgatttaggataaggaggaagaaggaatggtgaaactgtagctttgtttttagtccatgttaactgttttctttcttttatgatcaattcatgcttcaacagtgcagttggctatttattggccgctcaactgaatccaaatttaaaattttaaaaaataaatactttcctgtcgc

SEQ ID NO: 599 - DNA, 266 bp, Fagus grandifolia
  misc_feature (221)..(221): n is a, c, g, or t
agagagagagagaattatggacgccatagactcagtcgtcgatcctctcagagagttctccaaggacagcatccgcctcgtcaagcgctgccacaagcctgatcgcaaagaattcaccaaggtggcgttccgtacagcgatcggattcgtggtgatgggattcgtcggcttcttcgtgaagctgatcttcattccgatcaacaacatcatcgtcggttccncataggtcatatgaagctaactttaattttcgtaggagggtaagg

SEQ ID NO: 600 - DNA, 204 bp, Fagus grandifolia
aaatggaggccattgactcagtgttcgaccccctcagagaattctccaaggacagcatccgcctcgtcaagcgctgccacaaacccgatcgcaaagagtttaccaaggtggcgttccgtacggccatcggattcgtcgtgatgggtttcgttggcttcttcgtgaagctgatcttcatccccatcaacaacatcatcgtcggcg

SEQ ID NO: 601 - DNA, 574 bp, Brachypodium distachyon
gaaggcaggctactataaaacaagccatccgcgaaacaaactcggcccacaaagacgtcatattctcccttcccgtcgacttcctcctcttccctcgcgtctccggatctcgccatggacgccgtcgactccgtcgtggaccccctccgcgagttcgccaaggacagcgtccgcctcgtcaaacgctgccacaagcccgaccgcaaggagttcaccaaggtggcggcgcggacggccatcgggttcgtcgtcatgggcttcgtcggcttcttcgtcaagctcatcttcatccccatcaacaacatcatcgtcggatccggctagattggaggctggccagcatggagacggcgcaaacattttgagagcaatcgagcaagggactagtcgctagtgcgctgtcttacagtagacacccaatgtttattgacctattcgaaaagttatttgtgaaaacagttaactttgttctgtttgcgagaaattgtcggcagcctaattgctgtgaaatcgtcgtactgagtagaccttgaattagcgagttatataaacttgttttgtcatattctcctgg

SEQ ID NO: 602 - DNA, 584 bp, Brachypodium distachyon
gtacaaggaattaaggacacgtcacccgtccacgtcgtcagacgcgccgcaagacctcgtcgggttccgcttcccaattcccttccccatccctccggcgtgatctctccccctccaccgcggctgcgcagcgcaaccagaagaaccaccgatggacgccgtggactccgtggtcgacccgctccgggatttcaccaaggacagcgtgcgcctcgtcaagcgctgccacaagcccgaccgcaaggagttcaccaaggtggcggtgcggacggcgacagggttcgtcgccatgggcttcgtcgggttcttcgtcaagctcatcttcattcccatcaacaacatcatcgtcgggtccggctgattccgtaggtgatgggccacagagcaaagaggatggagtcaattcgtggaggcggtgccagttttcttgtcttgataccgtaaagctaaagcaattcctttaggacttcatattcgaggacagttttgttgcatcttcatttcaaacagttgtattggtgtatctggagcagttggtgcctgatattggctagaccgaaatgaagtagcgaggtacaagaatg

SEQ ID NO: 603 - DNA, 557 bp, Bruguiera gymnorhiza
gacctgcctgtctccggtgtttctcccgccttctctatctctctctttctctctctctctcgatcgaaaagcctcagctcgctttcaatcgaacagatcttagggttttctcgagtaccaaatccaatcgaaaatggatgccgtggactcagtcgtcgaccctctcagggatttcgctaaggacagcgtccgcctcgtaaagcgatgccacaaacccgatcgcaaagaattcacgaaggtcgctgtccgtactgcaatcggatttgtggtgatgggattcgtcggcttcttcgtcaagctcatcttcatccccatcaacaacatcatcgtcggttctgtttaggttctagagaatggagtcttgtgcgtgaaacttgcctttggtgaaatgcttagccctcttaggtttcttttcgacgtgtactgaatacttgagtaaagctggagtattgtgaaatctaaattctccatagtcttttgaagttttgtctcttggaggtttatctgttgctgctgcttttaatgttcgttataccggcttcttataatcttgggtg

SEQ ID NO: 604 - DNA, 402 bp, Bruguiera gymnorhiza
tttcagagtctcaaatggacgccgtagactcagtcgtcgaccctctcagagatttcgccaaggatagcgcccgcctcgtaaagcgctgccacaaacccgatcgcaaagaatttacgaaggtcgctttccgtactgcaattggatttgtcgtgatgggatttgttggattcttcgtcaagctgatcttcatcccgatcaacaacattatcgtcggctccggttaggctctggagatggaggcttttgcgtgaaacttgacattagtgagatgctaggcttcttttcgacatgtgccaaatacttaagtgaagagctgaatattttctaatgtaaactctctggattctgttgaagttttgcctcttgcattgttatctggtactgctgcttttaatgttcctt

SEQ ID NO: 605 - DNA, 715 bp, Theobroma cacao
  misc_feature (77)..(77): n is a, c, g, or t
  misc_feature (89)..(89): n is a, c, g, or t
  misc_feature (91)..(91): n is a, c, g, or t
  misc_feature (95)..(95): n is a, c, g, or t
gggggcttcccaaatttgactcgaaaaaacctcctactactacccaacaaaactgcctcgacgtttttatgagttgngttcacattagncnatcncctcataaaagatctccatttttttctcttttaagatttcatctcgttgctaggtgttgagagagagagagagagagagaaatggacgcccttgactccgtcgtcgatcctttgagagactttgccaaggacagcgtccgcctcgtcaagcgctgtcacaagcccgatcgcaaagagttcacgaaggtggcgttccgtactgcgatcggttttgtagtgatgggattcgtcggattcttcgttaagcttatctttattcctattaacaacatcattgttggctccgcttaggtttgtagacattgctggaggatgtgaccattatgattggttgcaacttgtcatcaaagaggaatgttagaatacagcgtttagcgaacagccccttccctttcttttaaatgtattgagttgaaatagaaaccttgaatctgaagtcaattggaatttctttgagcctctgtaatagattctgattaattttgcctttgacttcagagtgtttcttattgtgctatttcgagaaaaagaaacaaatgatgaggaaattcctccttaacaaacagtaagtgctttgcagtctttcacatgaatcaaatggaaaataattttgccttgcg

SEQ ID NO: 606 - DNA, 622 bp, Theobroma cacao
  misc_feature (64)..(64): n is a, c, g, or t
  misc_feature (101)..(101): n is a, c, g, or t
  misc_feature (104)..(104): n is a, c, g, or t
  misc_feature (136)..(136): n is a, c, g, or t
  misc_feature (503)..(503): n is a, c, g, or t
  misc_feature (537)..(537): n is a, c, g, or t
tcataaaagatctccatttttttttcttttaagatttcatctggttgctaggtgttgagagagngagagagagaaatggacgcccttgattccgtcgtcgntcntttgagagactttgccaaggacagcttccgcntcgtcaagcgctgtcacaagcccgttcgcaaagagttcacgaaggtggcgttccgtattgcgatcggatttgtagtgatgggattcgtgggattttttgttaagcttatctttattcttattaacaacatcattgttggttccgtttaggtttgtagacattgctgggggatgtgaccattatgattggttgcaacttgtcttcaaagaggaatgttagaatacagcgtttagggaacagccccttcccttccttttaaatgtattgagttgaaatagaaaccttgattttgaagtcaattggaatttttttgagcctctgtaatagattttgattaattttgcctttgacttcagagtgttttttnttgtgttatttcgagaaaaagaaacaaatgatgnggaaattcctccttaacaaccagtaagtgctttgcagtttttcacatgaatcaaatggaaaataattttgccttgtgggaaccca

SEQ ID NO: 607 - DNA, 514 bp, Theobroma cacao
  misc_feature (52)..(52): n is a, c, g, or t
  misc_feature (60)..(60): n is a, c, g, or t
  misc_feature (65)..(65): n is a, c, g, or t
  misc_feature (79)..(79): n is a, c, g, or t
  misc_feature (88)..(88): n is a, c, g, or t
  misc_feature (97)..(97): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (135)..(136): n is a, c, g, or t
  misc_feature (154)..(154): n is a, c, g, or t
  misc_feature (160)..(160): n is a, c, g, or t
cggggaaaaacaaaaaagaaggaggaaaagaaaaatggacgcaattgactcngttttcgntccgntaagggagttcgcnaaggacagngttcgtctngtgaagagatgccacaagccngntcgnaaagaatttannaaggtggcgttccgtacngcgatnggattcgtggttatgggattcgtagggtttttcgtcaagctcatttttattcctattaacaacattattgttggatccggttagaagggaaccatgttactcacaggaaggatgggaattggtacaattttttagcacggggagaaaagaaagatctgcatgctttagatcgagagatacatcatctgagtgcatggactaatttcattttggacttgagttttctttatattcgtttttgttgaaaatggtttaaatgttaatgatgtaatagaatcttgttgaaactagtacaatcttaagacttttggtccaatgaattatatgtttcatgcacttcttgctgccctgcca

SEQ ID NO: 608 - DNA, 481 bp, Brassica napus
ttcaaaagcaagcaacgaacgattatcgctatggacgccattgattccgtcgttgatcctctcagagacttcgctaaggatagcatccgtctcgttaagcgttgccacaaaccagatcgcaaagagttcacgaaagttgcagttcgtacggcgatagggttcgtagtgatgggattcgttggcttctttgtgaagctcatcttcattcccatcaacaacatcatcgtcggcgccacttaggaagcaaagaacagagttttgagagagagagagaaaattagagttttgctgttacaagaagtcacatgtcacttctatgttttcatgtcatcggattccatttgtttctatgttttttttctttcttaatttgttcgcgactgagatttcaagaagttgtgacctagaatcctaccattactgtttgaatcctacccgaactttagttataataatttgaatcctaccattactgttttcc

SEQ ID NO: 609 - DNA, 480 bp, Brassica napus
gtgccaaaccaaaaaaggaaagacaaatagaaaaaaaaaaaggtcgagaaagaaagaaagagacatggacgccatcgattccgtcgtcgatccacttagagacttcgcaaaggacagcattcgtctcgttaagcgttgtcacaaaccagatcgcaaagaattcacgaaagtggcggtccgtacagcgataggttttgtagtaatggggttcgtgggattctttgtgaagctcatctttattcccatcaacaacatcatcgtcggtgccacctagataactatcgaagaaagagaagagaagggtagtaaacagctttcttgcttgtttcaagaaaatacttccaacagtttttacttttttgtgttcagatactcgaaaagagtaaacatttgttaaccacacatttgagattagtctctccagtaattgcattctattttataaatgtcactgtttatttcgctgtaccgttagaaatt

SEQ ID NO: 610 - DNA, 536 bp, Brassica napus
atcaacgcagagtacgcggggatcgaaagcaaagccatggacgccattgattccgtcgtggatcctctcagagacttcgctaaggatagcattcgtctcgttaagcgttgtcacaaaccagatcgcaaagaattcacgaaagttgctgttcgtacagcgattgggttcgttgtgatgggattcgttggcttctttgtgaagctcatctttattccaatcaacaacataatcgtcggtgccacttagttatgtgaatgatgatgattttcctattcatcacaataggagcaaagaacaaaatgggagaaaggcaaaaactagttttgagaaatgaaagctagagctttgctgttttcaacaattcgcacgttatgtttatgtaatcgtattcatttgtttctttctcttttttttttctttcattttgttcacgactgaaaaactggactcatcttgaatgtagatcaaactaatttagaaacttgtggcggaggatttcattgagacgccactataataatcccaaacatatttat

SEQ ID NO: 611 - DNA, 527 bp, Brassica napus
  misc_feature (512)..(512): n is a, c, g, or t
aacttgtttctcttcgaaccaatccagaaaataagaaaagaaaaacacaaattaaattaaaaaaaagagaaaaagtcaaagaaatcgccatggatgccatcgattcagtcgtagatcctctaagagactttgccaaggacagcattcgcctcgttaagcgttgccacaaaccagatcgcaaagaattcacgaaagtggcggtccgtacagctattgggtttgtagtgatgggattcgtgggattctttgtgaagctcatctttattcctatcaacaacatcatcgtcggtgctacttaagatccagggagaggatggagaagggtagtagttaaaagcttttgttgtttcaagaagacattcacttctttttctttttttttttgggttcagatgctcgaaagaaagagtaaaacttttgttacaaattgcagaattctgtttaatatatgtcactttttttatttttacttgggtgttggaaattgcatggtttttgtgaatgtgggaganacaaggctaactctt

SEQ ID NO: 612 - DNA, 483 bp, Brassica napus
gaaagcaaagccatggacgccattgattccgtcgtcgatcctctcagagacttcgctaaggatagcattcgtctcgttaagcggtgtcacaaaccagatcgcaaagaattcacgaaagttgctgttcgtacagcgattgggttcgttgtgatgggattcgtgggcttctttgtgaagctcatctttattccaatcaacaacatcatcgtcggtgccacttagggagcaaagaacaaaatgggagaaaggcaaaaactagttttgagaaataaaagctagagctttgctgttttcaacaattcgcacgttatgtttatgtaatcgtattcatttgtttctttctctcttttttttcttttcattttgttcacgactgaaaaacttgactcatcttgaatgtagatcaaactaatttagaaacttgtggcggaggaattcattgagacgccactttaataatctcaaacatatttataaagaaat

SEQ ID NO: 613 - DNA, 516 bp, Brassica napus
ttttctcttcgtgccaaaccaaaaaaggaaagacaaatagaaaaaaaaaaagtcgagaaagaaagaaagagacatggacgccatcgattccgtcgtcgatccacttagagactttgccaaggacagtattcgtctcgttaagcgttgtcacaaaccagatcgcaaagaattcacgaaagtggcggtccgtacagcgataggttttgtagtaatggggttcgtgggtttctttgtgaagctcatctttattcccatcaacaacatcatcgtcggtgctacttaaaagataaccaacgaagaaggccaagagaagagcagagaagggtaacagctttcttgcttgtttcaagaaaatacctccaacagtttttgttttttttgtgttcagatactcgaaaagagtaaacatttgttaaacacacatttgagattagtctctccagtaattgcattctattttataaatgtcactgtttatttcgctgtaccgttagaaattgggatggtgaaccttta

SEQ ID NO: 614 - DNA, 572 bp, Brassica napus
catttcccctttttttttcctcatcgtgccaaaccaaaaaaggaaagacaaattaaaaaacaaaggtcgtcaaagaaagaaagagccatggacgccatcgattccgtcgtcgatcctctcagagatttcgccaaggacagcattcgtctcgttaagcgttgccacaaaccagatcgcaaagagttcacgaaagtggcggtccgtacagcgatcgggtttgtagtaatggggttcgtggggttcttcgtgaaactcatatttattcccatcaacaacatcatcgtcggtgccacctagataaccagcgaagaaagagaagagaagggtagtaacagctttcttgcttgtttcaagaaaatacttcatagtttttttttggtatgttcagattctcagaaagaggaaacatttgttaaccacacatttgagattagtctctccagtaattgcattctattttataaatgtcactgtttatttcgctttacccttagaaattgggatggtgaacctttagttatggtggcaaaactctcaaatttagaaaaataaaaaaaattttacttgtttgc

SEQ ID NO: 615 - DNA, 551 bp, Brassica napus
gatatatcaacttgtttctcttcgtaccaatccagaaaataagaaaaaaaaaacacacaaattaaactaaaaaagaaaaagtcaaagaaatcgccatggatgccatcgattcagtcgtcgatcctctaagagactttgcgaaggacagcattcgtctcgttaaacgttgtcacaaaccagatcgcaaagaattcacgaaagtggcggtccgtacagctattgggtttgtggtgatgggattcgtgggattctttgtgaagctcatctttattcccatcaacaacatcatcgtcggtgctacctaagataaccagggaggatggagaagggtagtagttacagctttcgttgtttcaagaagacttctcccactttttttttcttgggttcagatactcgaaagagtaaaacttttgttacaaattgcagaattctatttaatatatgtcactgtttttatttcacttcgcggttgaaaattgaatggtttttgtgaatgtgagagagacaaggttaacacttggtgacaaaacttagacattaaaatctcc

SEQ ID NO: 616 - DNA, 466 bp, Brassica napus
gaaaataaaacccctcatttacctcttctgaaaccctaattttccaattcgatctgagaagctatggacgctattgattccgccatcgatccactcagagatttcgctaaaagcagcgcccgtctcgtccagcgctgtcacaaacccgaccgcaaggaattcacgatggtggctgtgcgtacggcgataggatttgtggtgatgggattcgtagggttcttcgtgaagctcgtattcatcccaatcaacaacatcatcgttggatcttcttaggctaatactctttttaccaggctatgcgccaaggagtaggaaggaaagagactccaaaacctgttgtgaaaccttgtattctgttttttttctaggttacattttctcccttgtggcctaattttctacacttgtttgaattttcttgtttcttttgatcttttcttgctattgcctaaacttacagagattt

SEQ ID NO: 617 - DNA, 633 bp, Brassica napus
gggagtatttgtgttcagaccgaaatcaagtcaacgacaccaagaaattacttataaagtcagaatgtcaaaataaaacctcatttacctctcgtgaaaccctaattttccaattcgatcagagaagcaaggtatggacgccattgattccgccatcgatccactcagagatttcgctaagagcagcgtccgtctcgtccagcgctgtcacaaacccgaccgcaaggaattcacgaaggtggctgtgcgtacggcgataggatttgtggtaatgggattcgtagggttcttcgtgaagctcgtattcatcccaatcaacaacatcatcgttggatcttcttaggcttaatactctttttaccaggctatgcgccaaggagtaggaaggaaagagactccaaaacctgttgtgaaaccttgtattctgttttttttctaggttacattttctcccttgtggcttaattttctatacttgtttgaattttcttgtttcttttgatcttctcttgctattgcctaaactaacagagatttacttttttttttttttttttgtataccaaaaaagtatagtcctcaaaaactaggctttaaacacgaaataccaacccaagccatcatattattgtc

SEQ ID NO: 618 - DNA, 556 bp, Manihot esculenta
ggcaaatcctcagatttcagatcccaatcaaattcccttgttcgacgaactttagggcattaaagagaatagaaaaacgattgaaatggacgccatagactccgtcttcgatcccctaagggagttcgccaaggacagcgtccgcctcgtcaagcgctgccacaagcccgatcgcaaagagttcacgaaggtggcgttccgtacagcgataggattcgtggtgatgggatttgttggtttcttcgtgaaattgatattcattcctatcaataatatcattgttggatctagttagatcaggtcatgttgatcgctagcgtgggaactggtgaactggtgatctcacttgattacgatgcctagcaaaaaatttacaatgtagtggaaaggaatactgttagtgttgatgttgcttttgttatttgtttatctgagactagaagaacgaggacgtcatgcgaagttctggttatttttatgttagtctgactggaccctccttgttgggattcatccctaaaattttctaaagaatagagaatgatgctttgatttg

SEQ ID NO: 619 - DNA, 873 bp, Manihot esculenta
attcaggtcaaaccgctttaaaatatcaaccccgttctcccgtcttttaagacctgaatcccataagctacgtctcgagaagtcagattcaaacccgctttgacgaacaaaggaatcaatatggacgccatcgactccgtcttcgatccactcagagagttcgccaaggatagcgtacgccttgtcaaacgctgtcacaaacccgatcgcaaagaattcaccaaggttgccttccgcacggccatcggattcgtggtgatgggattcgttggtttctttgtgaaattgatcttcattccaatcaataatatcattgttggatctagttagatcagagaatattgatcggtagcatggacaggctggttgattagtttgattacaatgtcctgactccagagaacacatacaaattaggggaaaaggatactgttagtgttcatgtagctttttcattttttgtttgtctgagactaagataaaggatattgtctgcaatttttagtcagttccctagtttcttttctttgctttcctagttggatttatcccacaaatacgataatctgtttactcaaattctattgttaggaaattcagtatttgagatagtgcaaaggtaataggctgtatttgttttttcggttaagttaatggttttatggttttgacgtggactctgattgttcaacctttcattagttcgtataccattctgctagtagtttaatgatggagaattgctgtgagaatagcaacgagatggggcgaaggcaataaattgtgtaatggtgcgatgtcactgtaattgtatgtaaccatactatgcaaaacactgaatagtttatggttaaacaaagtgatgttagttag

SEQ ID NO: 620 - DNA, 661 bp, Manihot esculenta
gagaagtgagatccccaaaccactttaacgaacagaagaaaagagaaaactataaaaatggacgcaatcgattccgtctttgatccactgagagagttcgccaaggacagcgtccgcctcgtcaagcgctgtcacaagcccgatcgcaaagaattcaccaaggttgccttccgtacggcaatcggattcgtggtgatgggattcgttgggttcttcgtgaaattgatctttattcctatcaataatatcattgttggatctagttagatcagttggagatcacattgatctctagcatggatactggtggttgattagtttgattacaatgtccagactccagagaacaattacattttagcggaaatgaatactgtcagtgttgatgtaagcttcttcattatttgcttgtcttgagactataagatgaaggatatcacttgaaatttctagtaatttccctcttttcttttatgcgcttgcctgattggatttttcccacaatttgggtagtgaatgcctttttaattcaaattatgtggttaagcaattcactggttgagacagtgcaaaggtactaggataagttcatggctttgaagcaaagcttcaaactgtgatatcgacaatttttaatatgagatttgatgattcacctttc

SEQ ID NO: 621 - DNA, 629 bp, Ricinus communis
gggctaggaattgaatgaaactcctcagccctatttgcaaacaggtccagtccactactcaaaaacaggtattttcgtccaatacagaaaaaagaaaaataaaaaataaatatcttctctgtgtcttccgtatttgacctgaaaaagtctacagcactcgcaaaaaacgtgtccgcttcggtatctctctcatcttcaattactaaagaaattagatctagggtttctgcttgcaagtgaccgaaatggatgccttagataacgtgtttgatcctctcagagatttcgccaaggacagtgtccgcctcgttaagaggtgccacaaacccgatcgcaaagaattcacgaaggtcgcgttccgtactgcaatcggtttcgtggtgatgggattcgtcggattcttcgtgaagctgatctttatcccgatcaacaacatcatcgtcggttctggttgaagcttccgggattatcaacaattctacaggatgaaagttgttcaaagagcttgtctttaaagaggaatgcttagcatttagctctgttttaggttccttttttgatatgtatgcaatacttgagtaaaacaggaaattatgaattaaattgaggattttggttcagcttttttc

SEQ ID NO: 622 - DNA, 491 bp, Ricinus communis
gttctccttcaatctgttaaataacataaatctcatcgccaacctctcagatctcaaattctaaatctaattatcaaaaaggatggacgcaattgattcagtattggatccattgcgagacttttccaaggacagcgtccgcctcgtcaagcgttgtcacaagcccgatcgcaaagagttcacgaaggtggctttccgtacagcgataggatttgtagtgatgggattcgttggtttctttgtcaaattgatattcattcctattaacaatatcattgttgggtctgtttagcttaaggtcaacttggatttgctacaatggaaaatggttgtccattagcttgattacaatatccagagaaaacctagtgtagtgaaaaggaacattgttagtatttacaaactttacattgctttggttgtttagatgtgctagactataaggttaacagatatgatatgcaaatttctggtcatttgcacctggtgat

SEQ ID NO: 623 - DNA, 481 bp, Catharanthus roseus
ccaaagaattcggcacgaggctcgactctctctgttctatcttcttccgtctgccactctgccctaaacaagattgaattatggacgccttggattcagtattcgatcctctgagagatttcgccaaggacagcgttcgcctcgtcaagaggtgccacaagcccgatcgcaaagaattcacgaaagtggcgacgcgaacagcgatcggctttgtggtgatgggatttgttggtttttttgttaaattgatttttattccaatcaacaatatcattgtcggtgcatcataaaaaaatatcctgactcctgctctctagatgctagctccagggggctcttttcctgtttcgtttatttaaatagaacagcaacaatatcttgtatgtgtttctggaatggtagctcatgacttgttactctagcagtccaaatcagaaattaaaaaacctttttaaagccactttgatctatttcatttttt

SEQ ID NO: 624 - DNA, 516 bp, Catharanthus roseus
atccaaagaatcggcacgaggcccaaacacaaccggtcgcccgaccccttctctgaatatcaggccattgaattatggacgctttggattcagtattcgatcctctgagagacttcgccaaggacagcgttcgactggtcaagcggtgccacaagcccgatcgcaaagaattcacaaaggtggcgacgcggacagcgatcggctttgtggtgatgggatttgttggcttttttgtcaaattgatatttattccaatcaacaatatcattgtcggtgcatcataaacaaaaaatcctgacttctgttctctagatgctagcaccagggggacggagcgtactgcagatttcttttgtttctgggattgtagctgacttgttagactagcacagtccaaatgagaaattaaaaacttttttgaagccgttttgttttattttatattttttgatcagatgttgaactattcttaacccaagtacttttcttgaatatatgaaagataatttctcctac

SEQ ID NO: 625 - DNA, 478 bp, Catharanthus roseus
ggaagtcttaacaatcagccatggatgctttggactccgtctttgatcctctcagggattttgcaaaagacagtgttcgtctcgtgaagcgctgccacaaacccgatcggaaagagtttttcaaggtagcggtgcgtacagcgattggttttgttgtgatgggattcgtagggtttttcgtgaagctcatctttatccctatcaacaatatcatcgttggatctggttgattatctcgatcgaaacagaggtagtctagaactcggagtgggaactgagcaattgtggaagagcagaactagcagacattcctcaggagggttctaatagagatgttaactgtttatagtctgctacattcattcatgatatttggtatgaaatttttgtttaaatgttttgattttggtaaagagcaattcttggatttgcttgcttgctattattagtaatgaagtcgacctactgtcatgctctt

SEQ ID NO: 626 - DNA, 528 bp, Centaurea maculosa
gcggggtaaacctttgctccatcttcttcttgtttcctccgcatctgcatccaaaatccctaattctctctttccagatccctaattctctttctttctttctttcgatctcttcttctagatcgccatggatgctttggattcagtattcgagccattgagagagttctcaaaggacagctaccgtctagtcaagagatgccacaagcctgatcgcaaagaattctcgaaggttgcggtccgtacggcgattggtttcgtggtgatgggattcgtagggttcttcgttaagctcatcttcatccctatcaacaacatcattaccggatctgtttagaggtcatacaatcatcaagggatgcatggaggatgttagttgtgttcaaaatggtttaaaaagagaactatgatgtattgtaggaaacttttttggtgttttgttcaagtagaatgagatttgttatttggtacttatactagcttttatatcatctactttgttgttgaactaatgctagtttctacatc

SEQ ID NO: 627 - DNA, 610 bp, Centaurea maculosa
tattgctcttccatttgcaaatttctggaagcttcaacaatggacgccatagattcagtcatcgatccattgagagactttgctaaggacagtgctcgtcttgtgaaacgatgccacaagcctgatcgcaaagaattcacgaaagttgcgtctcgtactgcgattggattcgttgtgatgggattcgtcggtttcttcgtcaaattgatcttcattcctatcaataacatcatcgttggcgctagttagggctgcatggaggttgaagcatgcatgcaactgaatagcaatctcagaggtaaaaataacatgaatatatgcttaacgactgctcagacatatgatacatttatctctctgtcattcttgtattaagaccgataaaaatgagaatttctgaatttcgaatgcctgttttctgtttttgttattgcttgaaagtagctaaatagtcacttgaaaacactgggatttctgcttgaaagtagctaaataggccctgaaataacagggtaaagaaaatccccaatgggccgagaagccccaaaacactaggaattctgctgtaaggggttgtttgattgatttttcattaagtcatgtatgaacg

SEQ ID NO: 628 - DNA, 573 bp, Castanea mollissima
aattgtctctctctctctctctcaaaccctcagctatcaaatttcagatctagctctctctttctctctctctctctctgtgacatagaatcggagaaatggacgccattgactcagtcgtcgatcctctcagagagttcgccaaggatagcgtccgccttgtcaagcgctgccacaagcccgatcgcaaagaattcacgaaagtggcgttccgtacagcgatcggattcgtggtgatgggattcgtcggcttcttcgtgaagctgatctttattccgatcaacaacattatcgtcggttccgcataggttatgtgaagaagcactaatttgctagaggtggaaggcagatgggtcagagtgaaacttaatttttaagaggaatgcttagcaagtagcttcttaggtcttatttgatatgtatgcatttctcttgtagacaatgaaatttggtggttatgtacttgtttttataatgagacctgtattgactgttcttattatattttcgatagtgaattggttggctcctttatgagtttgagctcaatgggcctaaaaacaataaaaccag

SEQ ID NO: 629 - DNA, 534 bp, Castanea mollissima
tttactaaaagaagaagaaagaagggagagatggaggccatagactcagtgttcgatccactcagagaattcgccaaggacagcgtccgcctcgtcaaacgctgccacaaacccgaccgcaaagagttcaccaaggtggctttccgtacggccatcgggtttgtggttatggggttcgttggcttcttcgtcaagctcatcttcatccccatcaacaacatcatcgttggctcctcttgatgtcagtctagattgcaggccaacatgaaggatggtagttctcggtagggtagtcacagcacatgggagatcaaagatctgtattctgacgtttgtttgtatttgatacattatttgagtacattttcttgttttcagattagactttcgagttaaattgagctggtttatattgcaactttcattcttagtctataaccctttaatctgtcaggatggaatacaagtttcattcttgttgttagttttctccatattaatcaattgatcatccttgttggctctaaaaaaaaa

SEQ ID NO: 630 - DNA, 657 bp, Cichorium intybus
gccaaattaatggggaggttagcttcacttcaattagggcaccccccaggggctttaccaacttttaatggtttcccggggttttggtatggtttggggggtgggaaatttggtggaggcgggaaataaaccaaattttcaaacaacagggaaaaccaggtttaatgacccaatgaattacggcgtctccttatttcctccgcatccctttcaaatccccaattctcttttagatctgacagttctctcgatctcttgataaggatgcgttggattccgtgttcgagccgttgagagagttctccaaggacagctatcgttagtcaagagatgccacaagcctgatcgtaaagaattctcgaaggtagcggttcgtacggcgattggtttcgtggtgatgggatttgtaggcttcttcgttaagctcatcttcatccctatcaacaacataattgtcggatctgtttagaggtcacacaattatcaagggattgatggaaaaggaagttagttgtgtgcaaatgggttcaagttgagaagtatgatgtactgtagggaacttttttggtgttttgttcaagtagaatcagatatgttattcgatacttaaatgttgaacttctgttagtttttacatgatcagtatttttataaacc

SEQ ID NO: 631 - DNA, 472 bp, Citrus sinensis
ggagaaaacgaaaatggacgccatcgacaacgtcttcgatccgctcagagatttcgcaaaagacagcttgcgtctcgtcaagaggtgtcacaagcccgatcgcaaagaattcacgaaggttgcgttccgtacggcgatcggattcgttgtcatgggattcgtaggtttcttcgtcaagttgatcttcatccctatcaacaatattattgttggatctggataaggctgcagagttgctggctttgatgatggaagttatcagcagattgattcacacccttcaacgaaggaatgagttaacccgtttagaattttattagacagtacctcaaatatgccttgaatctttttgaattagactttatatttgcttttaagttgacttattccggaaatattttacttttgtcgaaaattagtttgttcttacagattggaacttgctacgttaaatcattttgtttactttaaa

SEQ ID NO: 632 - DNA, 590 bp, Coffea canephora
ggggcttccctttcttcttagaagagggaggtcattttggttttcttgcgagctagtgcagacagattgagattttcagccgaaggcaaaggcacagaagagagagagagagagagagagagagagagagaggctgccaaacaaaagggaaggaagaaagaatggatgcgttggattcagttttcgatccgctgagggatttcgccaaggacagcgttcgtctggtcaagcgctgccacaagcccgaccgcaaagaattttccaaggttgcggtgcgtacagcgataggattcgtggtgatgggattcgttggattcttcgtcaagctcatcttcatccccatcaataacatcatcgtcggatctgcctgactctctttccccacagatctgggctgtctggatgcgatagtaagcaaacactctctaaggttacaagagcagccagttggtgacacagaaaagatgctttgtgcctgagtagccactctttctctctttaactgaataccagactttttgattgatatcagtagcattttgatgctgaacaaatagctttgatcaaatcaagtttatattgttcatcat

SEQ ID NO: 633 - DNA, 529 bp, Coffea canephora
  misc_feature (264)..(266): n is a, c, g, or t
  misc_feature (374)..(374): n is a, c, g, or t
  misc_feature (379)..(379): n is a, c, g, or t
tccctctctttctctatatatttttcttcctctctccaccccaaaatttccccatttttgttggaaaaaaaagggattttcattttctagagaagataaaaatggacgctttggattcagtattcgatccgctgagagacttcgccaaggatagcgttcgtctcgtcaagagatgccacaagcccgatcggaaagaatttacgaaggtggcgacgcggacggcgatcgggttcgtggtgatgggatttgtggggtttttcgtgnnnttgatcttcattcccattaacaacatcatcgtgggagcttcttaatccctaataggtagcagcttttgccttgaggaacttggatttacttttttgaggaaagtttgnttagntggagttctagtcccttgggattaggctagaagaatgtacttttattagtgatcttgaacttgtatttttgactgatggaagtactagttattaaattccattcctacagttcagttagctcccctgcttttgcattttgctcactctat

SEQ ID NO: 634 - DNA, 535 bp, Gossypium hirsutum
gaagggaaaacaaaaatcaaactctaccttcaaaactaggagaaaaaactaaaaatggatgcaattgactcagtttttgatccgctaagagagttcgctaaggacagtgttcgtcttgtcaagagatgccacaagcccgatcgtaaagaatttacgaaagtagcggtccgtacagctatcggattcgtggttatgggattcgtaggatttttcgtcaagctcatctttatccctattaacaacattattgttggatccagttagccttgcttcatgttacagactcacaggaaggacaggagccggtagaaattttcaacactgagataaaagaaagaactgtatgtttttagattgagagctatatcatgtgagtttttgaactagttttaatttaagccttgggttgtcttatattcggttttgttgtaatagaatcttgttgaagcaagtgagttttggtctaaatgaattttatgttcaggctaacagtgtacttgatgatataatccaatgaaatatccgtaaaactcga

SEQ ID NO: 635 - DNA, 531 bp, Gossypium hirsutum
  misc_feature (19)..(19): n is a, c, g, or t
  misc_feature (24)..(24): n is a, c, g, or t
  misc_feature (466)..(466): n is a, c, g, or t
ggatttaaagaaaaaaaantcaancctttttcatcgtagagcaaagctaaaccagaagaaaggggaaaatggacgcaattgactcagttttcgatccactgagagagttcgctaaggacagtgttcgtctcgtcaagagatgccacaagcccgatcgcaaagaatttaccaaggttgcgttccgaacagcgatcggattcgttgttatgggattcgtaggatttttcgtcaagctcatctttatccctattaacaacattattgttggatccggttaggccttgtcaacgtttgctgaaaatcggtagaatgtttaagttaagaggtacgtcatgagtttatgaagtaatttcaatttagacttgggtttgtctttaaattcagttttgttgaaaaagggttcaattttggtgtttgtaatagaatcttgttgaagcaagttcaatcttttgacttgatacaaacnaaggcatatgtgtagattgtggtacgcatttttttataccaagtttaaacacatttctcacagca

SEQ ID NO: 636 - DNA, 530 bp, Gossypium hirsutum
ggcacgagcgaaatcttcgaaatctccctctaacatcttaacatacgattttggttgtgtgggagagagagatggacgcccttgacaacgtggtagatcctttgagagacttcgccaaggacagcgtccgcctcgtcaagcgttgccacaagcctgatcgtaaagagttcacgaaggtggctttccgtacagcgatcggtttcgtagtgatgggattcgtcggattcttcgtcaagctcatctttattcctattaacaacatcatcgttggctccgcttaggaattgcaggctcgtagaaattggtgggggatatgaccagttggcgtagttgcagattctcatagaaaatgaatgttagaatgcagcagttgggggctgtccctctttccttttcattttacattttattagttgaaccaaatagtcttgaatctaaactaaactctcttggaatttctttgagcactttgtaatagattatggttaatttttgcatcgacttttgtcgtcttcttttttttttgtgcc

SEQ ID NO: 637 - DNA, 954 bp, Gossypium hirsutum
  misc_feature (142)..(142): n is a, c, g, or t
gagcagaaatcagctaaataaacaggaaaaatggacgcaattgactcagtttttgatccgctaagggagttcgctaaggacagtgttcgtctcgtcaagagatgccacaagcccgatcgcaaagaatttacgaaggtggcgntccgtacagcgatcggattcgtggttatgggatttgtaggatttttcgtcaagctcatctttatccccattaacaacattattgttggatccggttagccttgcttcatgttacagactcacaggaaggacgggaactggtagaaattttcaacactgagataaaagaagaactgtatgtttttagatcaagagctatatcatgtgagtttttgaactagttttaatttaagccccgggttgtcttatatttggttttgttgtaataggaagggaaaacaagaatcaaactctaccttcaaaactaggagaaaaaactaaaaatggacgcaattgactcagtttttgatccgctaagagagttcgctaaggacagtgttcgtcttgtcaagagatgccacaagcccgatcgtaaagaatttacgaaagtagcggtccgtacagcgatcggattcgtggttatgggattcgtaggatttttcgtcaagctcatctttatccctattaacaacattattgttggatccggttagccttgcttcatgttacagactcacaggaaggacgggaactggtagaaattttcaacactgagataaaagaagaactgtatgtttttagatcaagagctatatcatgtgagtttttgaactagttttaatttaagccccgggttgtcttatatttggttttgttgtaatagaatcttgttgaagcaagtgagttttggtctaaatgaattttatgttcaggctaacagtgtacttgatgaaaatccaatgaaatatccgtaaaactcaagcgactgactca

SEQ ID NO: 638 - DNA, 449 bp, Gossypium hirsutum
aaaccaggaaagggaaaaatggacgcaattgattcagttttcgatccgctaagagagttcgctaaggatagtgttcgtcttgtcaagagatgccacaagcccgatcgaaaagaatttacgaaggtggcgtttcgtacagcgatcggattcgtggttatgggattcgtagggtttttcgtcaagctcatcttcatccccattaacaacattattgttggatctggttaggaagcatgagaatcagtaccaagtttcagactgtcggcaaaagatagaagttagaagtggatgcaattgactgagaggtacatcatctgatttcatgaactaattcaaacttagacatggaaatttctagttttctttatattcaatatgtttgagattatttttgttttagcattgtaatagaatcttgttgaaataaacacaatcattctgacctccaa

SEQ ID NO: 639 - DNA, 475 bp, Gossypium hirsutum
atcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccggattctgagtagacctttgaatccttgatggatcagccaatctcggaaaggaagtttcgt

SEQ ID NO: 640 - DNA, 528 bp, Vigna unguiculata
gggatatttattcagttttcaattcagatccaaaggtagaaggaaaagtgagagagaatggacgccattgattccgttttcgatcctctcagagaattcgccaaggacagcgtcaggctcgtcaagcgctgccacaaacccgatcgtaaagaattctctaaggttgccgtgcgtactgcgattggttttgttgtgatgggattcgttggttttttcgttaagctcatcttcattccaatcaacaacatcatcgtcggatctggttaggatgaggggaatttcaattgcctcaggaattcaagttgttaaacattaagaggcagaatgagttcccactttgttaggtcatttaatgaatttaattgtagttcttttgtactttatttttggtatttacttgtatcttatcttcggaagcattacagttttattcgaaatgtacaattttattttctgtgttagacctttgacacattgttttgatctaggaaaaggatgaaagtagttgacaaacttttcttttggttt

SEQ ID NO: 641 - DNA, 607 bp, Vigna unguiculata
gcgggaagacaaaaggattcaacacctatttccattctcgaatccaaagttgggaggcagagagagtgtgtgagagagacaatggacgccattgattctgtcttcgatccactcagagaattcgcaaaggacagcgtgaggctggtcaagcggtgccacaaacccgatcgaaaagaattctccaaggttgccgtgcgtaccgcaattggtttcgtggtgatggggttcgtggggtttttcgttaagctcattttcattccaattaacaacattatcgtcggatctggttaggttgaggggaactgcaattgcctcaggacttcaagttatcaagaaaatggaggctgaaagaattccccaagaatagataattaatcttgttatatttcagttttggtttttccttatgactgggaggaagctatgaaagtttgtgcttatcttttgttatataccttgacactttgcttttgatttaggataaggaggaaaagggaatggtgaaactgtagttttgtttttagacgatgataactgttttctttcttatgaggttgaccaatatgagtatcttttcataatagcattttgtaattaaaaaaaaaaa

SEQ ID NO: 642 - DNA, 805 bp, Cryptomeria japonica
  misc_feature (125)..(125): n is a, c, g, or t
gagcccgacttcaagccgacgaaaaatcatttatttaaaagaaaacagtaaattcttccaatactaataccgtcgagactaattttaaggtcaggttttatactggtcgccattgtagaactctnggaggcttttatcgtggaatagatcggctctacatttttacaacgcgtgaattgagcttagatctatattttactgaatcatggaggctgtggacactgttgtacaacccttgaaggagtttgctaaagatagcatcagactcgttaagagatgtcacaagccagatcggaaagagttcagtaaagtggcattcaggacagctatcgggttcgttgtgatgggttttgttgggttctttgtgaaattgattttcattccaattaacaacatcattgttggatctggataggggattcaagaaacaatgatggggactggcatatacatgcgtgattggagatgattgattcatgctatttgtatcgccagatttctgttttctccttgtatttctatggatacacagcattttatacttgtcagaagggtgtcttcatatggattttgaaaatacttcatatgaagataatagaattaattagagtggcatagcaagaacaataatcactctatgatggtccttttttggcatcagtaggttgagttcctttcatgtagagcaatttaattctgggatgttcagtcgtagagcttactggctggaaattaacggagtaatatttctagtttttgcttcttgattttttatttcaagaataatgaggttaatttttccctg

SEQ ID NO: 643 - DNA, 569 bp, Cryptomeria japonica
  misc_feature (484)..(484): n is a, c, g, or t
aatcatggaggctgtagatactgttgtacaacccttgaaggagtttgctaaagatagcatcagacttgtgaaaagatgtcacaagccagatcgaaaagagttcagtaaagtggcattcaggactgctatcggttttgttgtgatgggctttgttgggttctttgtgaaattgattttcattccaattaacaacatcattgttggatctggctagggattcaagcaaatgatgatggggcctggcatggtcatccttggttggacaagattgcttcatgtagtcgatattttataatgccagatttcttttgttttccccatgtattccatcggtacaatgatttttctctacttgttagaatgttaaagaccatgtaactaagatatctttggttggtgtttcacttgaaacctctataaacatggtttatatagtgatttcatatagagaaataatgtaaaatgtttgcttatttgtggttanaatattttcgagtggaataatttgcgtactcttttgagtatttatgtacttttggcagatatttaatccttaacagagttattac

SEQ ID NO: 644 - DNA, 448 bp, cucumber
ccgttcccaattatcaaaattttctttcttcttcgcggggaacggatgccattgattctgttgttgatcctctcagagccttcgctaaggacagccttcgtcttgtcaaaagatgccacaagcctgatcgcaatgaattcactaaagtggcattccgtacagctatcggtttcgtcgtgatgggatttgttgggttcttcgtcaacttgatctttattcccattaacaatataatcgtcggatcttgaaagggttgaagttcctgattggaagcattctagttgaacacattttcactgagtaatgtcaaacagttgtctttgtcacttcggcattttataattttcccctcctgatttatagtcttttgtcaagcaaactgcaaaccgcgtttgagtatatatgattacagtgttcattttcttttccttatttaataaattttctc

SEQ ID NO: 645 - DNA, 504 bp, cucumber
gccacaattcgttcaaaccggaaaccaaatttcgcgataaacatttcttttggtgacgcttccttccgatctcggacccatggatgccgtagattcagtcgttgatcctctcagagagttcgccaaggatagcgttcgcctcgttaagagatgtcataaacccgatcgcaaggaattcaccaaggttgccgttcgtaccgctatcggcttcgttgtgatgggatttgtagggttctttgtcaagctaatcttcattccgatcaacaatatcatcgtcggatctggttagttaggtaatgacaaagtacgtaggtgacggctggcgtttacgtttagtgcaacctgttttcattgaggaatactgagctatattaggtctcctttagaacttttaaatccgcgtgcgtaaattgagtaaacaccaggatatatggaaattttcctgtcatattgatgaactcactttctatttatatttcaatgttataacatgttatttttatc

SEQ ID NO: 646 - DNA, 540 bp, cucumber
ttttgttcaccattttattaatcacacgagccggagccgcatcagaaacaaacaaaaatggacgccattgattccgtcttcgatccactccgggagttcgccaaggacagcgtacgtctcgtcaagcgctgtcacaaacccgatcgcaaagagttcacaaaggtcgcggttcgtacagcgattggcttcgtcgtcatgggattcgttggtttcttcgtcaagctcatctttatccccatcaataacatcatcgtcggatctggctagacagctgaggccacaaaaggagcaggccggacaatatagaagaatggaacttgatcaactatttcaaatccttaccaatgttattattaatttaaaaagcttaatttattttctagagaagtataaaactccatgaatggctgtaacgaattgctaggattatgtcttactcctgattgatccagtgtccttgttcatggtcactggttattttagagtatagtgactaagtttttgctttatcatatgaaagttggcttcatcattggtatg

SEQ ID NO: 647 - DNA, 504 bp, Cycas rumphii
gctctaatttacaagtttgcgatacaattgcaaagggaaaatggaggctgtagagacagttgtgaggccattgcaagactttgcgaaagatagtgttcgcctggtcaagcgatgccataagcccgaccgcaaagagttcagtaaagtggctttcagaacggccatcggatttgttgttatggggttcgttggtttctttgtcaagttgatcttcattccaataaacaacattatcgttggatcaggataggtttgccttttgcaatcctctgggctcttgattgatattcaatggaggtgtggacaaatatcatatgatgctattcttttcaatcgattattttttagcactttgttttgctatttgtcagaaggcttttactactgtccagctggtgtactttcacagttgtattttgagcttggatgtaatgggggcgctctttatgatgtatctctacatagatttctagcaagcaaactaaaatttttaagttgttgcat

SEQ ID NO: 648 - DNA, 542 bp, Cynara scolymus
gcggggcgtatcgttggcgtaaaccttgctctcgtctccttgtttcctccgcatctgcatccgaatccctaattctctttccagatccgatatttctttcgatcatggatgccttggattcagtattcgagccattgagagagttctcaaaggatagctaccgtctagtgaagagatgccacaagcctgatcgtaaagaattttcgaaggttgcggttcgtacggccattggtttcgtggtgatgggattcgtagggttcttcgttaagctcatcttcatccctatcaacaacataattgtcggatctgtgtagaggtcatacaatcatcaagggatgcatggaggatcttagttgtgttcaaaatggtttaaaaggagaactatgctgtattttaggaaacttttttggtgttcctttcaagtagaatgagatttgttattcggtacttatactagtttttatatcatctactttattgttgaacttgtactagtttttacatcctctgcttttattgtttcacctgtgctcgaatgtgcc

SEQ ID NO: 649 - DNA, 558 bp, Taraxacum officinale
gtatacccttgctctctcgtctccttatttcctccgcatctcctttcaatccctaattcacttttccgatctgatttttctctcgatctcttgataatggatgctttggattcagtcttcgagccattgagagagttctcaaaggatagctaccgtctagtcaagagatgccacaagcctgatcgtaaagaattctcgaaggttgcagttcgtacggcgattggtttcgtggtgatgggatttgtggggttcttcgttaagctcatcttcatccctatcaacaacataattgtcggatctgtttagaggtcatacaatcttgaagggacagatgcaggacgatagtcgtgtgcaaagtggtttaagttgagaagtatgatgtattgtagggttcttttttggtgttatgttgaagtagaaagagatttgttacccaatactttaaatctttaatgttgagaacttatgttagcttttacattttgttttacttgtttgcatcattcttttcacctttagccttgggtagcttgtgcccaaatgtgacattcctgattt

SEQ ID NO: 650 - DNA, 436 bp, Taraxacum officinale
ctcttctttcccacaacacacctttgcattgttctccaagctcgacgatggatgccattgattcagtcatcgatccattgagagagttcgccaaggacagcactcgacttgtaaaaaggtgccacaaacctgatcgcaaagagtttataaaagttgcatctcgtactgcgattggattcgtcgtgatgggattcgtcggtttcttcgttaaattaatcttcattcctatcaataacatcattgttggcgctagttagggctgcatggagattgaagcatgctaatgaatagaaaaaactacgaagtatatgctttctttgttacttaattagtcgattttaaagtgaggattgttggatttagaatgttaatgtttgtttgctactatatgaaagttatcgtccatattgacaccacttatgttctgtttgactca

SEQ ID NO: 651 - DNA, 697 bp, Eucalyptus gunnii
  misc_feature (557)..(557): n is a, c, g, or t
  misc_feature (641)..(641): n is a, c, g, or t
  misc_feature (693)..(693): n is a, c, g, or t
cggccggggattcacccggatttcctctgcgtccgtcccgtcgcgaaatcgtcttcttcggtcgttagggttttcgagcgagcgagcgagagagagttttgggggcgatggacgccatcgattcggccgtcgatccattgagggagttcgcgaaggacagcctccgcctcgtgaagcgatgccacaagcccgatcgcaaagagttcacgaaagtcgcgttccggactgcgatcggattcgtggtgatgggatttgtggggttcttcgtcaagctgatcttcattcccatcaacaacatcatcgtcggttctgcttaggccatcaagaaagtggattcatgggaatataaggcgatttgttcagagcattattagttcaattggactggacatcagtgttgttcgaccttaggccttttatgttttccccctattatctttgtagtttatactcaatactgcacatttttgagtgttttaccttggattttgtcataatcaaggagtttatgtagttttgacattgcatcttcaatttctctatggcactagtcgatngaaattatctttgttttttacctttgatttcgtcataattgaggagtttatgtagttttgacattgcatcctcaatttctctgnggcactagttgatggaaatttaagtttgaaagggagtacgcatcctgcttanccgc

SEQ ID NO: 652 - DNA, 548 bp, Adiantum capillus-veneris
agagacagagcgagagacagacagacatagcgagagccatggacgcagttgaaggcgtgatcacgcccatcaaggatttcgctaaggacagcgtccgcctggttaagcgatgccacaaaccagatcgcaaagaatttactaaggtggccttcagaacggcgattggatttgtcgtaatgggtttcgtgggcttctttgtcaagctgattttcatccccatcaacaatattatcgtgggctcaggatagctttcgctgatgagcaatggaatccagacggatgggagccaatttttgtacgcttcttcaaagcagaagtataggatcaaatgactcatttacacttgtagtagctcattgagagcatgagcttgtattcacaaagagatcaaatttttgatgtgactggacacatgtatcccgtgagtggtgtgtcaagttgctcttaggatgaagttcttgttgtacattgcaaaagtgtcaaatcagattcagtttctgtgataatggctagaagggattctcaatgggatgctgtgcttttagggt

SEQ ID NO: 653 - DNA, 590 bp, Festuca arundinacea
ggcacgaggccttcccacgcgcgcgcctcgtctcggagatctcgctagcccgcgcgcccgccatggacgccgtcgactccgtggtggaccccctccgcgagttcgccaaggacagcgtgcgcctcgtcaagcgctgccacaagcccgaccgcaaggagttcaccaaggtggcggcgcggacggcgatcggcttcgtcgtcatgggcttcgtcggattcttcgtcaagctcatcttcatccccatcaacaacatcatcgtcggatccggctagattgcagagtaaaggatgtgctgcatgaagatagggcaatactagcaattgggccttcgttgtcaaagtttgttaaccctatttcgaaagttcttgttaaagacatttaactttgttcaatttctgagaagttgtggccagcttaatcgtcgtaatgaatagacattgaagtagcgagttataatgttcatgttgcagggcgactaactcaagtcgcgtgggtaaaaaaatcaagttgcttggggtaaaaaaaaaagtccctgtatgcctcaacaactaactctatgacgtagctggcaggattctgaaaagtggaat

SEQ ID NO: 654 - DNA, 628 bp, Festuca arundinacea
ggcacgaggcagcattctccctcccacgcgcgcgcctcgtctcgtctcgtctcggagatctcgccggcccgcccgccatggacgccgtcgactccgtggtggaccccctccgcgagttcgccaaggacagcgtccgcctcgtcaagcgctgccacaagcccgaccgcaaggagttcaccaaggtggcggcgcggacggcgatcggcttcgtcgtcatgggcttcgtcggattcttcgtcaagctcatcttcatccccatcaacaacatcatcgtcggatccggctagattggagagtaaagaatgtgctgcatgaagatagtgcaatactagcaattgggccttcgttgtcttgaaataagaaaacaagagaggcagcgatggggcgtgcacgggatgtgaattacaagaggtttattctgagtttgatgcctcttactaatttggtggggtcattcacaggcttaagatctgattggcattgttcctggggtatgattaggctgttttgctgataacacatccggatgataagactgttttgctaaccatagacaatcctttaactggggtaatgtatgaagagggacgaactgaaatgcactattatcaatatatgtgcttctgct

SEQ ID NO: 655 - DNA, 542 bp, Linum usitatissimum
gaatctcaaattgccctccgtgagttgagagaaacgatagagagacatcaggaaaaagtagaaggaaaatggacgccattgacaacgtcttcgatccgctcagggagttcgccaaggacagcgtccgcctcgtcaagcgttgccacaaacccgatcggaaagaattttccaaggttgcggtgcgaacggcgatagggtttgttgtgatgggattcgtggggttcttcgttaagctcatcttcatccccatcaacaacatcatcgtcggatctggttagattcagattataagatgaagggtggcgttgggaagcatggagcagctgctggggaaatttctgcagcatctgatgaagagattagacaacacaacccaatgtagtttagtacaagttggagtgatagttttgatgttttcatgtactttgattccgagtttttgttaagacttgcaagaaacagttccctttcctactgagtttaatcttcacctgttcaatattggatagatgtttacacatacattttgatccttttcgtcc

SEQ ID NO: 656 - DNA, 444 bp, Gerbera hybrid cultivar
ggccctgctctgtctccttgtttcctccgcgtctccattcaaatccctaattctccagatctgatctttctctcaatcgctcgataatggatgcattggattcggtgttcgatccattgagagagttctcgaaggacagttatcgtctagttaagagatgccacaagcccgatcgtaaagaattctcgaaagtagcgattcgtacggcgattggtttcgtggtgatgggattcgtagggttcttcgttaagctcatcttcatccctatcaacaacatcattgtcggatctgtttagaggtcgtataatcatcaaggagtgcatgaaggacagtagctgtgtccaaaatgggttaaaaaaggactatgatgtaatgtaggaaacttttttgatgttccgtttatgtagaacgagatttgttatttcatacttttaatgctgaatt

SEQ ID NO: 657 - DNA, 358 bp, Gerbera hybrid cultivar
ggtcatcgatccattgagagagtttgctaaggacagcgctcgcctcgtgaaaagatgccacaaacccgatcgcaaagaatttacgaaggttgcgtctcgtactgcgattggattcgttgtgatgggattcgtcggtttcttcgttaaattgatcttcattcctatcaataacatcatcgtcggcgcttcttaggggtgcgtggaggttaaagttgtgatgtaccttggctctgcacaaacatatcgtatgttcttaacagcaaagacctttcttatataatgatgcgttactaaaaggattttcttaaattttcatcaatgattttgttacttgcttaatttaataaaacgaacttta

SEQ ID NO: 658 - DNA, 2239 bp, Zingiber officinale
  misc_feature (995)..(995): n is a, c, g, or t
ggaagggccctattcaaatttggcataatgatggcttattaatatatacatggagtagaagctcatatatcataattatagtttaagttaacacaatttatgtaccaaaaggtcaagtgatctaaacagaattaccacacttttttatttagtttttttttcttctagacatgttaaatgcctacaacattgctcatgtttataattactttttatggtttagtttgttatgaatctgggactttctcatttctacaatgttttttgaaaaaaaacagtgttacaaaatgttacttgtaaagaccagagtccacaaggacatcttatatcccccacagtcctgtggtttgatgattgaagttgtatgctatctctagttatagtagaaaagttgatattgagagctaaatgtcaaacactgtctgacatgcatgaaatttcataaattctatggcctgacttcttccatttatgctatgtattgacaagataacccaaatagttggattcaagactttctgttgttttttcagtattcggctattgagcttcatacttgatatgtgatatatctttaatggatctatccaattgtacaaatcttccaagtcaattcaagtttattagaaaaattagataagctactgcttaaccacttttctaaattttagtagatcactatacagacactgagaatattatgatccaggagctgtgttattttgccatactaagcaggttttgttgtgaataaatactggattaaaaaaacttacatagtctgttcagatatggagtcaataatatggaagaaagtgcaaagaaaatctgtaaagctgctcgtgggatccctgaggggcattgtgttattattcttgcacacaatggtcctacaggtttgtcattgaattggatgatgattgttcattctttcaacaatccagacttctatttgcaggattagattcagatgcaacatttcgacttctgtttanaggattaggttcaaatgctgatgacatatgtggtatagattggatttatggaggcggtgaccatggcgacccagatcttgctcgagcaatatctgacttgcaaagagatgagcaaattcccatccctctggttgtttttggtcacatgcataatactctgcgatatggaggtcttaggaaaatgattgtggtcgcttctgataacaccatttacctaaatggtgctatagtgccaagagtcaaagactcgctgctggctgatccgggaagctcgacagaaggcctgactgatccgagaggctcggcagaaggccacaatcagttacaaacttctggtgtcagcaccttgcgtgcgttcactgttgttgagatgcttgacggagaggttgaaaaaattgcagagacctgggttttagtatctgacagtaatgtcgaaattggccaggagacctttctgtttcagaagcagtaatcacattgcttctctgtggatggcaactcgacccttttacaaagccctgcgtctctcaaagatgcggaataataaatagaaaataactaagtgaactcagtttgtatggatgatttgctctttgtaagaccttgttgttggtaaaggttcagtgctgattggttgctgatgttggaggtttggttttggtatttgcttgttgaatctagttggtcattgttgtgatgctatgatctatcctcgtgccgaattcggcacgaggcctcgtgccgaattcggcacgaggtaaatcactgatctggcaagcaagtaaacaaataagtcggattgcagtaatatactcctcaaggttaaacactagaaattttgaaagttcacttggatgcaaaaaagaacattttccttgacctacaattgactctcacaatgcagtttcatcgttgctctaaccccagcaccaacaaaattccttcaacctaaccagacccgacgatgatgttattgatcgggataaagatcagcttgacgaagaatccaacgaatcccatcaccacgaagccgatcgcggtgcggaccgccaccttggtgaactccttgcggtcgggcttgtggcagcgtttgacaaggcgaaagctgtccttggcaaactctctgaggggatcgacgacggagtccaaggcatccatttcgactacacaattgaggcgattactcttcacacacgagctttcttcgaggtcgcggcgatgatgcgacgcagcggcatggtgca

SEQ ID NO: 659 - DNA, 437 bp, Zingiber officinale
gcacgagggcgatctccgttttagggttggtggtgattatcgatggacgccttagactctgtggtcgatcccttgagggagttctccaaggacagcatccgtctcgtgaagcgatgccacaagcccgatcgcaaggagttcactaaagttgctgtccggactgcgattggcttcgtggtgatggggttcgtcgggttcttcgtcaagctgatctttatcccgatcaacaacatcatcgtcggttctggttagataaaggcaagggatggatgacctagggagctacaggagaggcaaggaggtgtgtgtgacagtggctcggctgggacgaataagacctgctataatgctttgttatgtttgatatgaaccattgtatttatgttacattccagtataactctatgacatttccgctgctttaagttataaaaaag

SEQ ID NO: 660 - DNA, 660 bp, Vitis vinifera
gctttccatttttgcatatatattcttcagattgatcgaaaatcagaaccctctctttctcggatatctaaccaatctcttgatcagataagatctagagctgtttctgcctgcagaaagcaatggatgccatcgataacgtcttcgatccgatgagggagttcgcgaaggacagcgtccgcctcgtgaagcggtgccacaagcccgatcgtaaagaattcaccaaggtcgcgttccgcacagccataggtttcgtggtgatgggcttcgtagggtttttcgtcaagctgatcttcatccctatcaacaacattattgtcggatctgtctaggcctctaaggaatggtggaaattgtctggagtgcgaaatgcttacacaggataaaattactttaagctttttaggttcttctttgacatgtaaactatcgggaaacaagcagattggtggatgttaaaatttctgagttgcattgagctcttctatgttggagacatacctgttggtttgttattcattttgatagtactcgaggttgaatgaattcacgaggccactgtaaccagttggttattttgctaaacattaattttctttattttttgtttattttttcatctattatgaagacgtgaatgagtttagacttgcaaacaaa

SEQ ID NO: 661 - DNA, 473 bp, Vitis vinifera
gcccattttggcccaaaagtccaaaataggagcgtaagtctttgaaacgccgtcgtttcgtcgtcgtcgtcctcctcctctacccgatctagggtttctgtgtggttgtcaagcggagagaaatggatgccatcgactcggccgttgatcctctgagagagttctccaaggacagtgttcgtcttgtcaagcgttgccacaagcccgatcgcaaagagtatacgaaggtggcgttccgtacagctactggattcgtcgtgatgggattcgttgggtttttcgtgaagttgatcttcattccgatcaacaacatcatcgttgggtctggttaggccttgtggagatctgagtctagtacaagagaatagaggctatccggttgagcagtgctttgttacaaacaatgtttaggttcttttttgatgtgcacaacttaactgagtaaactataaaaactagaagttttggatttc

SEQ ID NO: 662 - DNA, 516 bp, Mesembryanthemum crystallinum
  misc_feature (24)..(24): n is a, c, g, or t
tgactagttctgagcgatcgcggncgcgtcgccaaaacactttctctctctctactttctctctctaatttttatctctctacgccatggacgccattgacaacgtcgtcgatcccctcagagaattctccagggacagcgttcgcttggtcaagcgttgccacaagcccgatcaaaaagagttcactaaggttgcatttcgtaccgctgtcggcttcgtcgttatgggatttgtcggatttttcgtcaagctgatctttatccccatcaacaacatcatcgttggatctacttaggtttatagttacggcagagtcctcaaaaggagaggggcagttcagttgagtcctacagttcaggccatgaggagaatcacctattcttgcagaatgcgtagttaatagtactcatttaggtttattttcttccagaacatcgatatcgttgagatgtatacatcggttacaatgaactaagcataagatttttcaaactatattgatgtttgcttttctc

SEQ ID NO: 663 - DNA, 593 bp, Ipomoea nil
  misc_feature (259)..(259): n is a, c, g, or t
  misc_feature (275)..(275): n is a, c, g, or t
  misc_feature (286)..(286): n is a, c, g, or t
  misc_feature (302)..(302): n is a, c, g, or t
  misc_feature (318)..(318): n is a, c, g, or t
  misc_feature (335)..(335): n is a, c, g, or t
  misc_feature (357)..(357): n is a, c, g, or t
  misc_feature (396)..(396): n is a, c, g, or t
gtatttcagatcggaatcacaaaaagcggcggatacaagtgatggatgctttagatacggtgttcgatcccttgagagacttcgccaaggacagtgtccgtctcgtcaagagatgtcataagcctgatcgcaaagaattctcgaaagtggctgtacggactgcgattggattcgtggtgatgggattcgtagggttctttgtcaagctcattttcatccccatcaacaacattattgtcggatctgcttgattttaatnatgaacaatcaagatntggaattttcntggtgttgaaaattgnttcattgtataatggntgacctaaagtacacangggacttttgtcagctgttagnaggaggtgccaacttcttagttacattttttgttctttnagtaaaagcttcaaaatgactgactgctgttttgttggatgtagcttcttgtagtaagtgtaagatagacattatacttacccacctaccacttcttctgagtttatactttcatttatgcacttttgccttctgagctttgacatgttacataagtaaaaaaacaacagttatactgtggacccaaggtccatgat

SEQ ID NO: 664 - DNA, 528 bp, Ipomoea nil
  misc_feature (57)..(57): n is a, c, g, or t
  misc_feature (62)..(62): n is a, c, g, or t
  misc_feature (68)..(68): n is a, c, g, or t
  misc_feature (131)..(131): n is a, c, g, or t
  misc_feature (156)..(156): n is a, c, g, or t
  misc_feature (188)..(188): n is a, c, g, or t
  misc_feature (203)..(203): n is a, c, g, or t
  misc_feature (254)..(254): n is a, c, g, or t
  misc_feature (295)..(295): n is a, c, g, or t
  misc_feature (305)..(305): n is a, c, g, or t
  misc_feature (311)..(311): n is a, c, g, or t
  misc_feature (325)..(325): n is a, c, g, or t
  misc_feature (347)..(347): n is a, c, g, or t
  misc_feature (398)..(398): n is a, c, g, or t
  misc_feature (400)..(400): n is a, c, g, or t
  misc_feature (423)..(424): n is a, c, g, or t
atacttccgtgccgggtcaaattcagatactcaatccaattcccattgctgaagctncaganagttgngaaagtatggatgctttggacgcagtttttgatccattgagggacttcgccaaggatagcgtncgtctcgtcaagaggtgccacaagnccgaccgcaaagaattttcgaaagttgctgtncgcactgctatcggnttcgttgttatgggattcgtaggcttcttcgtcaagctcatcttcatcccnatcaacaacatcattgtcggatctgcttgattcttagattncggtgatganagatcntccaatgaagagcntagatgttttgtattttatttntcaatcactatcactaggtttacagatgctatagtgaaatacgggaagttntnttactcttttaagttgctttganngtttgccataatttgtttcataacctttcatgctccttgaaggatgtttagtggcctagtagtgaatttttcttaaatgaatgatcattttctttcatttatag

SEQ ID NO: 665 - DNA, 267 bp, Ipomoea nil
gctcagaatccgcctcgtcaatcgcttcccttctccggcaaaggctaaagttttcgtgatcgagagaaatggatgctttggattcggtgtttgatcctcttagagacttcgcaaaggacagcgtccgtctcgtcaagagatgccacaagcccgaccgcaaagaattctcgaaagtagcggttcgaactgcgatcgggttcgtggtaatgggatttgtagggttcttcgtcaagctgattttcatccccatcaacaacattatcgtcg

SEQ ID NO: 666 - DNA, 594 bp, Jatropha curcas
gaagtggtatcaacgcagagtgcccattgcggtagggggtagtttgtcgtttttatccgttaacaaaatcctattttcgccctctgtctcaggaacttcaattatctcctaattaaacagatctagggtttctctttgcaattgagcgaaatggatgccttggactccgtcttcgatcctctcagagagttcgccaaggacagtgtacgccttgttaagaggtgccacaagcctgatcgcaaagaattcacgaaggtcgcgtaccgtactgcaattggtttcgtggtgatgggattcgtcggattcttcgtgaagttgatcttcattccgatcaacaacattatcgtcggttctagttaggcctggtggattgttaacaaatctaaggatgaagtgctttcagttgaaatttgtttctgaagaggaatacttagcagttagctcttgtatgttcttttttgatatgtattcaatacttgagtaaaccaggaattatgaatttaacccttaagctttttctcttagttctgaaatttgatggttgcctcttgtactatattttgtttcatctcacggaattggcatattatgctt

SEQ ID NO: 667 - DNA, 587 bp, Actinidia deliciosa
  misc_feature (289)..(289): n is a, c, g, or t
  misc_feature (311)..(311): n is a, c, g, or t
ctctctctcttcgaaattagggttcgtgagatttttcttgtaattgtccttcgtatcagagcaatggatgccctagactctgtcatcgatccgctgagagagttcgccaaggacagcactcgcctcgtcaagaggtgccacaagcccgatcaaaaagaattcacgaaggtcgcgtttcgtgttgctatcggtttcgtcgtcatgggattcgttggcttcttcgtgaaattgatcttcatccctatcaacaacatcatcgtcggatccgcataggctttgttgatgctgnattttggaaaggatgaaacctnttcgaatgagtgcaaagtgggttggggatagcttacatctatagtttttaggcatttcttaatttgtatttcttactcctaagtaaatcttgatatactctggtggtttcttcaaacttgtatcagtatcatgctttattacctttgcaggatttttaaaccttatggtgccttgcggtgctgagcatcgttattgtaggaagcccccaccaaacaccttgagcaatagcttaggggactagtaatacatacgatattgagtagcaaaaaaaaaaa

SEQ ID NO: 668 - DNA, 645 bp, Actinidia deliciosa
  misc_feature (32)..(33): n is a, c, g, or t
  misc_feature (38)..(38): n is a, c, g, or t
  misc_feature (370)..(370): n is a, c, g, or t
  misc_feature (378)..(379): n is a, c, g, or t
  misc_feature (383)..(383): n is a, c, g, or t
  misc_feature (415)..(415): n is a, c, g, or t
  misc_feature (434)..(434): n is a, c, g, or t
  misc_feature (440)..(440): n is a, c, g, or t
  misc_feature (452)..(452): n is a, c, g, or t
  misc_feature (454)..(455): n is a, c, g, or t
  misc_feature (463)..(463): n is a, c, g, or t
  misc_feature (467)..(468): n is a, c, g, or t
  misc_feature (486)..(486): n is a, c, g, or t
  misc_feature (497)..(497): n is a, c, g, or t
  misc_feature (499)..(504): n is a, c, g, or t
  misc_feature (506)..(507): n is a, c, g, or t
ccttccagatctaggcgctactctctctctcnntctcncgattctctctctactcctggagaatggatgccttggactccgtattcgatcccctgagagagttcgctaaggacagcgttcgcctcgtcaagagatgccacaaacccgatcgcaaagaattcacgaaggtcgcgttccgtacagcgattggatttgtggtgatgggattcgtaggctttttcgtgaagctgatcttcatccctatcaacaacatcatcgtcggatctggttgaggtcaggaccgtcggtgaaaatgtgagcatgcatgaaagtggcggatatcattagggcgcaaaacagggatgggtttaagttttgtaggatccttttnaccacagnnattnactgtggacaattgattcatgaaagatgttcncaatagagttgtagtgttnaacatnaaatttcttttngnnttcgtgcntacnnattataaacagaggatcntgtcttttttnannnnnnannatgaacaaggtcttgttggattcagcataatgtttaccttttaaaagcgtcatgtcggattaagagagattttaggaagataaagattgtagtttgtgcctaggcatggctacagcggtgtgtgttcattgtcccgat

SEQ ID NO: 669 - DNA, 471 bp, Lactuca sativa
tttcttccgcatctccttcaatccctaattctctttcagatctgatatttctctcgatctactgataatggatgctttggattcagtcttcgagccattgagagagttctcaaaggatagctaccgtctagtcaagagatgccacaaacctgatcgtaaagaattctcgaaggtagcggttcgtacggcgattggtttcgtggtgatgggatttgttgggttcttcgttaagctcatcttcatccctatcaacaacataattgtcggatctgtttagaggtcatacaatcatgaagggatggatggaggacgtttagctgtgtggaaaatggttttacatcgagaagtatgatgtattttagggaacttttctggtgttatgttcaagtagaaagagatttgttttttgatactttaaatctttaatgtggaaccttatatactagtgtttacatcatctgctttttgttt

SEQ ID NO: 670 - DNA, 665 bp, Lactuca sativa
  misc_feature (261)..(261): n is a, c, g, or t
  misc_feature (326)..(326): n is a, c, g, or t
  misc_feature (342)..(342): n is a, c, g, or t
  misc_feature (358)..(358): n is a, c, g, or t
  misc_feature (413)..(413): n is a, c, g, or t
  misc_feature (506)..(506): n is a, c, g, or t
  misc_feature (535)..(535): n is a, c, g, or t
tactgtcatttatgaataaaaagattttcgtaaccgtaatccccccctttcattttttctccccaactactccttcgccgttttctcgacgcttcgacaatggacgccatagattcagtcatcgatcctttgagggggttcgctaaggacagtgctcgccttgtaaagaggtgccacaaacctgatcgcaaagaatttacaaaagttgcttctcgtactgccattggattcgttgtaatgggattcgtcggcttcttcgtnaaactaatcttcattcctattaataacatcatcgtcggcgcttcttagggcagcatggattgganattgaagcatttaaangtgagaataacatgantactaatgtgcttaatctctatgcatatgtatcgtatggttttctttgctacttngcattactactgataagtgaggatagagtgagagttgtggaaggtgtccaaagtgtatcgtatgtttttcttttcattgttactttgcattantcgtgacatcattttattaaaatgagacngagaaaaaaaaaagccaatgaaaacgtcggatttgtcttaaaatattgattctctgctttgtaaacatgttttattatgttgttattgaatgcgaaaagatgccaacaatttcttcttggtatccctgac

SEQ ID NO: 671 - DNA, 516 bp, Lactuca sativa
actcgaagcttcgacaatggacgctacagattcggttatcgatcctttgagagggttgctaaggacagctgctcgccttgtaaagaggtgccacaaacctgatcgcaaagaatttacaaaagttgcttctcgtactgcgatcggattcgttgtaatgggattcgtgggcttcttcgttaaactaatcttcattcctattaataacatcatcgtcggagcttcttagggcagtagcatgggattgaagcatttaaagaaatagtaacatttagaggtgagaataacatgaaaactgatgtgcttaatctctatgcaaatgtatcctatgtttttggaattactgctgataagtgagtatagagtgagagatgtggaaggtgtccaaaatgtattgtatgtttttcttcgttactttgcattactctttagatcgttttattaaaatgaatgagactatgagaaaaaaaatccaaggaaaagtaattcccaccccaaaaagtaaaattttgttggcgg

SEQ ID NO: 672 - DNA, 502 bp, Lactuca sativa
cgcatctccattcaatccctaattctctttcagatctgatatttctctcgatctattgataatggatgctttggattcagtcttcgagccattgagagagttctcaaaggatagctaccgtctagtcaagagatgccacaaacctgatcgtaaagaattctcgaaggtagcggttcgtacggcgattggtttcgtggtgatgggatttgttgggttcttcgttaagctcatcttcatccctatcaacaacataattgtcggatctgtttagaggtcatacaatcatgaagggatggatggaggacgtttagctgtgtggaaaatggttttacatcgagaagtatgatgtattgtagggaacttttctggtattatgttcaagtagaaagagatttgtttttttgatactttaaaatctttaatgtggaaccttatatactagtttttacatcatctgctttttgttttacttgtttgcatcatttttttttcacttctcgcc

SEQ ID NO: 673 - DNA, 531 bp, Lactuca sativa
acccttgctctcgtcttcttatttcttccgcatctccattcaaatccctaattctctttccagatctgatatttctctcgatctattgataatggatgctttggattcagtcttcgagccattgagagagttctcaaaggatagctaccgtctagtcaagagatgccacaaacctgatcgtaaagaattctcgaaggtagcggttcgtacggcgattggtttcgtggtgatgggatttgttgggttcttcgttaagctcatcttcatccctatcaacaacataattgtcggatctgtttagaggtcatacaatcatgaagggatggatggaggacgtttagctgtgtggaaaatggttttacatcgagaagtattgatgtattgtagggaacttttctggtgttatgttcaagtagaaagagatttgttttttgatactttaaatcttcaatgttgaaccttatatactagtttttacatcatctgccttttattttacttgtttgcatcatttttttttcacttctagcc

SEQ ID NO: 674 - DNA, 543 bp, Glycyrrhiza uralensis
ttttattttaaataaaccatagcagaacccctccctaaacaaatcactacttcaatcctcagatcgaaacaaaacgcaaagagaaagaaaaagagagaatggacgccatcgattccgtattcgatccactcagagaattcgcaaaggacagtgtcaggctcgtcaaacgctgccacaaacccgatcgcaaagaattctccaaggttgcagtgcgtactgcaattggtttcgttgtgatgggattcgttggctttttcgtgaagctcatcttcatcccaattaacaacatcatcgtcggatctggttaggatgagggactacaatcgcctcaggaattcaagttgtcgagcaaaaggaggcagaaagagttcccgcttcagtagatcgttcagtgcactttaacgtagttctttatttcagttttggtttttccttatttcttatgttctgaagaattacagttttatttaaaatgtaaaattttacttttcgatgttagaacttgacacattgtctggatttaattagaggaaaatatttgat

SEQ ID NO: 675 - DNA, 461 bp, Liriodendron tulipifera
tctcctttcctcctttgtaatggatgccctagattccgtcgtcgatcccttgcgagaattcgccaaagatagcgcccgtctcgtcaagagatgtcacaaaccggatcggaaagaattcacgaaggtcgcgatccggacggcgatcggattcgtcgtaatggggttcgtggggtttttcgtaaagctgatcttcattccgatcaacaatataatcgttggatctggttaggttgcatgcgaaggaagttgattggggggcagaagctgtccatcaagtggagatagaaagactgatagatacagaaactctcgactgctagtcttctttttagttgtgatagacatatacctcccaagtttttggtattcaacttagtttcaagttcccttttcttctttttcttgaaaattcatgttgatttgcatatttttggtgggtgttattacttcatgattttgtc

SEQ ID NO: 676 - DNA, 580 bp, Liriodendron tulipifera
ttcctttctgcggtttttccattcctttatcggagattagggtttcttttttcttctctatctgagatggatgccatcgattccgttatcgatccccttcgagacttcgcgaaggacagcgtccgcctcgtcaaaagatgccacaagcccgatcgcaaagaattcacgaaggtggcgatccggacggcgattggtttcgtcgtgatgggatttgttgggtttttcgtgaagctcatcttcatcccgatcaacaatatcatcgtcggatccggttagggtcatctgtatggagattagaagagataccacacaggtggtgctggaaagagatttacgaattagtggccatatatctcctttggatgtagactcgtgctttctttttcttctggaatccctcttactttaggctgttatttttgtttttgtttttttggttttccagaatgtaggcttttataatttttttatttgtgagcttcataaatgtcgtttggttatgtgaggcttctttcctgaatcataaatgtatcataattgtaccttttaagtagttatgtgcaagatctgaggttttctc

SEQ ID NO: 677 - DNA, 429 bp, Lolium multiflorum
ctcgtccccgcgcgcctagtctcggagatctcgccggcccgcccacccgccatggacgccgtcgactccgtggtggaccccctccgcgagttcgccaaggacagcgtccgcctcgtcaagcgctgccacaagcccgaccgcaaggagttcaccaaggtggcggcgcggacggcgatcgggttcgtcgtcctgggcttcgtcggattcttcgtcaagctcatcttcatccccatcaacaacatcatcgtcggatccggctagattggagactacaggatgttctgcatgaagatagtgcaatactagcgattgggccttcggtgtcttgacgtaggcaaacaaagtttgtttaaccctatttcgaaagttgttgttcaagacagttaacttctttgttcaaattctgagacattgtcgccaaaaaaaaaa

SEQ ID NO: 678 - DNA, 598 bp, Lotus japonicus
aagacattaactaataaaaccaaaataaaaactcattcgcatttcacaaaccaccatcatcatcaccatttcaattctcagatccaaacgcagaagagagagagagaagagaaagagagagaatggaagccattgattctgtgttcgatcccctcagagaattcgccaaggacagcgtcaggctcgtcaagcgttgccacaaacctgatcgcaaagaattctccaaggttgctgttcgtaccgcaattggtttcgttgtgatgggattcgttgggtttttcgtgaagctcatcttcattccaattaacaacatcatcgttggatctggttaggataagggaaactagaatcgcctcaggaattcaagttgatagttaagcaaaaggaggcaaaagagttcccgcttcacatgatcgttcagtgtacttagtcttagtttctctgtatttcagttttggtttcttttttttctgatcttctgagccagagttttttcgaaaatgtaaaactttatattctgtgtttagtactcgacacattatatggatttaggaaaaggaaaacaaaaatagacgaagaattgtgtatttgcgtaaaa

SEQ ID NO: 679 - DNA, 591 bp, Lotus japonicus
cggtatcagacacatctttggtttctcagatccaaacacgagagaaagaaaatggaggccatcgactctgtcttcgatccgctcagagaattctccaaggacagcatcaggctcgtcaagcgatgccacaaacccgatcgcaaagaattctccaaggtcgctgtacgcaccgcaatcggtttcgttgtgatgggatttgtggggtttttcgtgaagctcattttcattccaattaacaacatcattgttggatctggttaggatgagggaaactacagtcgcctcaggaattcaagttgttgagtaaaaggaggcagaaagagttcccacttcactagatcgttctgtgccctaaatctttttggtttttttccttatttgtacgcttcagaaacattataattttgtttaaaatgtaaaatcaatttccatagacccttgacacattgtttggatttagtaaaagaaggaaaagaattagataagggtttgtacttttgctttgattctttgctaatttgctttctagtttttttatgatcaacccataatacaacagctctgctgtttattggccgttgggctgactct

SEQ ID NO: 680 - DNA, 564 bp, Eragrostis curvula
  misc_feature (4)..(8): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (18)..(19): n is a, c, g, or t
  misc_feature (21)..(23): n is a, c, g, or t
  misc_feature (25)..(26): n is a, c, g, or t
  misc_feature (28)..(28): n is a, c, g, or t
  misc_feature (31)..(32): n is a, c, g, or t
  misc_feature (36)..(36): n is a, c, g, or t
  misc_feature (39)..(42): n is a, c, g, or t
  misc_feature (45)..(45): n is a, c, g, or t
  misc_feature (341)..(341): n is a, c, g, or t
  misc_feature (389)..(389): n is a, c, g, or t
  misc_feature (399)..(399): n is a, c, g, or t
  misc_feature (426)..(426): n is a, c, g, or t
  misc_feature (480)..(480): n is a, c, g, or t
  misc_feature (482)..(482): n is a, c, g, or t
  misc_feature (511)..(511): n is a, c, g, or t
  misc_feature (533)..(533): n is a, c, g, or t
  misc_feature (535)..(535): n is a, c, g, or t
  misc_feature (562)..(563): n is a, c, g, or t
gaannnnnanangannannannnannanagnnccgnttnnnngcncaagcacacgagtcgtcttgtcgaagcgaagaggcctcgagatctctctcaccgtcgcctcccagcgccgccgccgcgaagccatggacgccgtggactcggtggtcgacccgctccgtgagttcgccaaggacagcgtccgcctcgtcaagcgctgccacaagcccgaccgcaaggaattcaccaaggttgcgacgcggacggcgatcgggttcgtcgtcatgggcttcgtcgggttcttcgtcaagctcatcttcatccccatcaacaacatcatcgtcggctccggctgattngatcccttcaggtgagggttgaaacactgtgtgaaggactagatgacngtgtcaagcnaatggaggctgcacaagttttctagcncttagacgtgttgttgagaacagctcccttctatttcgtctcagaactattgtntnggtagacctgggcttcctacctagtactntagtccgtgaatgaattaacanangtcaaagcttaccattttcctgagttnnc

SEQ ID NO: 681 - DNA, 640 bp, Zea mays
gtggctctgtgatgtacactgtataataaaggggccacccatcaggaaaggcaagcaaatttcccaaacgcaaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccggattctgagtagacctttgaatccttgatggatcagccaatctcggaaaggaagtttcgtattttgttgttccgttaagctgtttgctgtttgctctcatggtgatggtaagcctgatttaggtgtcgttcggttgct

SEQ ID NO: 682 - DNA, 620 bp, Zea mays
tgtcaagtgtgacgcggaaccgaaacccgacacatccaggcgtacagccctccgcctcgtgaaggcaaagcacgcgcaaagccaccacagcgtcgtcatcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgttcacctcaggctagtggctgcaggagtggacaatggcgtcactaccttggaggcagcaccgttttcagctctgatttccgcaaagcaattcctttaggacttgtgttgttaaagggcaactcccttatcttttcctctcttgaggtcgtgtggtagatctggaactcttttgtacctggtgtcgaatagtcttttgtggatcagcgggtgacaaaattaaatggttaccgttgtcttggggatt

SEQ ID NO: 683 - DNA, 782 bp, Zea mays
aaaatttcagcactcatccgcctcgtgaaaggcagagcacgcgcaaaagccaccaccgcgtcgtcgtctccaagcaagcgaagagcgcctcccctccccctcgagatcttctctccctccccgcgccgctatggacgctgttgactcggtggtcgacccgctccgcgagttcgccaaggacagcatccgcctcgtcaagcgctgccacaagcccgaccgcaaggagttcaccaaggtcgccgcgcgcactgcgatcggcttcatcgtcatgggattcgtcggcttctttgtcaagctcatcttcatccccatcaacaacatcatcgtcggctccggctgatccatgcccctcaggagtggacaatggcgtctccgccttggaggcgcagctctggcatccggaaagcagtttgtttaggtgaaggacgagtcccgtggtagacctgtaactcttggttgggtctttctcgattgctttctagtgcggcatggacgcatcgttcataattccccttttagggcttgttcggttacatcaatccagaagggtattggaggggtttaatttcccttctagtcatttttgattatgagagaatttaatctcctccgatccccttctgaattggtgtaaccgaacatgcccttattggtgcaccatacgcctgctagagtggacgtgaccacaatcataacacctatacctagcactacagaagaccatgatggcctactgtcgaataaactcgtctgaaagggtagagcaacaccttttcgaccac

SEQ ID NO: 684 - DNA, 683 bp, Zea mays
gcctaggcatggctgcaaaggtttcaatcagagcccagccgcaataatttgttagctaccgaatgaatgatggtctacgcttgttgatgagttggtgctttgtcgtggttttgtggatgtaataattcgatgtacaaataaaaaaaggggagacaaggtgcttgtccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccggattctgagtagacctttgaatccttgatggatcagccaatctcggaaaggaagtttcgtattttgttgttccgttaaaagaaaaaaaaaa

SEQ ID NO: 685 - DNA, 606 bp, Zea mays
tacgcgggggtccacggcaatggcggcgaactgaaccgcagccttggcctccttctcagcaacaaataccgcgcatctcgcctccgaggccgcaacgacagcagcacgagcagcttccacagcatcggcaacaactttgctcggtggaaaatccatccgcacaggagcagagaaattacggctagggtttctggattaaggaagggggcggcatgaacacggaacggcggctaggattcgccaaggatagcatccgcctcgtcaagcgctgccacaagcccgaccgcaaggagttcaccaaggtcgccgcgcgcactgcgatcggcttcgtcgtcatgggattcgtcggcttctttgtcaagctcatcttcatccccatcaacaacatcatcgtcggctccggctgatccatgcccctcaggagtggacaatggcgtctccgccttggaggcgcagctctggcatccggaaagcagtttgtttaggtgaaggacgagtcccgtggtagacctgtaactcttttgtgcctgatgccgaatagtcgtatgtgaagaagaaaaaattaaaaggttgggtctttctcgattgctttctagtgcagcatgg

SEQ ID NO: 686 - DNA, 498 bp, Zea mays
cgagcaaacgcacctccacattctgcctcccacctctccggcgagatctccctcctccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggtgcggcaggactagaggatgttgtccattcatgggggcggcaaaccaattcatttaggacttcattgtagaggacattttcccttgtgttttcatttgaaacagttgtacctggagcagttttgaacctgatactggctagactgtaatatcaagtagccaatgatactggctagaccctatcatttcctccc

SEQ ID NO: 687 - DNA, 555 bp, Zea mays
agacattcatgttattacacccggcaagacgaccaaacttcctacgaaggcagaaccgcattctcgcgtcggcttgcttttaactgaatccagcccaccgcttctcgcacgtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccggctaggctcagggcgcgactagcatgggagtagtgcgatacttttgagagcaagggatagcgaggatcttggtctttggaatagtattgttaatgacattttttttccggttgtgtttctggagtaaatcgttgaacgacaaggcttcaggatgtctggatgtggattctgagtagaccttgaatccttgatgaagcagccagtcttggaaagaaagttccattttgttgttcc

SEQ ID NO: 688 - DNA, 770 bp, Marchantia polymorpha
  misc_feature (684)..(684): n is a, c, g, or t
  misc_feature (726)..(726): n is a, c, g, or t
gcctcgtcttctgctgctgcttgcccatcgctcgctgccttctgctgctcgcgcgcccgactgtgtgatcgcatcctcgcccgtccgaagctccgattgattgagcctggcgttcgtttcctcgagctgtcgagatcggccggtcgcgcctgcaacctcttgttgtgtcgagggttttcgatccatctgcgcgttccaggaggccgatcggcgaggaggagggattttgcgccgaggtaggagggagggcggttgttgatcgggcgtggagagagagcgggagtgttcagaatggaggcggtcgataccgtggtgagacccgtgaaggagttcgcgaaggacagcatccggctcgtgaagcggtgccacaagcccgaccggagagagttcaccaaagtggcagcaagaactgccctcgggttcgtcgttatgggattcatcggctttttcgtgaagttgatcttcatccctatcaacaacatcattgtcggttccggttgaggtgctgattgtcgctggttggtcaagcgaaccagtgagcagattttgttatttaatacggtttggaaatcgctgtcggtctttgttggattgacctgaaactccaaaatcagccagaaactatgttacagaagggtgagtgtacatcaaaaccgaccgcagtttatgtgcaacatttattangtttctggacagaatgagctcgaagtgcaattgtaggattanactctgatagtactgtaacggccgccttttcgcccggaagtgaa

SEQ ID NO: 689 - DNA, 544 bp, Medicago truncatula
acatcaataaacctttcgttttgttgcagacaaacaaatccccaagtcctaacacacagattaagatcgaaagaaaatggacgccattgattctgttttcgatccactcagagaattcgctaaggacagcgtaaggctcgtcaagcgatgccacaaacccgatcgcaaagaattctctaaggttgctgtgcgcactgccatcggtttcgttgtgatgggattcgttggctttttcgttaagctcattttcatcccaattaacaacatcatcgttggatctggttaggataatggaaactacaatcgcctcaggaaatcaagttgtgaagcgtatgggggcagtaggggttcccagtttaatagaacattcagtgcacttaatcttagttatgtattcagttttgtttttccatatttctttttttctaaaacatcacagttcaacaacatgtaaaattttatttttacatgggttaggcttttgacccattgttcaaggagcaaagcgtttagatatggaactataatttggctttgataagca

SEQ ID NO: 690 - DNA, 562 bp, Medicago truncatula
tcatcttcttcaccaacaaaaaccttctcattctactcgattcaatttctcatacttcaaattctcaattcgcgagaaaatggatgccattgattccgtcttcgatccactcagagaattcgccaaagacagcgttaggctcgttaagcgttgccacaaacccgatcgcaaagaattctctaaggttgctgttcgtaccgcgattggtttcgttgtgatgggatttgttgggtttttcgttaagcttatctttattccaatcaacaacatcatcgttggatctggttaggatgggggaaactagactcgggaattcatgttgtgaagcagaaggaggcagaagaacttaatcttagttatgtatttcagattttctttttccatatttcttatcatcggaagatagggttacagttttattgaacatgtaaaattttatttttccatgtgttagacttttgacaaattgttcaatgaggaaaaagtttagacaaggatttgtgcttttgcttttgattatttgttttatagtttcattgaataaaatatcgatttagttaat

SEQ ID NO: 691 - DNA, 662 bp, Medicago truncatula
accttggtatttttccgtatccataggagcgggagcataggcaaaaggaggggcatatggagttgtacctggaaatccccatgtaaggattactaggccggcggggacgaaattgtttcatcccaggtacattggtcgtcttagcagtaaccttcaattgacgtccatgtagttcagattcatccaacaaaaaccttctcattctactcgattcaatttctcatacttcaaattctcaattcgcgagaaaatggatgccattgattccgtcttcgatccactcagagaattcgccaaagcagcgttaggctcgtttaagcgttgccacaaacccgatcgcaaagaattctctaaggttgctgttcgtaccgcgattggtttcgttgtgatgggatttgttgggtttttcgttaagcttatctttattccaatcaacaacatcatcgttggatctggttaggatggggaaactagactcggaattcatgttgtgaagcagaaggaggcagaagaacttaatcttagttatgtatttcagattttctttttccatatttcttatcatcggaagatagggttacagttttattgaacatgtaaaattttatttttccatgtgttagacttttgacaaattgttcaatgaggaaaaagtttagaca

SEQ ID NO: 692 - DNA, 505 bp, Cucumis melo
acaaggaagtcaacccgtccggtttccgtctccaatcattccgacgaatctcttccccgttcccaaattatcaaaattttctttcttcttcgtggggaatggatgccattgattcagttgttgatcctctcagagccttcgctaaggacagcgttcgtcttgtcaaaagatgccacaagcctgatcgcaatgaattcactaaagtggcagtccgtacggccatcggtttcgtcgtgatgggatttgtagggttcttcgtcaagttgatctttattcccattaacaatataatcgtcggatctggatagggttgaaattcctgattggaagcattctggttgaacacattttcactgagtaatgtcaagcagttgtcattgtcacttcggcagtttataattttcccctcctgattttagtgtttgtcaagcaaactgcaaaccgcgtttgagtatataattacagtgtttattttcttttccttattgaataaaaatttctctac

SEQ ID NO: 693 - DNA, 503 bp, Cucumis melo
  misc_feature (159)..(159): n is a, c, g, or t
  misc_feature (207)..(207): n is a, c, g, or t
  misc_feature (356)..(356): n is a, c, g, or t
  misc_feature (410)..(410): n is a, c, g, or t
  misc_feature (503)..(503): n is a, c, g, or t
gccacaattcgttcaaaaaccgcaaaccaaatttcgccaaaaacatttcttttgtcgacgcttccttcccatctcggagccatggatgccgtagattcagtcgttgatcctctcagagagttcgccaaggacagcgttcgcctcgttaagagatgtcanaaaccggatcgcaaggaattcaccaaggttgccgttcgtaccgctatnggcttcgttgtgatgggatttgtagggttctttgtcaagctaatcttcattccgatcaacaatatcattgtcggatctggttagtttaggtcatgatgaagtacgtaggtgatggcggctggcgtttactttagtgcaacctgttttcnttgaggaatactgagcatttaggtctcctttagaacttttaaacccgtgtgcgnaaattgagtaaaccccaggatatatggaattttcctgtcatattgatgaactcactttctatttaaatttcaatgttataacatgttcttttn

SEQ ID NO: 694 - DNA, 717 bp, Cucumis melo
atattttgttcgccattttattaatcacacgagccggagccgcattcgaaacaaacaaaaatggacgccattgattccgtcttcgatccactccgggagttcgctaaggatagcgtacgtctcgtcaagcgctgtcacaaacccgatcgcaaagagttcacaaaggtcgcggttcgtacagcgattggcttcgtcgtcatgggattcgttggttttttcgtcaagctcatctttatccccatcaataacatcatcgtcggatctggctagacagctgaggccacaaaaggagcaggccggacaatatagaagggaacttgatcaactatttcaaattcttaccaatgtttttattaattttaaaagcttaatttattttctagagaagtaccaaactccatgaatagatgtaacgaattgctaggattatgtcttactcctgattaatccagtgtgcttgttcatggtcgatagttattttagagtatagagactgagtttttgctttatgatataaaagtaagcttcctcatcggtatgaaaactgtagtattcccctctccttcatctcgtcaggtgtcggcaaattgaactaattaactttgacacagccaaggaagccaagatattttcagtaaggtgcggtcgtgcacttgaatgcacagaatatttttgtataatagatgtttaatgtagcatttcattactttttttgtc

SEQ ID NO: 695 - DNA, 557 bp, Pennisetum glaucum
tcggggaaatcacgacgcgcaaagccacacaccacctccgcgacttcgtcgtcgtctccagccagactccaagcagaaggcaagaggcccgcgagatctcctccccgcgccgccggcatggacgccgtggactcggtggtcgacccactcagggaattcgccaaggacagcatccgcctcgtcaagcgctgccacaagccagaccgcaaggagttcaccaaggtggcggcgcggacggcgattggcttcgtcgtcatgggcttcgtcggcttcttcgtcaagctcatcttcatccccatcaacaacatcatcgtcgggtcgggctgatccgattccagcagttgaggggctgcagcactggacaatggcgtcaataccttggaagcagcaccagtttgcagcccagacatcgtaaatcagttcctttaggacttccttttgtaaggccaacgcctttctgttttctcaaaagattgtattggtagacgtggaatctgttgtaaccttgatacatccgtgaattaatagatgacataatccaatggtcactgtttcgt

SEQ ID NO: 696 - DNA, 535 bp, Mimulus guttatus
caaatcccaaatccccaaatccctagatctacagaataaaaaagcaaaaaaaatacagatctacagaaaagagaaaatggatgctttggattcagttttcgatccgctgagagatttcgcgaaggacagcgttcgtctcgtcaagcgttgccacaagcctgatcggaaagaattcaccaaggtcgcgactcggactgcgatcgggtttgtcgtgatgggtttcgtcggatttttcgtcaagttgatcttcatccccatcaacaacattatcgtcggtgctacttaatttcattttaggcttttgcttggtacaagaatcttgataatatcgtaatgcaaaagcaaaggaagggcgccagttctgaagattagttaagcctcgtttttttaagaaaataggactccatgtaaaagtagactaatgttttaatacatttttgtcgattatataactccagcatgattttatgactacattgtttagttttatcctcatatttccgtgattgattttttcctgaagcgcagcactgct

SEQ ID NO: 697 - DNA, 542 bp, Nuphar advena
  misc_feature (67)..(67): n is a, c, g, or t
  misc_feature (118)..(118): n is a, c, g, or t
  misc_feature (249)..(249): n is a, c, g, or t
  misc_feature (321)..(321): n is a, c, g, or t
  misc_feature (413)..(413): n is a, c, g, or t
tagtggatccccgggctgcagtaatcggcacgagggggttagggttaggtttgctctttttctttcntgagaatggacgctgtggactccgtcgtcgatcccctgagggaatttgccnaggacagcgttcgcctcgtgaagagatgccacaagcctgatcggaaagaattcacgaaggtcgcgttccggacggcgatcgggttcgtcgtcatgggttttgtcggcttcttcgtcaagctgatcttcatnccaatcaacaacatcatcgtcggatctggttaggtagaaccaacaaagttttttggtgatggatttcatatncgagcaacttttgtagtgtttggaagagaaggatggagaagtcggactacttaaagctctaatactttagtaaattgttcatcaaacttacncatctaaactgtgacatatggcctgaccaagttctctagttttcaagctttgtggttattttttgtgtattgctcactctttttctcataattttgagatgtctgctttgaaaagtttcatctgattat

SEQ ID NO: 698 - DNA, 558 bp, Quercus alba
caaatactcaattctctctctcttttacaaaccctcagttatcaatttcagatctagctctctctctctctctctctctctctcacactcacatagaatcggagaaatggacgccattgactcagtcgtcgatcccctcagagacttcgccaaggacagtgtccgccttgttaagcgctgccacaagcccgatcgcaaagaattcacgaaagtggcgttccgtacagcgatcggattcgtggtgatgggattcgtcggcttcttcgtgaagctgatcttcattccgatcaacaacatcatcgtcggctccgcttaggtcatgtgaagaagcactaatttgctagaggtggaaggcagatgggtcagaatgaaactaattttaaagaggaatgcttagcaagtagcttcttaggtctttatttgatatgtgtgcatttctccagtagacaatgaaatttggtggttttgtacttttgtttttctataatgagacctgtattgactattcttatattttggatagtgaattggttggctccttcttgagtttgagctcaa

SEQ ID NO: 699 - DNA, 400 bp, Quercus alba
aagatggaggccatagactcagtgttcgatccacctcagagaattcgccaaggacagcgtccgcctcgtcaaacgctgccacaaacccgaccgcaaagagttcaccaaggtggcgttccgtacggccatcgggttcgtggttatggggttcgttggcttcttcgtcaagctcatcttcatccccatcaacaacatcatcgttggctcctcttgatgtcagtctagattgcagggctaacatgaaggatggaagttctcagtagagtagtcacagcacacggggagagcaaagatctgtattctgttattttttaatacattatctgagtacattgttttgttttcagattagacttttgagttaaattgagctggtttatattgcaagtttaaaaaaaaa

SEQ ID NO: 700 - DNA, 541 bp, Elaeis guineensis
ctccacgctgagatattcccttgttctcgtcgatttcgagtctagggtttcgccttcctctcgtctctctccctcccctcctgtctgagttggagatggacgctttggattcggctgtcgatcccctgcgggacttcgccaaggacagcatccgcctcgtcaagaggtgccacaagcctgatcgcaaggagttcacaaaggtggcctttcgcacggcgatcggattcgtggtgatggggttcgtgggattcttcgtgaagctgatctttatcccgatcaacaacatcatcgtcggatctggctaggaacaagagattgtggagggagcagtgcaagaaattatatttttcagtttatatcttatgaagacttttttaaaatttgacacatagaaatgcatctttgaaagatgacagggtgttcgtcgtttttgttgttttcttttccattgatggacagtctgtattttatcattagcttgtagtgtaattctctgaagttatctatagggaagcaaatgttaatgatgggttttgttggg

SEQ ID NO: 701 - DNA, 550 bp, Allium cepa
caaatcagatctaaaacttccttgtttctatggacgccgtagattccatcgtcgacccccttcgtgaatttgctaaagacagcgtccgtctcgtcaaacgatgccacaagcctgatcgcaaagaatttacgaaggttgcgttccgtactgcgattggatttgtagttatgggatttgttggcttctttgtgaagctgatcttcattccgattaataatataatcgttggttctggctgagggatcaatcgaagcatgctttggagactggtcccgaaaacacatttctggtaatattatctctgtatgataaagattatcctatgtgctacagaacagttttggtatttttttatttctcagcttgtggtactttatactgatactggattaatcatagtttcagaattatactagtaacttttattttcatatctgtggtgattgattgaatctttgcgggtaaaaaagtttattttttgacttggtattgtatttggtttaattgaataattttttctggaaaaatatctctcttgtttactgcaaaa

SEQ ID NO: 702 - DNA, 559 bp, Carica papaya
aggaagacttgtaaaattgtaaattcactctagggttttatattcctgttggcatactgcggaatggatgctctggacaccgtcgtagatcctctcagagacttcgccaaggacagcgttcgcctcgtcaagcgctgccacaagcctgatcgcaaggagttcacaaaggtagctttccgtacggcgatcgggttcgtagtgatgggattcgtagggttcttcgttaagatggtctttattccgatcaacaacattatcgtcggctcttcttagggtgagtgggaaatttcaagatcattagaggatgtagacagaccggatcgctgcaacttgtagtcaaagagatgtgcagacagagatttctgtaggtcatattttttaggtgcatttgatattttttaagttactcctgtaaacaatcgaatcgaaatattcaagatatttgatcataatcgtagttgatatgatatttgccttctttcttggtgatctatacaatttggatgtaattgttggattttggaacacataatgaattcatgcactgtagtttaggagt

SEQ ID NO: 703 - DNA, 794 bp, Arachis hypogaea
ggaagaaggaagaacgctatacttactttacttcttcaaaagaaagtcaaatccattgaatattctgagatcaagaaccgcaaagagataagagaaaatggacgccattgattcagtcttcgatcccctcagagagttcgccaaggacagcgtcaggctcgtaaaacgttgccacaagccagatcgcaaagaattctcaaaggttgctgttcgtactgccatcgggttcgtcgtgatgggattcgttggcttcttcgttaagctcatctttattccaattaacaacatcatcgttggatctggttaggatgatgggaacgagagtcactttaaggaattcaagttatggggtgaccggaagcataaagcgttctcaacttctcactcttagttctgctatgtttcgtctattttgttttgtttttttttttccttcagtcatctctgggagcattacagtgagatttagaatgtaaaatttttagacctcgacacattgctttgatttaggattaaggacgcaaaaaattgaggaattgcagttttgcttttagactttgttaaccttgaatttggggaaggggtctgggatttggggtccctgcatctacattcatatatcaagaaagttatgttttgtgtcctcagttgattcattttttcatcattagattcagtataagacccagttaacggggaacggcagtaagttgatttggtgttggaggaaagatgaatagaaaacgcatctctatcaacattgcagcggttgatacgcgctgctttgtttatac

SEQ ID NO: 704 - DNA, 747 bp, Arachis hypogaea
acgctcgatctagttcgtgcctgctattatctatttttcagtcttcaatctgagtttcgaaagcacaagagagagaatggacgccattgattcagtgttcgatcccctcagagagttcgccaaggacagcgtaaggctcgtcaagcgttgccataaacccgatcgcaaagaattctccaaggttgctgttcgtactgcaatcggattcgtggttatgggattcgttggcttcttcgtcaagctcatcttcattcccattaacaacatcatcgtcggatctggttagccgttgcacgtctttgacattggaaagagcgtcagtgccgccataactcaggtagataggaaggctgttcagaattctggtcatgtcatacaccagaggagtcggctgtccataacatcttgtatttttatctatgttcatgtaatcaaacgttgctattgttccttgtctgatcactgtgataacaataggattaaaacttagtttcaattcatatgaagcaaattttagttataaacagctctttctagctgaattttcagaatctaaaattccttttcgtcatgagctgtgccggccatggatttcgtaacttaaaagttcaaaaggcagcaaccttagcattgcgccgaggccaaccttctttataatatatacttcccctttatcatgattcaagaactactaaaatattgttgttatgtatggtatttaatcatgaaaacatgactacttactct

SEQ ID NO: 705 - DNA, 596 bp, Arachis hypogaea
gacaactacatacaataaaaatccaatctcagtttccaaagcatggacgccattgattcagtgttcgaacctctcagagggttctccaaggacagcgtaaggcttgtcaagcgttgccataaaccggatcgcaaagaatatttcaaggttgctgttagtactgcaatcggaattacggttatgggattcgttggcttcttcgtcaagctcatcttcactcccgttaacaacatcatcgtcggatctggttaggatgatgatagccacaatcacacacagagagttttaaagcaaatggtagcaggagttcttcccacatcaactttttgttaattatagttctgctgtatatcactttttgtttttccatccttggtgtcttttgggaacattacagttttaatttaaatttaacctttctttaacatgtgttagaattggcaccgtttaatttagccctgatcagggggaaatatttgattgatttacatgtaacattggtgttctgcgtttttgttttcacgttctgaagctaaaagttcaatttgatagacaaaatggtccgctacatatttgataaaatccgtttgtggtac

SEQ ID NO: 706 - DNA, 652 bp, Arachis hypogaea
ggaagaaggaagatgacgctatacttactttacttcttcattagaaagtcaaatccattgaatattctgagatcaagaaccgcaaagagataagagaaaatggacgccattgattcagtcttcgatcccctcagagagttcgccaaggacagcgtcaggctcgtaaaacgttgccacaagccagatcgcaaagaattctcaaaggttgctgttcgtactgccatcgggttcgtcgtgatgggattcgttggcttcttcgttaagctcatctttattccaattaacaacatcatcgttggatctggttaggatgatgggaacaagagtcacttgaaggaattcaagttatggggtgaacgaaagcataaagcgttctcaacttctcacttagttctcctatgtttggtcttttttgtttttttgttttttttttcttcagtcatctctgggagcattacagtgagatttagaatgtaaaatttttagaccttgacacattgctttgatttaggattaaggacgcaaaaatttgaggaattgcagttttgcttttagactttgttttccttcttgaatttggggaaggggtctgggatttgggatccctgcttcgacattcatattcatatatcaagaaagttatgtactttgt

SEQ ID NO: 707 - DNA, 530 bp, Capsicum annuum
gcacgagggcttatcataaataaatttctctctgtgtagaaaactcaatttctcgtcaggccaaaatggatgctctggactcagttttcgatccccttagagatttcgccaaagacagcgttaggcttgttaagcgatgccacaagccggatcgcaaagaattcacgaaagttgctactcgtaccgcgatcggtttcgttgtgatgggatttgtagggttttttgtcaagttgatctttattcctattaacaacatcattgttggtgcttcttaaattggcattgtgaaggagaagctaaatggagatatagaaggaagctaagccagaacagtgctcccagtttagtttaattttgtaacttctagctgtttggatatcttcgacatcttattctgaacctgcctattggtctgagttaattttgtaaactctatattttatttctactgagaaaatcctttatagacatcactgcttgtgaaggcttggtttcgttggagagctaaacaacccgtcatcttcgttgtt

SEQ ID NO: 708 - DNA, 551 bp, Capsicum annuum
gagaaaacccactaatttcgtttctcagatccgaaaaatggacgcccttgatactgttttcgatcctcttagagatttcgccaaagacagcgttaggctcgttaaaaggtgtcacaagcctgatcgcaaagaatttaccaaggttgcgacccgcacggcgatcggttttgttgtgatgggatttgttgggtttttcgtcaagttgatattcattccaatcaacaacatcatcgttggtgcttcttaactggcattgtgaaggagaaatacaagtagagatgtagagcaaggaagaaaagtggtgcaaaatcatagtttcattttgtgatccgtagcagttggttatgtagtattatttctgaaccgcctagtttctgggactttgtcatctgagttgcctctcagattttgtagactttactgttgatgtcaagacatccatttttttcattatactttttgtcttatgctttaagccttgatgaaaattggaatacagttttgaatgtcgcttaattgtgatggaaacacggagcgcgaggcaattcctt

SEQ ID NO: 709 - DNA, 474 bp, Petunia hybrida
ggattggattcagttttcgatccacttagagatttcgctaaagacagcgttcgacttgtcaaacgttgtcacaaacctgatcgtaaagaatttactaaggttgctactcgtacggcgatcggtttcgtggtcatgggatttgttggattttttgtcaagttgatttttattcctatcaacaacatcatcgttggtgcttcttaattggcctcgtggaggagaagaagctatggagtttggagatacaaacctgaaggatatgtgaaatctttcaaattttagtttcattatgtaatgcgtagcagttagacattctgaacctcttaactagagtttgttccatcgaaatctcgagttccttgtcacttttgtcccttaaagtcggagcgcctgagctatttttcttttaaatcttactttttgttggaaattttgtaagctatttgcacataaaccagcaagttttaatctttc

SEQ ID NO: 710 - DNA, 521 bp, Petunia hybrida
ctagattctgtgtttgatccccttagagattttgcaaaagacagcgttaggcttgttaaaaggtgccacaagcccgatcgcaaagaatttactaaagttgcaactcgtactgcaattggttttgtggtgatgggatttgttggattttttgtcaagttgatattcattcctattaacaacatcatcgttggtgcttcttaatccggccatgcgagtgagaaactaaatggagatatggatggaagcgacagattatagtcctgccattactttaattttgtccagtagcagttggaggtcttttcttcttattctgaaccttgttattgatctagttaatagcattcagttacctttctacctcccagaacctcatattggatttttgtacacttccgttcaagtcaaagcactctcttctttgttttactttcttggtgtgtttggttaggaggcaaatgttctccatgaaaaaaagtattcatgcaaacattttagtttggggaatgattatctgggtt

SEQ ID NO: 711 - DNA, 696 bp, Physcomitrella patens
gcacagcacaacatgcgtgcgggtccctgcgagggagggaccaccgcatcactccggatcaagagtggaggattgaatcatggaagccgtcgatactgtagtgaggcccgtgaaggacttcgccaaggatagcattcgcttggtcaagcggtgccacaagcccgatcggcgagaattctctaaagtggccatcagaaccgctttagggtttatcgttatgggcttcattggattttttgtcaagctcattttcatccctatcaacaacatcattgttggatctggatagtgcagtgcttggtgagttttctggtttgaaaaaggttgaagattagctcagtcgaaggagtttcgggtatgttgtttatttgcgtttttcttaaccgcaaagaacactccgagggctacgtaaacatggccatctgcacggcataaatgtgcacctcaaggcctcaagttcgtatggttatgcagctctatatgtttgcttcatagtttcattaatattggagttgaatttgctgtttcagattttgctgggtctaatattcattaatagcagacaccgaagaattaggtcactgttatgacctggttttagattgttcgagtgaaagttggctctttcttgtgcttgaccacattttctggctctctttcgctggaacctaaattacgaccactgtttggctgcaa

SEQ ID NO: 712 - DNA, 1072 bp, Physcomitrella patens
aggacgctgtgtgaggttttcgtgagaattttcattgcagcattttgcatttttctacctcactccgagtttgccagtatcgctgcattcggttgtacgcaggggttcgctggtgtgtagcttttgtttgggtggtagtggaggaatcagcaaagagccatggaggccgtcgacactgtggtgaggcctgtgaaggacttcgccaaggacagtatccggttggtgaagaggtgtcacaagcccgatcgtcgagagttctctaaagttgcgatcaggacagctctaggctttatcgtcatgggcttcatcgggtttttcgtcaagctcatatttattcctattaacaacatcattgtcggttctggatagtagagattttggtgcgttctgtgcctcgtagaaactcattctacacttgtatctcagacgcagacatcatatgctataaattatgtattagtgtgccgagtcacatctgtgattaacactgagtttcagtctttaggtccaggatatagtgtgtacttttctcacactaagcaaaagaattgattaattgcacagtttggaaggattgggtaattggtgttcgacttttcgggcgtaagaggacaagccagtctccttcgttctataaaatagcagatttgcgaacagttccaccaatgtttttgaccttcactcagtttttagagaattttcgtgtccgtgctatccacctttcagattgtcctgagctaatcctgtatctgtagtgttagtaagcacatgaggcgttatctcatgatgatgatgatgatgatgatgatgactacggttgcgttttttggtgctctgcatcaataatttgatcagttaggagtttattttatcgttgttgtgggcgtccaaattgtaggtaactagaggatgtgtgtattgacgaacaggagacatggtgctcgatgtctcagtagctatttatgggttgctgatttagtttcccacgtagtagctggaagtatatgtgcgatctgcacgaacatgtatttattcattaaactcgccattgtattcactgatttgtggagtt

SEQ ID NO: 713 - DNA, 597 bp, Pinus taeda
  misc_feature (226)..(226): n is a, c, g, or t
caagaggtttacattttcgccattgttggagcttcgagggaatttctgcactcgagcgatctcgcaccccgaaaagacataaacgtcgtgtaggatttgaatccactgaatcatggatgcagtagacactgttgtgaggccgttgaaggactttgccaaagatagtgtcaggcttgtgaaaagatgtcataagccagaccggaaagaattcagcaaagtagcattnagaacggcaattggttttgtcgtcatgggctttgttggcttctttgttaagttgattttcattccaatcaacaacatcatcgttggatctggataggaatttacgctggtcatggttgttaagacttgcatatttttgtacgttagacactttcaaatggtgttgaagttgtacctgaaattccaggcttcttttgtttcgttagtgaattatatggattgcgaacactaaattttaacggctacaatagcaaatgctttttggtagagctttcaatgcggataagggacttgttgtggatgtagaaatcttcatttttttttaagaactgaaattgggaaatttatattatataaagctgtagttatgct

SEQ ID NO: 714 - DNA, 831 bp, Pinus taeda
cggccgggggcaagaggttttcatcttcgccattgttggagcttcgacggaatttcagcactctgaagagcaatctcgcaccccgaaaagacataaacatcgtgtaggatttgaatccactgaatcatggatgcagtagacactgttgtgaggccgttgaaggactttgccaaagatagtgtcaggcttgtgaaaagatgtcataagccagaccggaaagaattcagcaaagtagcattcagaacggcaattggttttgtcgtcatgggctttgttggcttctttgttaagttgattttcattccaatcaacaacatcatcgttggatctggataggaatttacgctggtcatggttgttaagacttgcatatttttgtatgttagacacttttatatggtgttgaagttgtacctgaaattccaggtttcttttgtttcgttggtgaattacatggattgtgaatactaaattttaactgctacaatagcaaatgctttttggtagagcgttcaatgcggataagtgattgttgaggatgtagaaatcttcatttttttaaaaaaactgaaactgggaaatttatattatataaagctgtagttatgctaaacagtggaattactgctgtccagagctttaggaaaaataaacagctccttacatgcaaaaagcagagcttacatagatcattaggaaaaataatccagtagttacagaaaaaatattccaatatttattagagctatatattttgaagtaaacacctaatactatagtgatttcaaaaaacattaaacttaatggaaaacctagtggtgatagtccttc

SEQ ID NO: 715 - DNA, 1537 bp, Pinus taeda
  misc_feature (1204)..(1204): n is a, c, g, or t
taatccataagtcatagaggccagaggtcttatgcgaggaagtaaacacggtttttgcttaacgcgctagggttcattgcatctctgaaccaccgcaacggatatacggcgggcagtcgagccagtgagctatatcgcaaggagagtatagaggcgcgataaaaatggaagccgtggacgctgttgtaaggccgctgcaggactttgccaaagatagcgtgcgcctcgtcaaaagatgtcacaagcctgatcgcaaagagtttagtaaagtggctttcagaacggctattggatttgttgttatgggatttgttggtttctttgtcaagttgatattcataccaatcaacaacatcattgtgggatcaggataggtagggtcttgtgctggtcaacctaacctgtaaaggcccccttcaatccttctgagggtgggttaatcttggaaggtcaaattggtgaactactgatcaaccattagaagggttagtaagggttgatcttgtgtcaacccagttatcctgtaaagtcctgatcattgtggtaagttctaattatccccagaagtaaaaaacaacaattcacatactgagctagaattatgcctgacttgtaatagtggctaagtattaatgaatgaatatgctaaaatgagttggctgtatttgcatttgtcttttcttgatacagatgcattcttatttgttacattatgtatcattagcatttgctttgttttgtttgactgcaagtgaatacctctgataatagcagtaatcacgagactatctattcattgcatgccaaggtaaaattctgcctggtgtgtagtgggaaggggttgatgagccagaatgctaacctgaggtgttaaatttgcaaggatgtctctttatgccttgaggtcgctttcctgtataatttaacgtgtacggtatgtcattgacatgcatttaaattacaattcctcatcactgcaaacaatggttatatggatatttccctttcgaaaggattgcatactttgggtcaaataaactctatgcatttctgtgtgataatcgatgggacatgtaggatatgcgtagggaagtcattaagatatgaagggcttgccatcaacgtggtcacatgtgagtttattccctttcacacttgtttaggaatctatatttctaataaattactgtccattaggactccntttcactgcaagtgcttgcctgtgatgataatgtaagcttgtatctacaggattgtgcaccaaggtggaattctacctggcttgtagttggtgtggattaatgagccataatgctaatctgaggtgttgcgttagcatttcaaggatttttcatgtgtatggtttgtcaggtatggtaactattgcaaatagaatgttctgaagtagttgtagttgagaaatgaaggcctcctactaacgtggtcacatatgaggttatctgcttagagttttttaatgggccttaagtcttgttcagaagtctatattttaataaatcactttttttctttc

SEQ ID NO: 716 - DNA, 576 bp, Populus trichocarpa
aaatcccagtagctcacagatccaccatcttcacaaccaccaaaaatagagagagaaagagagagaaaaaaaatcgaaaagaaatggacgccatcgattcagtattcgatccattgagagagttctctaaggacagcgttcgcctcgtcaagcgctgccacaagcccgatcgcaaagagttcacgaaggtggctttccgtacagcgataggattcgtagtgatgggattcgtaggtttctttgtgaaactcatatttattcccatcaacaacatcattgttggatccgtttaggatagcatggatggatccaggcttgatcgcaaaatccagagatagatggcaatgtggtgaaatggaatgttagcactgttgatgttgctttttgctgtatgttggtcttaaaactgtaggattgaggatattgtatgaaacttttgttcctttttatctagtagcttttttggatttacaatttttcttttttcgcgtggttattgtgttccaacaagtgttcatgttctttaattatatagcccaaaatgaaattcagggagtattgcaactttatttggcc

SEQ ID NO: 717 - DNA, 478 bp, Populus trichocarpa
aaccgtcagctgctcttgtaataaacgctctctgtaaaaaagaagaagaaaaaatcccaattcaatctacctagggtttctcgatctcccattcaatcctcaacaaaaatggacgccatagattccgtcgtcgatcctctcagagaattcgctaaagacagcgtccgactcgtcaaacgctgccacaaacccgatcaaaaagaattcacaaaggtggcgtctcgtactgcaattggattcgtggttatgggatttgttggattcttcgtgaagttgatttttatcccaattaataatatcattgttggggcttcttaggctgtatggatcatcaacaattagaatatgaaggcagtctggttgaaaatttgtttttaatgagaagcttagcttttaacttgcttaatttcctttttgatatgtttgcaatactccatagaccaggtaatcacaatataaaaaacctttatcatttttg

SEQ ID NO: 718 - DNA, 634 bp, Populus trichocarpa
gtcacaagagactctctctctctctctctctctcatattttttgctctttcaaaaaggaagaagaaaaaatctcaaataaatctgtctagggtttctcgatctcctatttctcttcaacaacaatggacgccatagattccgtcgtcgatcctctcagagaattcgctaaagatagcgtccgactcgtcaaacgctgccacaaacccgatcaaaaagaattcacgaaggtggcgactcgtactgcaatcggattcgtggttatgggatttgttgggtttttcgtgaagttgatttttatcccaattaataacatcatcgttggtgcttcttaggtggtatggatcatcaagaggcaatctgataaaaaacttatctttaatgaggaagcttagcttttagcttgcttaattttctttttgatttgtttgcaatgctccacaaacaaggaaattaccaatatcaaaactttttatgattcttttaggctctgcatctgtttgtttgtgatattccacaaacaaggaaattatcgatatcaaaactctttatgattcttttaagctctgcgtctgtttgaccctttgtgtgatcttatgcctttccttatcgatgttgtagtggatgagttagttg

SEQ ID NO: 719 - DNA, 489 bp, Papaver somniferum
cagtagttgatccattgagagaattcgctaaggacagtgttcgtctcgtcaagagatgtcacaaacctgatcagaaagaattcacaaaggtggcattccgtactgcgattggttttgttgtgatggggtttgttgggttcttcgtcaaattgattttcatccctatcaataacatcattgttggatctggttaagacattaggaaatagaagttatatggctttaaagagcagaagttaggaacctgcaaggatgctaaactacacggtctcaggcttcttctttgtgtatcttctttttggacaaagctcctcatctgttaaacatatttaagagcaacagttaaattcattttactttctttttctcttttaggaataacattgaaattagttccttttcttttttctgtttacccttaaatatagagtgtagaaggggtaactctctcaccagtttctggttcaactgtatctatatttgaaggtt

SEQ ID NO: 720 - DNA, 675 bp, Papaver somniferum
  misc_feature (116)..(116): n is a, c, g, or t
  misc_feature (119)..(119): n is a, c, g, or t
  misc_feature (121)..(121): n is a, c, g, or t
  misc_feature (125)..(126): n is a, c, g, or t
  misc_feature (128)..(131): n is a, c, g, or t
  misc_feature (134)..(134): n is a, c, g, or t
  misc_feature (136)..(140): n is a, c, g, or t
  misc_feature (143)..(143): n is a, c, g, or t
  misc_feature (146)..(152): n is a, c, g, or t
  misc_feature (158)..(158): n is a, c, g, or t
cctgcttgttgatttcaacgccgatggcacgtttggtaacattccagacaataccagtccgaccatgataaaacttatgaggcatacccttatgaatagcaccattcactttaatntcnanatannannnntcntnnnnnttntcnnnnnnntcttcncttctgtatccgtttttattccagatctagggtttccatcctccgaatccattaatcaattcccatattcattgcgaaagatggaagccattgattcagctgttgatcctttgagagagttcgctaaagacagtgttcgtctcgtcaagagatgtcacaaaccagatcgcaaagaatttaccaaggtggcgttccgtactgctattggattcgttgtgatgggattcgttgggtttttcgtcaagctcatctttattcctattaacaatatcatcgtaggatctgtttaggagtttcattgaggttgcaaaagtggtaggaagcagtttattagattcctgttagcatgtaaggaatgaaaaaggacacctgcctgttttggctcatcttaatgtacacgctttaactgcaaaattgatctaacagcaggattaaatgtttttactttttaagttttgaaaatcaatgttacttttcagttcagttatctcaggattaaatgtctttcgtttgctgt

SEQ ID NO: 721 - DNA, 584 bp, Solanum tuberosum
gtctgaacaaaaatggatgctctcgactctgttttcgatccccttagagatttcgccaaagacagcgttaggcttgtaaagaggtgccacaagccagatcgcaaagaattcaccaaagttgctactcgtactgcaatcggcttcgttgtgatgggatttgtaggatttttcgtcaaattgatcttcattcctatcaacaacatcatcgttggtgcttcttaatcggccgtgtgaaggagaaactaaatggagatatagaaggaagtaatgacgacagtcctcacaatttagtttaaatttgtaacctctggctgttggatatttctgacatgttattcagtaccctcttattggtctgagttaatactgtagcattcaaattgtctttatcaccttctccctgcaccctcatattggaattttgtacacttgtttccagatcaaagtatttatctcttagttttacttttctggtgcccttgatacagaggtaaatgtttctatgattatttttcttcatgaaagatgctttatcattaaaagtacaattaagaaagaagaatgagagtattgatttggcagct

SEQ ID NO: 722 - DNA, 554 bp, Solanum tuberosum
aaagagctcatttcaatttcaccccaattcagatcgagatccagaagaaaaaaccctaattttgttttcagatccaaaatggacgctctcgatactgttttcgatcctcttagagatttcgccaaagacagcgttaggctcgtcaaaaggtgccacaagcctgatcgcaaagaatttaccaaggttgcaacccgtacggcgatcggttttgttgtgatgggatttgttggatttttcgtcaagttgatattcattccaatcaacaacatcatcgttggtgcttcttaagtggtttcgtgaaggagaagtacaactggagatgtagagcaagagataaaaagtggtgcaaaatcttagtttcatattgtaatccgtaacagttggtataccatgtagtcttatttctgaaccgcctagttgatggggattgtcatctgagttgcccccctcagctcgcattcccctcacccaatccgttttcagattttgtaaactttgctgttgatgtcaagacatcctttttttttaattctacttttttcaccttggtgggt

SEQ ID NO: 723 - DNA, 651 bp, Solanum tuberosum
aagcagtggtatcaacgcagagtggccattacggccggggaccgatccaaagagctcatttcaatttcaccccaattcagatcgagatccagaggaaaaaaccctaattttgttttcagatccaaaatggacgctctcgatactgttttcgatcctcttagagatttcgccaaagacagcgttaggctcgtcaaaaggtgccacaagcctgatcgcaaagaatttaccaaggttgcaacccgtacggcgatcggttttgttgtgatgggatttgttggatttttcgtcaagttgatattcattccaatcaacaacatcatcgttggtgcttcttaagtggcatcatgaaggagaagtacacaactggagatgtagagcaagagataaaaagtggtgcaaattcttagtttcatattgtaatccgtagcagttggtataccatgtagtcttatttctgaaccgcctagttaatgtggactttgtcatctgagttgtccccctcagctcgcattcccccctcacccaatccgttttcagattttgtaaactttgctgttgatgtcaagacatcctttttttaattatactttttttcaccttggtgggttcagttttgaacgttccttgataggagattctgtgatggtggaa

SEQ ID NO: 724 - DNA, 461 bp, Solanum tuberosum
gtctgaacaaaaatggatgctctcgactctgttttcgatccccttagagatttcgccaaagacagcgttaggcttgtaaagaggtgccacaagccagatcgcaaagaattcaccaaagttgctactcgtactgcaatcggcttcgttgtgatgggatttgtaggatttttcgtcaaattgatcttcattcctatcaacaacatcatcgttggtgcttcttaatcggccgtgtgaaggagaaactaaatggagatatagaaggaagtaatgacgacagtcctcacaatttagtttaaatttgtaacctctggctgttggatatttctgacatgttattcagtacctcttattggtctgagttaatactgtagcattcaaattgcctttatcacctccctgcaccctcatattgaaattttgtacacttgtttccagatcaaagtatttatctcttagtttta

SEQ ID NO: 725 - DNA, 1544 bp, Prunus persica
  misc_feature (575)..(575): n is a, c, g, or t
  misc_feature (600)..(600): n is a, c, g, or t
  misc_feature (667)..(667): n is a, c, g, or t
  misc_feature (713)..(713): n is a, c, g, or t
  misc_feature (718)..(718): n is a, c, g, or t
  misc_feature (763)..(764): n is a, c, g, or t
  misc_feature (778)..(778): n is a, c, g, or t
  misc_feature (831)..(831): n is a, c, g, or t
  misc_feature (911)..(911): n is a, c, g, or t
  misc_feature (993)..(993): n is a, c, g, or t
  misc_feature (1049)..(1049): n is a, c, g, or t
  misc_feature (1204)..(1205): n is a, c, g, or t
  misc_feature (1220)..(1220): n is a, c, g, or t
  misc_feature (1281)..(1281): n is a, c, g, or t
  misc_feature (1291)..(1291): n is a, c, g, or t
  misc_feature (1297)..(1298): n is a, c, g, or t
  misc_feature (1323)..(1323): n is a, c, g, or t
  misc_feature (1326)..(1326): n is a, c, g, or t
ttttgaccactgtcctaaacgcgtctcaactttatcttcgactacgtctccgtctcctgcatacatctctctctctctctctctctctctctctctctctcacccaatttgctcagagaaaatggacgccatagattcagtagtggatccgctcagagagttctctaaggacagcattcggctcgtcaagcggtgccacaagccagatcgcaaagagttcacgaaggtcgcgctccgtacagcgatcgggttcgtagtgatgggattcgttgggttcttcgtgaagctgatcttcatccccatcaacaacatcattgttggatctgtttaggtcatgtgctgaagttagaaagatgataggtgcagcaacttgaattcactaagaaagcagtagcttttagttctcatttggttccttttgagatacgtttgctttatttttgtaaaaccatgatacttgcactttctagttttccataattgagacctcatcttttttctttcaatttaaattttgatgccatggatttggtttaccaacttttcgtggtgctctttaaccaataaagagcagncaggatgataatgataatgaaatgntgaatttgatgggctgtgttgattaagcttatgcatgttaatcaaattagcaggcaccttgtatctnccatcgtcaaaatccaaccggttctctgggccggtagaactggggntgttncaagttctgctttagtttgcatgatcttcatggttggatttgctnncaatgtccaggatncgatagaactagggctgttctgagttttgcttgagtttgcatgatctttatgnttgtatttgctagtaatgtctagtggccgggacaactgaaactgtgccgagatttggacaagacattaaccagtctagangtttgaatgcaagaaacccataaggcatcccgcagatcagtaatgtgcagtgagtaaaacacccaagtattaaactgagccntattttatttcaggaagttaggttaacggatattgccaaaggcctgaagaaagganctaagacatgcttcataaattctgccctttatctcatattggggatttggattctagaatttcaactgggtgaggactggacatgttatgaaagctttgaaagagtcaaactcactctagtttttaagaaataaatttagatcatttcagaaaanncatcaaaagatgcgncacatttagcagaaatttccgtggtgatatatcgtcgataacatgttatgtacattttgtnattgacatgntatggnnctggattgataacatgttaaggacnctngtttggggaaattggataaaattacatgaattttggggggagggggtgattgcccctgaacattctaatttaaattttaccccccccaactttttggagggggggaaccccccccccctgtctaaccccccttaaaattttctctaaaaggaaaaaaattttttccccctccttttttttttaaaaaatttttttaaaaccaattttttaaaaaaaaa

SEQ ID NO: 726 - DNA, 503 bp, Prunus persica
  misc_feature (270)..(270): n is a, c, g, or t
  misc_feature (489)..(489): n is a, c, g, or t
tgtttctgaatttggtcttcagagaaaatggaagccatagactcagtcgtcgatcctctcagagtgttcgcgaaggaaagcactcgactggtgaagaggtgccacaagcctgatcgcaaagagttcacgaaggtggcgatccgtacagccatcgggttcgtagcaatgggattcgttgggtttttcgtgaagctggtcttcatccccatcaacaacatcatcgtcggctctgtttagatggagaaatggagttgtggcactggaccactncgtctatagagtggtactgtaccattgcgtcagccggtcatgcttaaggttctgagttgactagatcatggaggcagacagcaacttgtgctcaaagagaaagcaatagtattttagtttacttctcatttggttgggctcttctttgccttagttctgtaaaattatgatgcttctttttgcctgaacatatgtaaaactgtgatacatcaacttgtntagttttccataaa

SEQ ID NO: 727 - DNA, 535 bp, Raphanus sativus
  misc_feature (439)..(439): n is a, c, g, or t
ggggttcaaagctctgacgttctcttctttcatcgattcctccgatttctttaaagaagattcagatcaccaaaatcaaagcatcatcgccatggacgccattgattccgtcgttgatcctctcagagacttcgccaaggatagcatccgtctcgttaagcgttgccacaaaccagatcgcaaagagttcacgaaagttgcagttcgcacggcgatagggtttgtagtgatgggattcgttggcttctttgtgaaactcatctttattcccatcaacaacatcatcgtcggcgccacttaggaatcaaggaacagagttttgagagagaaaaattagagttttgctgttacaagaagtcacatgtcagttcaatgttttatgcaatcggattccatttgtttctatgtttttctttctttcttgatttgttcacaactnaaaaatcggaattgtcttgaatgtagagcaaactaaattcaggaagttatgacctaggatcatatatacacttagtatgtctctcttttacacccc

SEQ ID NO: 728 - DNA, 858 bp, Raphanus sativus
ggagaaactctgtgacgtttcgttcatcgcttcctccgaagaaagagtcccgaagaaagcacaagaaaataaataaaaaagagctgtgagattgagatttgagatcatcgaaagcaaagcaaaaccatggatgctattgattccgtcgtcgatcctctcagagacttcgctaaggatagcattcgtctcgtcaagcgttgtcacaaaccagatcgcaaagaattcacgaaagttgctgttcgtacagcgattgggttcgttgtgatgggattcgtgggcttctttgtgaagctcatctttattccaatcaacaacattatcgtcggtgccacttagggagcaaaggacagaatgggagaaaggcaaaaaactagttttgagatcgttttcaacaattcgcacttatgtttatgtaatcgaatttcatttgtttctatctttttttttttctttaattttgttcacgactgaaaagattgggctcatcttgaatgcagatcaaactaattagaaacttgtggccgaggatttcatttgaaacgccactgtaatagtgtccaatatacaatcaaacaggttccatggatacaaaaagaaaagttactgccagctccagtccttactttggttcgaccaaaaataaatgatccgttgaggagaagctactctatttctatttgagtctttacaatattactaacagttatccttggaaccactgttatcagcgtttagccagaccatcatttttcattagtttttcctttcatttgcgatttagatcacatatacaacatcatgaatcttgtgtgcgtttgaccatctctatagaagcagttttatattacttaacaaaaa

SEQ ID NO: 729 - DNA, 443 bp, Raphanus sativus
gaggaaaagaaaacacaaattagaaaagaaaaaaaaagagagtcaaagaaatcgccatggatgccatcgattcagtcgtagatcctctaagagactttgccaaggacagcattcgtctcgttaagcgttgtcacaaaccagatcgcaaagaattcacgaaagtggcggtccgtacagctattggttttgtagtgatgggatttgtcggtttctttgtgaagctcatctttattcccatcaacaacatcatcgtcggtgctacttaaaagataaccacggacgatgaagaagggtagtagttacagcttttgttgtttcaagacacttttttttaatgctcgagagagtaaaacttttgttacaaattgcagaattcgtctatttaatatatgtcactgtttttattttcgctttgcggttgaaaattgcatggtttttgtgta

SEQ ID NO: 730 - DNA, 432 bp, Raphanus sativus
  misc_feature (172)..(172): n is a, c, g, or t
  misc_feature (262)..(262): n is a, c, g, or t
ggataactctcaacttgtttctcttcgtaccaatcgagaaaaagaaaaacacaaattaaaagaaaaaagaaaagaaatagccatggatgccatcgattcagtcgtagatcctctaagagactttgccaaggacagcattcgtctcgttaagcgttgtcacaaaccagatcgnaaagaattcacgaaagtggcggtccgtacagctattggttttgtagtgatgggatttgtcggtttctttgtgaagctcatctttattccnatcaacaacatcatcgtcggtgctacttaaaagatagccagggacgatgaagaagggtagtagttacagcttttgttgtttcaagacactttttttttatgctcgagagagtaaaacttttgttacaaattgcagaattctatttaatatatgtcactgtttttattttc

SEQ ID NO: 731 - DNA, 550 bp, Raphanus sativus
gtgacgtttcgttcatcgcttcctccgaagaaagagtcccgaagaaagcacaaaaaaaataaataaaaaagagctgtgagatttgagatttgagatcatctaaagcaaagcaaagccatggatgctattgattccgtcgtcgatcctctcagagacttcgctaaggatagcattcgtctcgtcaagcgttgtcacaaaccagatcgcaaagaattcacgaaagttgctgttcgtacagcgattgggttcgttgtgatgggattcgtgggcttctttgtgaagctcatctttattccaatcaacaacataatcgtcggtgccacttagggagcaaaggacagaatgagagaaaggcaaaaactagttttgagatatgacaactagagcatttgctgttttcaacaattcgcacgttatgtttatgtgtaatcggatttcatttgtttctatcgttttttttttctttaatttttgttcacgactgaaaaaattggactcatcttgaatgcagatcaaactaatttagaaccttgtggccgaggatttcatt

SEQ ID NO: 732 - DNA, 451 bp, Raphanus sativus
ggccaaaccaaaaaaggaagacaaataaataaataaaaagtcatcaaagaaagaaagaaagaaagaaagaaagaaagaaagagccatggacgccatcgattccgtcgttgatcctctcagagactttgcaaaggacagcattcgtctcgttaagcgttgtcacaaaccagatcgcaaagaattcacgaaagtggcggtccgtacagcgatcgggtttgtagtaatgggattcgtgggattcttcgtgaagctcatttttattcccatcaacaacatcatcgtcggtgccacctagataaccagcgaagaagaagaataagaagggtagaaacagctttcttgtttcaagaaaacaatttcacagtttttttttgttcagatactcagaaagaggaaacatatgttaaccaacacatttgagatcagtttccagtaattgcattctatttta

SEQ ID NO: 733 - DNA, 785 bp, Raphanus sativus
  misc_feature (511)..(511): n is a, c, g, or t
  misc_feature (663)..(663): n is a, c, g, or t
  misc_feature (673)..(673): n is a, c, g, or t
  misc_feature (679)..(679): n is a, c, g, or t
  misc_feature (691)..(691): n is a, c, g, or t
  misc_feature (693)..(693): n is a, c, g, or t
  misc_feature (696)..(696): n is a, c, g, or t
  misc_feature (722)..(722): n is a, c, g, or t
gggagatctaaaagacacaaatactaatatcatagatccgacagatctgaatcctggacatcctaaatcgtgtcctacctctagttactactagccaagacaaaatacaaagacaataataagaaaccaaaccggagtctctgtgttcagaccgaaatcaaagtctgaattggaagacgaagcaaagtcaacgaagccaagaactagtactataaagtcccaatgtcaaataaaaacctcatttacatctaaaacgaaatctcctgaaaccctaatttttccaattcgatctgagaagctatggacgctattgattccgccatcgatccactcagagatttcgctaaaagcagcatccgtctcgtccagcgctgtcacaaacccgatcgcaaggaattcacgaaggtggctgtgcgtacggcgataggatttgtggtgatgggattcgtagggttcttcgtgaagctcgttttcatcccaatcaacaacatcatcgttggatcttcttagnctaaatatttttacgaggctatgcgccaaggagtaggaaggaaagagactccaaaacctgttgtgaaacctctctgtattctctgtttttctaggttacatttttatccccttgaaacttgaaagtctaattttcctttatttggattttgntcgtttcttntactcnttatagcctaananacntaagattttatttctttttgtataanacaaaaagtattgtcctcgagaaactacgctttaaacacgaaactctacattttttagtgacc

SEQ ID NO: 734 - DNA, 488 bp, Raphanus sativus
  misc_feature (58)..(58): n is a, c, g, or t
  misc_feature (135)..(135): n is a, c, g, or t
  misc_feature (154)..(154): n is a, c, g, or t
aaaggaagacaaatataaaaaaaagtcgtcaaagaaagagccatggacgccatcgatnccgtcgttgatcctctcagagactttgcaaaggacagcattcgcctcgttaagcgttgtcacaaaccagatcgcaangaattcacgaaagtggcgntccgtacagcgatcgggtttgtagtaatgggattcgtgggattctttgtgaagctcatttttattcccatcaacaacatcatcgtcggtgccacctagataaccagcgaagaagaagaagaagaagaagaagggtagaaacagctttcttgtttcaagaaaacaatttcacagttttttgttttgttcagatactcagaaagaggaaacatatgttaaccacacatttgagatcagtttccagtaattgcattctattttatacgttactgtttatttcgctatacccctagaatttgccgttagatatggtgacaaaacccacaaagataatg

SEQ ID NO: 735 - DNA, 534 bp, Raphanus sativus
  misc_feature (97)..(97): n is a, c, g, or t
  misc_feature (343)..(343): n is a, c, g, or t
  misc_feature (376)..(376): n is a, c, g, or t
aaaccaaaaaaggaagaccaataaataaaaaaaaaaaaaagtcatcaaagaaagaaagaaagagccatggacgccatcgattccgtcgtcgatcctntcagagactttgcaaaggacagcattcgtctcgttaagcgttgtcacaaaccagatcgcaaagaattcacgaaagtggcggtccgtacagcgatcgggtttgtagtaatgggattcgtgggattctttgtgaagctcatttttatccccatcaacaacatcatcgtcggtgccacttagataaccagcgaagaaaaagaagaagggtagaaacagctttcttgtttcaagaaaacaatttcacaantttttttttttggttcagatactcagaaagagnaaacatatgttaaccacacatttgagatcagtttccagtaattgcattttattttatatgttactttttatttcgctataccgttagaatttgccgttagttatggtgacaagacccacaaagataatgatgaatcaatcaagttctattttatttta

SEQ ID NO: 736 - DNA, 682 bp, Oryza sativa
aaatttcaatggttttcaagaattcaaataagaattcaaatctgatgaaatttgaccgaaatctagtgaaaaccagtcacggagaagagcacacaggaacaatgtttcgagcggttataaagggagccatccgctgaacaaactcgccaaaagcgaagcagtccccaccccgaccgcgtccacctcctctcttctcccacgcgcgcctcgcctcgtctcctctcgagatctcgccatggacgccatcgactccgtggtggatcccctccgcgagttcgccaaggacagcgtccgcctcgtcaagcgctgccacaagcccgaccgcaaggagttctccaaggtggcgttgcggacggcgatcgggttcgtcgtcatgggattcgtcggcttcttcgtcaagctaatcttcatccccatcaacaacatcatcgtcgggtccggctaggttggatgctaaagaaagactagcatggggatatagtggagtactcatcaaggagaaaacagaagattattgaggatagtgctgtgttctaaagtaggcgtccaaagttcattgacccgtttcaagaaactgttgctaaaagatggtttatattctgttccctttttgtggagaaatcatcgtactgaattagactttgcaattagcatgcaatgaaatgttcatgtttttgccgta

SEQ ID NO: 737 - DNA, 453 bp, Rosa hybrid cultivar
  misc_feature (20)..(20): n is a, c, g, or t
gaccactccgtcttcttctntacaatctcagatcttcttctctcaattccctcacacagaagatggacgccatagactcagtcgtggatcccctcagagagttctccaaggactccatccgactcgtcaagcgctgccacaagcccgatcgcaaagaattctccaaggtggcgctccggaccgcgattggattcgtggtgatgggattcgttgggttcttcgtcaagctgatcttcattcccatcaacaacatcatcgtcggatctgtttaggtcatgctgaagatcaagtttgatagatgataggtgcagcaatttgagagtttgaagaggaggcattagtgtgtgctttttagttctcatttggttccctttaagatatgtttacagtacgtttgtaaaacgatgaatcatgcagtttctaatttttcacaattgagacctcacaaaaaaa

SEQ ID NO: 738 - DNA, 419 bp, Rosa hybrid cultivar
ggagccaaatttctaacgacttcgtcttctctctctctctcgctctagattttagtgagagaaaatcgaaaatggacgccattgactcagttgtggatcctctcagagagttcgctaaggacagcgctcggctcgtcaagaggtgccacaagcccgatcgcaaagaattctcaaaggtggcgttgcgtacagccatcgggtttgttgtgatgggattcgttgggtttttcgtgaagctgatcttcattcccatcaacaacatcatcgtcggatctgtttaggtcattcctaaagttgagtttgatagaggctagatgatgcaggcaacaacatcaacatgtccctcaaagggaaagcaatagttatgcaattcttatttgtctccttttagtatcttctgtaacactcgagaactacaa

SEQ ID NO: 739 - DNA, 542 bp, Carthamus tinctorius
ggcggggatgtttgttggcgtataaccttgctctcatcttcttgtttcctccgcatctgcatccaaatccctaattcccttttccagatccgatatctctctcgatctcttctagacaccatggacgccttggattcagtattcgagccattgagagagttctcaaaggatagctaccgtctagtgaagagatgccacaagcccgatcgtaaagaattctcgaaggttgcggttcgtacggcgattggcttcgtggtgatgggattcgtagggttcttcgttaagctcatcttcatccctatcaacaacataatcgtcggatctgtttagaggtcatacgatcatcgagggatgcaaggaggatgttagctgtgttcaaaatggtttaaaaagagaactatgatgtattgtaggaaacttttttggtgttttgtttaagtagaatgagatttgttatttggtacttatatagtagtttctatatcatctactttgttgaacctctgctagtttctacatccttttcttgttttaagaaaaaa

SEQ ID NO: 740 - DNA, 447 bp, Carthamus tinctorius
agtagtagtagtaggtagtagtatcactcttccctttctctcctccacatttgcaattttctcgaagcttcgacaatggatgccatagattcagtcatcgatcccttgagagactttgctaaggacagtgctcgtcttgtgaaacggtgccacaagcctgatcgcaaagaattcacgaaggttgcgtctcgtactgcgattggattcgttgtgatgggattcgtcggtttcttcgtcaaattgatcttcattcctatcaataacatcatcgttggcgctagctagggctgcatggaggttgaagcatgcatgcaactgaatagcaatctcagaggtaagaataacatgaatattgatatgcttaaccactgctcagacatatgatacatttatctctctgtcactctttgtattaagacggatataaatgagaatttctgaattttg

SEQ ID NO: 741 - DNA, 635 bp, Senecio madagascariensis
cgcagtcggtacttcaactttatgttttatttttggacgcggggccccaatttctcatagtaacagatctgatcaaattctctctcgaattcaaactcttaacaatggatgctttagattcagttttcgagccattgagagaattctcaaaggatagttatcgtctagtcaaaagatgccacaaacctgatcgtaaagaattctcgaaagtagctgtgcgtacggcgattggtttcgttgtgatgggattcgtagggttctttgttaagcttattttcatcccgatcaataacatcattgttggatctgtttagaggtcatacaactgtcaggaggaatctgtggagaatgcgggttgtgtgcgaaatgggttaaaaagatatctatgatgtactgaagtagacttttctggtgttttgttcaagtagaaatgagattttgttattttatactttaatctaatgttgaactttattcgtttttacattttgccttttgttttacttattgcatattcttgtcgcttatgcaccaaatgtccacgattcccactgttgtttattgttgcttacgagaattcatataacgtaatctagttatgtctgatctatttatagctccttttcattgaccat

SEQ ID NO: 742 - DNA, 499 bp, Sesamum indicum
  misc_feature (362)..(362): n is a, c, g, or t
aattatctccgcaccccagatctagagagaactcgaatcgctgtaagaagatggatgctttggactctgttttcgatccgctcagggatttcgctaaggacagcgttcgcctcgttaagcgctgccacaagcccgatcgcaaagagttcaccaaggtcgctactcgaacggcgatcgggtttgtcgtgatgggcttcgtcgggtttttcgtcaagttgattttcattcccatcaacaatattatcgtcggtgctacttaatggcttgataggcttttgcttggtacaagaaacctcaattacatctaagagcagggaagaaagcgttttgatgattagttagcatctttttcttaaaatttnaggacttttctatgtaatagttgacagttgatgttaaatttgttttgtcgattatggacttccatgcatggcttatgacactattcttcttgtccatttttactatattgccatgatggcttatattgagctactcc

SEQ ID NO: 743 - DNA, 580 bp, Solanum phureja
agcgatatttcatttgtaccgatccaaagagctcatttcaatttcaccccaattcagatcgagatccagaagaaaaaaccctaattttgttttcagatccaaaatggacgctctcgatactgttttcgatcctcttagagatttcgccaaagacagcgttaggctcgtcaaaaggtgccacaagcctgatcgcaaagaatttaccaaggttgcaacccgtacggcgatcggttttgttgtgatgggatttgttggatttttcgtcaagttgatattcattccaatcaacaacatcatcgttggtgcttcttaagtggtatcgtgaaggagaagtacaactggagatgtagagcaagagataaaaagtggtgcaaaatcttagtttcatattgtaatccgtaacagttggtataccatgtagtcttatttctgaaccgcctagttgatggggattgtcatctgagttgcccccctcagctcgcattcccctcacccaatccgttttcagattttgtaaactttgctgttgatgtcaagacttccttttttttttaattctacttttttcaccttggtgggt

SEQ ID NO: 744 - DNA, 591 bp, Solanum phureja
ggaactttttgtctgaacaaaaatggatgctctcgactctgttttcgatccccttagagatttcgccaaagacagcgttaggcttgtaaagaggtgccacaagccagatcgcaaagaattcaccaaagttgctactcgtactgcaatcggcttcgttgtgatgggatttgtaggatttttcgtcaaattgatcttcattcctatcaacaacatcatcgttggtgcttcttaatcggtcgtgtgaaggagaaactaaatggagatatagaaggaagtaatgacgacagtcctcacaatttagtttaaatttgtaacctctggctgttggatatttctgacatgttattcagtacctcttattggtctgagttaatactgtagcattcaaattgcctttatcaccttctccctgcaccctcatattggaattttgtacacttgtttccagatcaaagtatttatctcttagttttacttttctggtgcccttgatacagaggtaaatgtttctatgattatttttcttcatgaaagatgctttatcatgaaaagtacaattaagaaagaagaacgagagtattgatttggcag

SEQ ID NO: 745 - DNA, 730 bp, Sorghum bicolor
gcacgcctccgcgtcgtcaaggcaaagcacgcgcaaatccacccccggcgtcgtcgtctccaagcaagcgaagagcgcccgcccctcgagatctctcggcctctccccctccccgcgccgccgctatggacgccgttgactcggtggtcgacccgctccgggagttcgccaaggacagcatccgcctcgtcaagcgctgccacaagcccgaccgcaaggagttcaccaaggtcgccgcgcggactgcgatcggcttcgtcgtcatgggattcgtcggcttcttcgtcaagctcatcttcatccccatcaacaacatcatcgttggctccggctgatccacttccctctggctagaggctgcaggtgtggacaatggcgtcactaccttggaggcagcaccattttcagccctgatatcagtaaagatccgtttaggacttgtgttgttaaggacaacctccttacctttttctcttgaggacttgtggtacacctggaactcttttgtacctgatgccgaatgggtttccgtgaattagcgggtaacaaaattgaatggttaccatgtcttctcgattgttttatggtgcggtatccttcataatttgcttttcgcgacgttgttagtacaactcccgtatcgttcataatctgaatatgtaattttcgtataaaaggtgccgaagctacgagactgcgtaccactaacttgaggcttccgattttggat

SEQ ID NO: 746 - DNA, 631 bp, Sorghum bicolor
aacagtacaagcaaaagttgtgaaacgacgtagctcttcgatacagaagacgtataaaggggccacccatttccatctggaaaggagaagaaaacaagcaaaacttcccaaaggcaaaaaccgcattctcgcgtctgctttccttccacacccatatccaccccccgcgtgaccgcgtctcgccccgtcgccatggatgccatcgactccgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgtcaagctcatcttcatccctatcaacaacatcatcgtcggttccggctaggcttacaggagtgcaggacgattagcatgggagtagtgcgatacttctgagagcaggatcttggtctttcgaatagtattgttaatgacagtttttattcgttgtgtttctggagtaatcgttgtactgtaagacttcaggatgtctggataccggattctgagtagaccttgaaaccttgataaagcagccagtcttggaaagaaagttttatcttttgttgtttcgt

SEQ ID NO: 747 - DNA, 562 bp, Glycine max
gatgaacgagaagaaaagtgtataaaaatcaacatctattacattagaattcagatccaaacgaaacgcaggagagacagacagagaagagaatggacgccattgattccgttttcgatcctctcagagaattcgccaaggacagcgtcaggctcgtcaagcgatgccacaaacccgatcgcaaagaattctctaaggttgctgtgcgtaccgcgattggtttcgttgtgatgggattcgttggttttttcgttaagctcatcttcattccaatcaacaacatcatcgtcggatctggttaggatgaggggaatcgcaatcgcctcaggaattcaagttatcaaacaaaatgagaggcagaaagagttccaacttcaaatagatagctcaatgaaattaattgtagttctgctgtatttcatttttggtttacctttgtatcttcggaagcattacaattttatttgaaatgtaaaattttgtttttccatgtgctggacctttagacacattgttttgattcaggaaaagaatgaaaaatatctatagttagccaatatcc

SEQ ID NO: 748 - DNA, 728 bp, Glycine max
ttacggcatcaaatccctggttgctttcgcagatcgctcccttttgcaactccaactcccttctcttgatgtccaccatcagaataggtgtgctcctctcctccaaggggactgtgatggttaagatccaagcttgggagacagagaaagagaaagagaatggacgccattgattctgtgttcgatccgctgagagaattcgcaaaggacagcgtgaggctcgtgaagcgctgccacaaacccgatcgcaaagaattctccaaggttgccgtccgtactgcaattggtttcgtcgtgatgggattcgtcggtttcttcgtgaagatcattttcattccaattaacaacatcatcgtcggatctggttaggatgaagggaactacaattgcctcagaattcaggttgtcaagcaaaaggaggtagacagagttcccacatcaatagatcattttatgcccccaatcttagttctgttttcatttttgttttttcttatatctggaagcgttactttagatgtaaaattttatttatcctttgttagaccttgacacattgttttgatttaggataaggaggaaaaaacaatggtcaaacctgaaacttgatttgattctatgttgactttgctttcgaatttatttatgatggctgtttattggcctttgcagaataacgttttgtttcatttagcaagaatctgcagataaatttttcaatgatgcca

SEQ ID NO: 749 - DNA, 656 bp, Glycine max
caaaaaatcaacacccatttcaattctcaaatccaagctcgggaacagagaaggagagagacaatggacgccattgattctgtcttcgatccactcagagaattcgcaaaggacagcgtgaggctcgtgaagcgctgccacaaacccgatcgcaaagaattctccaaggttgccgtgcgtaccgcaattggtttcgtggtgatggggttcgtggggtttttcgttaagctcattttcattccaattaacaacattatcgtcggatctggttaggatgaagggtactacaatcgcctcaggaattcaggttgtcaagcaaaagtaggcagaaagagttcccacatcaatagatcattctatgccctcaatcttagttctgttttcatttttgtttttttttctcatctcaggaagtgttacttactttagacgtaaaattttatgtatcctctgttagaccttgatacattgttttgatttaggataaggaggaaaaacaatgttgaaactgtagttttgtttgattctatgttaactttgctttagagtttccttatgatggctttttattggccatcgaactgaatccgagtttaaagtttcaaaagaaaaaaagttgaaggtatctagggtgggggtcgcactcctttgcagaa

SEQ ID NO: 750 - DNA, 310 bp, Selaginella moellendorffii
gagggcccagggggagaattagggttctaagagaaaaggaagacatggaggctgtggatgtggtcgtgcggccgatgaaggaattcgccaaggacagcctgcggctcgtcaagcgctgccacaagccggatcgcaaagagtataccaaggtcgcgctgaggacagcggcgggattcgtagtgatgggattcatcggattcttcgtcaagctcatcttcatcccgatcaacaacatcatcgttggatcgggctagagagagttttttgtaaggtttctccaaggaaattgaccatggaattttttccctct

SEQ ID NO: 751 - DNA, 945 bp, Picea glauca
  misc_feature (865)..(865): n is a, c, g, or t
  misc_feature (893)..(893): n is a, c, g, or t
  misc_feature (941)..(942): n is a, c, g, or t
aggaaatctcacttcatagagcctaccataaaagccgagagaaatccgtcctgtgtttcattttcgccattgttggagcttcgagggaatttcagcacgctaaagagcaatcccgcacctcgaaaacacgtaaacgtcttgtagggttcgaatctactgaatcatggatgctgtagacactgttgtgaggccgttgaaggactttgccaaagatagcgtcaggcttgtgaagagatgtcataagccggaccggaaagaattcagcaaagtagcattcaggacggcaattggttttgtcgtcatgggctttgttggcttctttgttaagttgattttcattccaatcaacaacatcatcgttggatctggataggaatttatgcgggtcatgggtgacaagacttgcatatttttgtatgttagacactgtcaaatgatgttgaagttgtacctgaaattccgggtttcttttgttttgttagtgaattatatggattacaaatagtaaattttaactactactatagcaaatgccttttggtagagtgttcaatgcggataagtgaattatatggattacaaatactaaattttaactactacgatagcaaatgccttttggtagagtgttcaatgcggataagtgacttgttacggatgtagaaaatttctgttttttttaaaccaaaactgggaaatttatatcatataaagctgtagcttgctaaacagcggaattacatcttactgctgtccagaattttaggcaaaataaacagctccttaagtgcgaaaagcagagcttacatgtatcatcaagcaaaatatcccagtgcttcttagagctatatattctaaaggaaanacctaatattctagtgactttaaaaaanattaaacttaatggaaaacgtgacgggctgatagcctcttcagaaaanntcc

SEQ ID NO: 752 - DNA, 1294 bp, Picea glauca
  misc_feature (856)..(856): n is a, c, g, or t
  misc_feature (875)..(875): n is a, c, g, or t
  misc_feature (1004)..(1004): n is a, c, g, or t
  misc_feature (1026)..(1026): n is a, c, g, or t
  misc_feature (1085)..(1086): n is a, c, g, or t
ttaattaaattaatcccccccccccccggagaggaagtaaaccgcagggttttgattttgtgttagggcttcttgcatctttgaaggtggtggcagcggatttacggcggtcagtcgagcaggggagctatatcgtaagcagcgtatagaggcgcgataaaaatggaagccgtggatgcggttgtaaggccgctgcaggagtttgccaaagatagcgtgcgccttgtcaaaagatgccacaagcctgatcgcaaagagtttagtaaagtggctttcaggacagccattggatttgttgttatgggatttgttggtttctttgtcaagttgatcttcattccaattaacaacatcattgtgggatcaggataggatgatgtgcgatgatgggcatatctggctgcatcaagaggctgaactaggatgatgaatttccattggatcttcaaagtacagagcaagcaaactacagactatgtagttgattttaggcactgtttcaagtttccataaattaagattatggaagtttttggtctgtcaattgtttccttatgtttgaggtttggaaattttacttttaatggttcatgacatgatgctttatcggtacatacattgtggattgtgttgatggttttcctactactctcttagtagagactgttcagtttttcttttcgaaagaaataattggtggtcctttccatcataaaataaaaggttacaatatagaaagttgaacaacccaaagggtcaagacaatgtatgtcagtgatattcaaaaactgaactaacagaaataaagaaacattcaaagtaatagaaataaggaaactttcactagatgattgcnctgaaaaaccaaatttgcnccatcatatctacaaattccagggggtttggcaaactagcccaagaaggcaccaatgtgcagaggttcaataaagctgctgccagctacttcagtctcaaaggctgaaaattgcaaaatcatggtcgangtatcttaatgggaggatctcntcaacccgatcacgatagatttatatggacaaggaatccggatctctgctacaagcttnngattagataatctgtccccctctttgttgtgctcctgatagattatgaggaaagtgtgtcctgtatagagttatatacgggtttctatatcttctgttagtggaaggcagccatgcagtcccaaacttctctttcttcttactctgttcccggaattccatagttccccactaatgggaatcccataaatgttgatatcgtttaacca

SEQ ID NO: 753 - DNA, 534 bp, Euphorbia esula
ttcgatcccctcagagagttcgctaaggacagcgttcgcctggtcaagaggtgtcacaagcccgatcgaaaagagttctcgaaagttgcattgcgtacggcaattggcttcgtggtgatgggatttgtcggattcttcgtcaagttgatcttcattccgatcaacaacattatcgtcggctctagctaggtcctttaagctattgacaagtgcacaagatggaagtaattcaattgaaatttgtagcatttgtcatatagaattgcagttagctttctctgttttattggtggttatgatagtagagttaaccaggaacttatgaatttgaacttcccctgaattttgggttagcatcatcgacatggttgattttgcactatgttttgttatcatttgtgcaccatagactggttctctggcatactatattaggaactggttattaggtatgggtgatatgaattcctaaaaacaatatcatagctgctatcgttacattgttagttttacatgccagaaaagtattcaagt

SEQ ID NO: 754 - DNA, 473 bp, Euphorbia esula
gaagaagaagatcgaaatggacgctatagattcagtgtttgatccattgagagagttcgcaaaggacagcgtccgcctagtcaagcgttgccacaagccagatcggaaagaattctccaaggtggctctccgtacggcgatcggattcgtagtgatgggatttgttggtttctttgtcaaattgatcttcattcctatcaacaatatcattgttggatctagttaggtcatattggaaaattaacatggggattgcctggcttttaatgcatcaaagttatttaaactgcagaggaagcataattgttagggcttgaaattatcttttagttgcttgtctaaaactacattgtgaactatatcatttcgaaattttcactagtatatggcgcttctttttatttctttttttttggcacgataacacgttttataaagattatttgatttatacaacatgattctttttttcc

SEQ ID NO: 755 - DNA, 643 bp, Fragaria vesca
  misc_feature (460)..(460): n is a, c, g, or t
  misc_feature (491)..(491): n is a, c, g, or t
  misc_feature (496)..(496): n is a, c, g, or t
  misc_feature (573)..(573): n is a, c, g, or t
acttcgtctgcttttatacattctctcagatcttcttcttctctctcgctctcaaattcgatcacagaaaagaagacatggacgccatagactcagtcgtggatcccctcagagagttctccaaggactccattcgtctcgtcaagcgctgccacaagcccgatcgcaaagaattctccaaggtggctctccggaccgcgattggattcgtcgtcatgggattcgtcggcttcttcgtcaagctcatcttcattcctatcaacaacatcatcgtcggatctgtttaggatatggtgaagtccaagtttcatagatgataggtgcagcaacttgagagtttgaagaggaggcgatactgtttactttttagttctcatttggttccctttaagacatgtttaccgtacttttgtataacattgaatcatcaagtttctagttttccataattgagaccttnaccacaagactaccagggtgatatgcaaggntgagnaagtccaaaggttccggcgctcggtctcgagacttcataacattctttgcccgcggccgtggtaatgaaatggcatntgttccaagaaaccgtctgataggttggtctccataaaagccgggaacaaggttgaaatcaatgattggg

SEQ ID NO: 756 - DNA, 528 bp, Fragaria vesca
ctgctctctctctctctcgctctagattttagtgagagaaaagagaaaaatggacgccattgactcagttgtggatcctctgagagagttcgctaaggacagcgctcgcctcgtcaagaggtgccacaagcccgatcgcaaagaattctcgaaggttgcgttgcgtacagccattgggtttgttgtgatgggatttgttgggtttttcgtgaagctcatcttcattcccatcaacaacatcatcgtcggatctgtttaggtcattcctcaagtttgaagtttgctagaggctagatgatacaggaaacaacatcaacatgttaaagcaatagttatgcagttcttatttggctctttttagcatctaaagtaacacttgagaactaaacttccgtggttacaacatcatttccttgtttcttttgctttacttatacattgtgaagcctctagaagaatatctctctttgaggtacatatttctccacatgtcttgctctcatataacctgaatgtgccatttccatc

SEQ ID NO: 757 - DNA, 553 bp, Saccharum officinarum
ctgcggtaccggtccataattcccgtctagcgacagcgcgcactgccgcattctcgcgtcggcttccttccacacccatccaccccccgcgtctcgccccgtcgaccctgtcgccatggatgcgatcgactccgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgtcaagctcatcttcatccccatcaacaacatcatcgtcggttccggctaggcttacaggagtacaggacgattagaatgggagtagtgctatacttttgagagcaatggataacgaggatcttggtctttcgaatagtattgttaatgagaattgttttttttcggttgtgtttctggagtaatcgttgtactgtaagacttcaagatatttggattatgtgagtagaccttgaatccttgatgaagcagccagtcttggaaagaaagtttcatattt

SEQ ID NO: 758 - DNA, 542 bp, Saccharum officinarum
  misc_feature (14)..(14): n is a, c, g, or t
cgcaaagccaccancgcgtcgtcgtctccaagcaaccgaagggcgccccactcgagatcttctctccctccccgcgccgccgccatggacgccgttgactcggtggtcgacccgctccgggagttcgccaaggacagcatccgcctcgtcaagcgctgccacaagcccgaccgcaaggagttcaccaaggtcgccgcgcggactgcgatcggcttcgtcgtcatgggattcgtcggcttttttgtcaagctcatcttcatccctatcaacaacatcatcgtcggttccggctgatccgtttccctcgggctaggggcctcgggagtggacaatggcgtcactaccttggaggcagcaccgttttcagccctgatatcagtaaagcaatccgtttaggacttgtgttgttaaggacaactcccatatcttttcctttctttaggtcgtgtggtagacctggaactcttttgtacctgatgcccgaatgggcctccgtgaattagcgggtgacaaaattgaatggttaccatgtcttctcgatt

SEQ ID NO: 759 - DNA, 536 bp, Saccharum officinarum
cgcaaagccaccaccgcgtcgtcgtctccaagcaaccgaagggcgcccccactcgagatcttctctccctccccgcgccgccgccatggacgccgttgactcggtggtcgacccgctccgggagttcgccaaggacagcatccgcctcgtcaagcgctgccacaagcccgaccgcaaggagttcaccaaggtcgccgcgcggactgcgatcggcttcgtcgtcatgggattcgtcggcttttttgtcaagctcatcttcatccctatcaacaacatcatcgtcggctccggttgatccgttcccctcaggttaggggcggcaggagtggacaatggcgtcactaccttggaggcagcaccattttcagccctgatatcagtaaagcaatccgtttaggacttatgttgttaaggacaactcccttatcttttcctctcttgatgaggacgtgtggtagacctggaactcttgcgtacctgatgccgaataggcttccgtgaattagctggtgacaaaattgaatggttaccatgtc

SEQ ID NO: 760 - DNA, 539 bp, Helianthus annuus
  misc_feature (6)..(6): n is a, c, g, or t
  misc_feature (380)..(380): n is a, c, g, or t
  misc_feature (391)..(391): n is a, c, g, or t
  misc_feature (399)..(399): n is a, c, g, or t
  misc_feature (427)..(427): n is a, c, g, or t
gggggntcacaaactcaccatttaagttttccgaagcttcaacaatggacgccatcgattcagtcatcgatccactcagagacttcgctaaggacagcgctcgtctcgtcaaacgctgccacaaacctgatcgcaaagaatttacaaaagttgccactcgtactgccatcggattcgttgtcatgggattcgttggcttcttcgttaaattgatcttcattccgatcaataatatcattgttggcgctacttagggctgcatggaggttgaggaatgcaaagaaatacaaatgacaagtcctggagatcagaataaaatgaaccgttatgtgctcacgcatatcgtatgttcattattgtataactactatataatacanatgcggattanattaatanttgtgtcatttgttttctgttgcattanaagttaaggtctatttaaacacagtgtttttctttccctgctatcactatgtaggtattattttccttgactgtttagttgaattgaaagtaggacattaccattaaaaaaa

SEQ ID NO: 761 - DNA, 553 bp, Helianthus annuus
cgggggaaacccctaattattgtctgtgcaggcagatctgattgataatggatgctttagattcagttttcgagccattgagagagttctcaaaggacagctaccgtctagtcaagagatgccacaagcctgatcgtaaagaattctcgaaggtagcggttcgtacggccatcggtttcgtggtgatgggatttgtagggttttttgttaagctaatcttcatccctatcaacaatatcattgtgggatctgtgtagaggtcatgcaagtgttaaggaatgcatgggcatggaggatgtgcaaaatcgtttaaaaagtgaagaatgatgtattgtagggagcttttttggttttctgttctaatagaatgagatttgttatttgatactttaatgttgagaactcatcttagtttttacatcttctgcctctggcatttgtttttacttgttggatcgttcttttcacatgcgcttgaatgtgcactcatcgaatgattgtatataccacatgcttgatgtcatatatatagtgcctattgttttgccaaaaa

SEQ ID NO: 762 - DNA, 552 bp, Helianthus annuus
  misc_feature (490)..(490): n is a, c, g, or t
  misc_feature (492)..(492): n is a, c, g, or t
  misc_feature (534)..(534): n is a, c, g, or t
cggggaccgtataacctttgctctctgttctcattgttttctccgtatctccatacaaatccctaattctctttgcagatcctctctctctctctctctcgatcaatcaacaatggacgctctagattcagttttcgagccactgagagagttctcaaaggacagttatcgtctagtcaagcgatgccacaagcctgatcgcaaagaattctccaaggttgctgttcgtacggctatcggattcgttgtgatgggattcgtagggtttttcgttaagcttatcttcattccgattaataacatcattgtcggatctgtttagagatcatattatcgccaaggaacggatggaggacactaactagctgagtgcaaaatgtatggcttagaaacagaagtatgatgtattaaggaatctttttttgttcttttcaagtagaactggatttgctatttgatgcttaaatgttgaacctatctcagtttttanantcctgttttttgttttacttactgaaatttctgaatttggtncgcttgatgagtgctgaa

SEQ ID NO: 763 - DNA, 562 bp, Panicum virgatum
acgctttcacctcgcggtaggcaaatcacgcgcaaagccacctccgcgtcatcgtcgtcgtctcctctcctctccaagcaagcgaggcggcctcgagatctcctactcctccgcgccgccatggacgccgtggactcggtggtcgacccgctccgggagttcgccaaggacagcatccgcctcgtcaagcgctgccacaagcccgaccgcaaggagttcaccaaggtggcggcgcggacggcgatcggcttcgtcgtcatgggcttcgtcggcttcttcgtcaagctcatcttcatccccatcaacaacatcatcgtcgggtcaggctgatccggtcccggcaggtgaggggctgcaggacctggcaatggcaacaataccttggaagcagttttcagccctatatcgtaaacaatcatttaggctttctttttgttaaggactgctccccctgttttgtctcgaaagattgtattggtacccttgaaactccttttgtaacctgatactgattaggcattggtgagctaacaggtgacaaaatccaatggttacagtttcc

SEQ ID NO: 764 - DNA, 707 bp, Panicum virgatum
gaggaaaggcaaaacagacttcccaaaggcagaacgcaagctcgcggcggcttccttcttccaaacccctcgcttccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtcgcggcgcggacggcgatcgggttcgtcgtcatgggcttcgtcggcttcttcgtcaagctcatcttcatccccatcaacaacatcatcgtcggttccggctagacctcgagtcctggagaagtgcagaacgagtgactagcatgggtggattgcaatacttttgaggagagcaaaggctaacgatgatcttggtctttcacaaagtattgtaaaagacagtttctcatttgtgtttttggagtaatcctcatactgtttaagacttcaggatgcctgcataccagattctgagttgatcgatcggttatagaagggtacggtggactgctttctttttagataggctgaaagtaagaattcaggttggttcaatgtatcagttcgtggtaaatataaaaaacttaaaatatttttttgattgtggaacaaatttttttattactcggctggaacaatgtttcagcaacaaaaaaaaatttattccagca

SEQ ID NO: 765 - DNA, 687 bp, Panicum virgatum
ggatccaatccaactaccatcagtattgaacgctttcacctcgagaaggcaaatcacgcgcaaagccacctccgcgtcaaagtcacctcctcgtctcctctcctctcctctccaagcaagcgaagcggcctcgagatcttctccgcgccgccatggacgccgtggactcggtggtcgacccgctccgggagttcgccaaggacagcatccgcctcgtcaagcgctgccacaagcccgaccgcaaggaattcaccaaggtggcggcgcggacggcgatcggcttcgtcgtcatgggcttcgtcggcttcttcgtcaagctcatcttcatccccatcaacaacatcatcgtcgggtcaggctgatccggtcccagcaggtgaggggccgcaggactggacaatggcaacaataccttggaagcagttttcagccctatatcataaagaatcatttaggttttctttttgttaaggactgctcctcctgttttgtctcgaaagatttggtacacttgaaactctttttgtaacctgatactgattaggcatgcgtgagctaacaggtaacaaaatccaatggtgacagtttccgcacccgtttaccttgtcttctgggatatgttgtggtttggctccgttcctgattcctatttccttacaggcggacgttgtcttttcaaaaaagata

SEQ ID NO: 766 - DNA, 654 bp, Panicum virgatum
gaaacttaccaaagctcgcggcggcttccttccacacccctcgcttcccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgtcaagctcatcttcatccccatcaacaacatcatcgtcggttccagctagacctcgagtcccggagaagtgcagaacgagtgactagcatgggtgtagtgcaatacttttgaggagagcaaaggataacgacgtttttcgcaaagtattgtaaaagacagtttctcatttgtgtttttggagtaatcctcatactgtttaagaattcaggatgcctgtatacccgattctgagtagacatgcactctgttcgcagcaaccagccaacactcacaccaaaccagcaccagccagcagtcgccagccagtagtacttttctctcacaacaaatcagcaccagcgacagcacaacaaacagaggtatggatgaagtagcgagttgtgaaaaaaaataatatattgtcgtcccgt

SEQ ID NO: 767 - DNA, 481 bp, Tamarix hispida
tgagcgaggaagggggctcattgtaattgtatatcgatctctctctctctggatctaagtcttcgtccttgtccgtcctataactccaattcaaaccatggacgccattgacacctttgccgatccactcagagatttcgccagggacagcgttcgtctcgttaagcggtgccacaaacctgatcagaaagagtttacgaaggttgcattccgcactgcaatcggatttgttgttatgggatttgttgggttcttcgttaagttgatctttatccctattaacaacatcatcgtcggtgctgcttagggagtaacatacacgcactgatcgaggcagttcagctaatcgaagatggtggccgctcatgttgctttggaaacgatctttcttttcctttctatcttttgagatgcatgtagtaaagtccataaacacggacaatccagagattttggctcatcaaatgttactagttttggg

SEQ ID NO: 768 - DNA, 453 bp, Tamarix hispida
  misc_feature (205)..(205): n is a, c, g, or t
  misc_feature (306)..(306): n is a, c, g, or t
  misc_feature (398)..(398): n is a, c, g, or t
  misc_feature (413)..(413): n is a, c, g, or t
ggggaagcactccaggtctcaacagtgatcaaacttctctctcggagtcgtctcgctgtttcctcctagaaaaatggatgctctcgactcagttttcgatcccttgagagacttttccaaggacagtatccgccttgtcaagcgatgtcacaaacctgatcagaaagaattcacgaaggttgcattccgtactgctattggattngtcgtcatgggatttgtaggtttctttgttaagttgatcttcattccaattaacaacatcatcgttggatctgcttaaaaggttgatggtgttggaaggtncaatcaagaaggaagaaatatgatgactaatatgaagacactgttggcgtagacgttagtgaaattgtggagattatgaactcattatattntgtaatacctaattntgttcaagggtctggttggttaagaatttggtttgctttg

SEQ ID NO: 769 - DNA, 601 bp, Camellia sinensis
tgaaaaagtcctctctctctctctctctctctctctctctgtgttcttcgagctctctctctaatctctctccacacacacagaaatggatgccttggactccgtattcgatccattgagagagttcgctaaggacagcgttcgcctcgtcaagaggtgccacaaacccgatcgcaaagaattcaccaaggtcgcggtccgtacagcgatcggattcgtggtgatgggattcgtaggcttcttcgtgaagctgatcttcatccctattaacaacatcatcgtcggatctggttgaggaggtcaggtggaaatgtaagcttgcatgaaactggaagttcttgataggatgcaaaaacacatgaagagaggagaatattccaagcaatgtaggatcttttttcaatacaatcatttaaatttcttgagtctttgttctttttactagctccatagtggtgaacagaaattttcttataaaatgtactcccttttatattttgtgttgttcttaaacagaatatcatgtcatggatgatgaattttgttaggctggtgcatcaaaacaggttggaattcagcataattttagtgcattttaagc

SEQ ID NO: 770 - DNA, 597 bp, Thellungiella halophila
ggttttccttcgattttattcctctcagaaaccaaattaacacaaaactgtgagattcagatcatcgaaagcaaatcaacgataaatcgccatggacgccatcgattccgtcgtcgatcctctcagagacttcgctaaggatagcattcgcctcgttaagcgttgccacaaaccagatcgcaaagaattcacgaaagtagctgttcgtaccgcgattgggttcgtggtaatgggattcgtcgggttctttgtcaagctcatctttattccgatcaacaacatcatcgtcggtgccacttagaaaccagaagaacaaatggagagaaaagaaagattagatgtttgtttctgtttttaagagaaggcacctatgttttgatgtaatcggattccattttgtttcaagtttttttttttttttttgttattttgttcacacaactgaaaaatcagacttgtcttgaatgtagagcaaaaactaagttagatggctgagttcttcgttagaccaagtggctcttccacgtggtctgactctcttttgcacgccaagcttgactatagtctataagaacgcgggattgtggttttctacgt

SEQ ID NO: 771 - DNA, 508 bp, Thellungiella halophila
  misc_feature (23)..(25): n is a, c, g, or t
  misc_feature (28)..(29): n is a, c, g, or t
  misc_feature (476)..(476): n is a, c, g, or t
ggccatcacggagtttatttctnnncgnnccaaaccaacagacagagaaaaaaaaataaagaagtcgtcgttgtcgtcaaagaaagaaagcgccatggatgccatcgattccgtcgtcgatcctcttagagacttcgccaaggacagtattcgcctcgttaagcgttgtcacaagccagatcgcaaagaattcacgaaagtggcggtccgtacagccatcgggttcgtagtaatgggattcgtgggcttctttgtgaagctcatctttattccgattaacaacatcatcgtcggtgccacttaggtcactccccttcaccattttcctctgtttggaaagacagtaaaaaagataacctgggaggatggagaaaggtagctacagctttgttgtttgaagaaggcacttcatagtttttgttttttttttggttcagatacacaaaagaggaaacatttgttcacaaattgcattntccggtaattgcattctaattaatatatgttg

SEQ ID NO: 772 - DNA, 502 bp, Nicotiana tabacum
ttctttcagatcagatctaattcaaatggacgctctcgattctgtgttcgatcctcttagagatttcgccaaagacagcgttaggctcgtcaaaagatgtcacaagcctgatcgtaaagaatttaccaaggttgctactcgtacagcgatcggttttgttgtgatgggatttgttggattttttgtgaagttgattttcattcctatcaataacatcatcgttggtgcttcttaattggcgctgcaaaggacatagccaattggagatgtagagccagagatagaagtggtgcaaaaatttagtttcacattgtaatccgcagcagttggataccctgtagtcttattctgaacctcctagttaattagtttttatgtcattctaattgcctccctcacctcccagtcccctcttccagcctgctatcagattttgtaaactttcctgttgaattcaagattacaatttttttatcgtaatttcgcccaatcctttaagcca

SEQ ID NO: 773 - DNA, 589 bp, Nicotiana tabacum
ggagagaacccattattctcagaccaaaatggacgctctggactctgttttcgatccccttagagatttcgccaaagacagcgttaggcttgttaagaggtgccacaagcccgatcgcaaagaattcaccaaagttgccactcgtactgcaatcggtttcgtggtgatgggatttgtaggattttttgtcaagttgattttcattcctattaacaacatcattgttggtgcttcttaaccggcaatgtaaaggagaaaccaaatggagatatagcaaggaaacgactcctgaagtcctcccaatttagtttaattttgtaaccggtagctgttggacatctctgacgtcttattctgaacctccttattggtctgagttagtagcattcaaattggcttcctcacctccctgcaccctcttgttggaattttgaacacttcctttcagctcaaagcacttatttcgtagctttacttttctggtgcatttacaacagaggtaaatgttttctttgaaaatgtttccatgaaagatgttttattatgaagaataatttagaatgaagaatgagggtattgttttgacgga

SEQ ID NO: 774 - DNA, 608 bp, Nicotiana tabacum
tcttattcttacaacccccctctgccgctaggagaaaccgattattctcagaccaaaatggacgctctggactctgtttttgatccccttagagatttcgccaaagacagcgttaggcttgttaagaggtgccacaagcccgatcgcaaagaattcaccaaagttgcgactcgtactgcaatcggtttcgtagtgatgggatttgtaggattttttgtcaagttgattttcattcctattaacaacatcatcgttggtgcttcttaaccggccatgtaaaggagaaaccaaatggagaaatagcaaggaagcaacacatgaagtcctcccaatttagtttaattttgtatcctgtagctgttggacatctctgacgtcttattctgaacctccttattggtctgagttaacagcattcaaattgcctttctcacttcccaccctctccctgcacccctcatgttgaaattttgaacacttcctttcaggtcaaagcacttatttcttggctatacttttctggtgcgtttagtacagagttaaattttttctatgaacaatgttttcatgaaagatgttttattatgaagaataatttagaatgaaga

SEQ ID NO: 775 - DNA, 246 bp, Nicotiana tabacum
  misc_feature (155)..(155): n is a, c, g, or t
aaccagatccgcactcctctttcagcgctaaaatggacgccttagactctgttttcgatcctcttagagatttcgccaaagacagcgttagacttgtcaaaagatgtcacaagcctgatcgcaaagaattcacaaaggttgcgactcgtaccgcnatcggtttcgtcgtcatggggtttgttggatttttcgtcaagttgatttttattcctatcaacaacatcatcgttggtgcttcttaactgg

SEQ ID NO: 776 - DNA, 668 bp, Nicotiana tabacum
tatcgatccgaagctcatttcattcatctccgtttcacccaattcagatccaaaagagaaaccctaatctgcttattctttcagatcagatccaattcgaatggacgccctcgattctgtgttcgatcctcttagagatttcgccaaagacagcgttaggctcgtcaaaagatgtcacaagcctgatcgtaaagaatttaccaaggttgctactcgtacggcgattggttttgttgtgatgggatttgttggatttttcgtgaagttggttttcattcctatcaataacatcatcgttggtgcttcttaattggccttgcgaaggacatagccaattggagatgtagagccagagatagaagtggtgcaaaaatttagtttcacattgtgatccgtagcatttggataccctgtagttctgaacctcctagttaatccgtttttatgtcattctaattgcctccctcacctcccagtccccttttccggcctgctatcagattttgtaaactttcctgttgaatttgagacatacaatgttttcatcgtaattttgcccaatctttaagccatgatggatacagctttggaacgtagcttaattgtgacaacggaaatatatccctctacttccaaaaattcaaactcggccgaattagaaaacatgt

SEQ ID NO: 777 - DNA, 562 bp, Solanum lycopersicum
agcgatatttcatttgtaccgatccgtttgagttcatttcaatttcgctaaattcagatcgagatccacaataaaaaaaaccctaattttgttttcagatccaaaatggacgctctcgatactgttttcgatcctcttagagatttcgccaaagacagcgtaaggctcgtcaaaaggtgccacaagcctgatcgcaaagaatttaccaaggttgcaacccgtacggcgatcggttttgttgtgatgggattcgttggatttttcgtcaagttgatattcattccaatcaacaacatcatcgttggtgcttcttaagtggctatataaaggagaagtacaactggagatgtagagcaagtgataaaaagtgttgcaaaatcttagtttcatattgtaatccgtatgtagtcttagtcttatttgtgaaccgcctagttaatggggactttgtcatcgagcttccccccacccaatccgttttcagattttgtaaactttgctgctgatgtcaagacatctatttattttttttcaatatactttttgcaccttggttggttca

SEQ ID NO: 778 - DNA, 4417 bp, Solanum lycopersicum
aacaactctctctctctcctttttctctctatctctctccagagttttttggtctccgggaaatggttgcgacgagacgaagtggatctctgccgtcgactgttaaacggtcggcctcctcctccgatgattcttcttctaagcgacaaaaggtggtagataataataacaataataataatgcggagtcgtcggagaaacccaagtctcctccaccgacggagaatcccaaggagttgtcttctactgacccgccggaattcgccgccgttacagctcccgacggtgagaccaccgccgttcccgccgcgaagggtgaagatgcaccttccgtatccgttgtagcaactcctattgcagaaggggcgacgcctgctatagttgataagcccaggagttcggtgactttgaggaagctgaatcaaggttcggaaacaacatcgccttggtgtaggcttatatcagagtttcctcagaacccaactattcatgtttcagctacgaatttcttgattggttctagcaaaaatgctcatcttcctatcaagcaacaaacagttagtgcaaccttatgttcaataaggcttacacagcatgaagggaattgggttgctgtgcttgagagcaggggcaaaggatctgtgcaagttaatggaaagacagttcggagaagcactagttgcattctcaattcaggcgatgagcttgtttttggtgttacagggagtcatgcttatatatttgagcagctgccatatgagcttggagttaagtcacctccttcagatgttaggaccagtgcaggaaaattgcttcgcgttgagagaagagcaggagatgcgtcagctgtagcaggtgcttccattttggcatcgctttcaagcctgaggcaagacccatcgcgcttgaaacctacgtctcaggttagtgggaatgagctgccttcttcccctgttattcatgaagatgagcttgatggcctcgaagtcgattcagctgcacatgttggcagcagcagtgctgctgatgtttcattgactagcaaaattcccccgcttgatggaaacctgaacgatagcagagaggcaggcaacatgccggaggaaagagagtggaacagagattcaataccagcttccgcagcaggggtgtctctaagatgtgcagtatttaaagaagagattcatgctgcaatagttgatggacaacaactagatgtttcatttgatagcttcccatattacttgagcgagaacacaaaaaatgtgctgattgcggcttcatatatacacctgaagcataaagaacaagtaaaatatacttctgagttatccactatcaacccaagaattctgctctcaggccctgcaggatccgagatttatcaggagatgctggcaaaggcactagctcattattatggagcaaaattgctcatctttgatagccattcctttttgggtggtctatcagcaaaggaggctgaattactaaaagagggaggcagtgcacataagatttctgctaactccaaacagattcctggagaacctgatttgtctaagggcaatgggtcatcatctggtcaagtaactaatgctaacactctgactgatcctttgggtttggaagcacacccaaagatggagattggcaatgtaccatctttagccgggacatcaaagaataccttgttcaagataggtgataaagtgaggttcattggttctgcttctggtggtttatattcaaactccaccagggggccaacttttggtactcgagggaagattgtgttgccttttgaagataatgcattatcaaaaattggtgtaaggtttgataagcctataccagacggggttaactttgggggtctttgtgatgatggtcatggatttttttgcaaggccagcgaactacgcttggaatccacaggtgctgatgatctggacaaattactcattagcacgttgtttgaggtcgtattcagcgagagcagaaagtctcccttcattttatttatgaaagatgctgagaaatcaatggcagggagttcagaatcatatacaacttttaaaaatcgacttgaaaagcttcctggtaacatcattgttattggatctcatgcacatacagataaccgcaaggaaaagtcacatccaggggggttgctcttcaccaaattcggcagcaatcaaactgctttgctcgatttggctttcccggatagttttgggaagttgcatgacaggggaaaggaagtgaccaagacaactaaacttctgacaaagcttttccccaacaaagtgaccattcacatgccacaggatgaagcgcttttatctgattggaagcaacagttggatcgagatgctgataccctcaaaatgaaaggaaatttgaatagcttgcgaacagttcttaatcggaatggattagactgtgatggacttgacactttgtgcatcaaagaccagactttttctgttgaaagtgcagagaaggtggttggatgggccttaagccatcatttgatgcagaaccctgatgcaaatcctgacgtgaggcttgttttgtctcctctgagcattcaatatggattggaaattctacaagccatgcaaaatgaaagcaagagcttgaagaagtcacttaaggatattgtgactgagaatgaatttgaaaagagacttctggcagatgttatcccccccagcgatattggagtaacatttgatgatattggtgcgcttgaaaatgtcaaggatacgttaaaagagctggtcatgcttcctttacaaagaccggagctcttctgcaagggtcaactaaccaagccatgcaagggaatacttctatttggaccccccggaactgggaaaaccatgcttgcgaaagcagttgccactgaagccggtgcaaactttatcaacatttcaatgtcaagtatcacttcaaagtggtttggcgagggtgagaaatatgtgaaagctgtcttctccctggctagtaaaattgctccaagtgtcgtttttgtcgatgaagttgatagcatgctgggacgacgggaaaatccaggagaacatgaggccatgcgtaaaatgaaaaatgaattcatggtgaattgggatggattgcgtacaaaagatactgaacgagtattggttcttgcagcgacaaacagaccatttgatcttgatgaggctgtcataaggcgactgccgcgtaggctgatggtcaatttaccagatgctccaaatagagcgaaaattctaaaagtcatacttgcaaaagaagacttgtctccagatgttgatctggatgcagttgcaagtatgactgatggatattccggaagtgatcttaagaatctttgtgttacagcggcatatcaacccattagagaaatcctagaaaaagaaaaaaaggaacatgctgcagctatggcagaaggtagacctacaccaacaccatgcggtggtgcagacatacgacctttgaacatggacgatttcaaaaatgctcacgagcgggtttgtgcaagtgtttcatcggaatccataaatatgacggagcttcttcagtggaatgaactgtatggagaggggggctctagaaggaagaagtccttgagttattttatgtaaaagttgttcatattgtacattgatgtcttaaggaagttcttaaaaatgtgatctcctcaggctcaggtcaaggttttgggtcatatgggccatcagtaatgtaaaaaaagcccatttgaattgcaaggcccaagcatagcccaagttgtatatagcgggttgggtgaaaatgaaactctttttgtgtcattcttcttcggaactttttgtctgaacaaaaatggatgctctggactctgttttcgatccccttagagatttcgccaaagacagcgttaggcttgtgaagaggtgccacaagccagatcgcaaagaattcaccaaagttgctactcgtactgcgattggtttcgttgtgatgggattcgtaggatttttcgtcaaattgatcttcattcctatcaacaacatcatcgttggtgcttcttaatcgagggccgtgtgaaggagaaacttaatggagatatagaaggaatcaacgatgacagtcttcacaatattagtttaattttgtaacctctgtggctgttggatatttctgacatctttttcagaaccctctttgctggtttgaattgtagcattcaaatagcctttctcaccttccaccttctccctgcaccccttatattggaatcttgtacacttatcttccagatcaaagtacttatatcttagttttacttttctggtgctctttatacagaagttaatgtttctattagcattattattatttttcatattggaactgcttgaaaaaccca

SEQ ID NO: 779 - DNA, 707 bp, Triphysaria pusilla
  misc_feature (617)..(617): n is a, c, g, or t
ttaattttgagaggaaaaagcatggattctttagattcagttttcgatcctcttagagatttcgccaaggacagcgttcgccttgtcaagcgttgccacaagccggatcgtaaagagttcaccaaggtcgccactcgaactgcgatcgggtttgtcgtgatgggcttcgtcggatttttcgtgaagttgattttcatccccatcaacaatattatcgtcggcgctacctaaattttaggttagtattttactttttttttaatattttaatcgtatgatgacttatttatcattgtctgttgtaaagtgaattagttgatctaattaaatatgcaaattttcacacacacacacaaaatggaaacttaagttgctgagttgaaagaatatctgagatagcaattgcactatttatatgagtttttaagttatctgataatatagggtaagatttacttagattaaggccacagagaaatgtttcttcagagctcagtatttggttgatgattagatgggatgtattcatgtgtcaaattagctgtgtttgttcaaagaaagctgaactagtggtttcgtgttttaaagattattactcaacctcggttctataaaanatattttagtttcctttgttttaaagatgtttgttaaaacatctatgaatgaagtggacacctatatgttttatctactaatgaagttgt

SEQ ID NO: 780 - DNA, 530 bp, Juglans hindsii x Juglans regia
ttgtgttggtcccggggatcggccattacggccgggggttccttcatatttcagatctagtctttgcatctcttccatagtatccgagcgatggacgccgtagactcagtcgtcgatcccctcagagagttcgccaaggacagcgtccgcctcgtcaagcgctgtcacaagcctgatcgcaaagaattcacgaaggtggcgttccgtacggcgatcggtttcgttgtgatgggatttgtcggtttcttcgtgaagctgatcttcattcctatcaacaatatcatcgttggttcgggttaggccatttgaatcactgaattgatggaggtggaaggcagaccggtgcaatgcaacatcgtgtttagcatgtagcttccaattaggctccctttcgatattgtatgtcatactcgagtagacaatgatattttgactcttttgttttcttcttggttatttaaaaaaaaaaaaggaaccctttgttttcttcttgcaccgttcgtagcggatttgtttgcccctttttagac

SEQ ID NO: 781 - DNA, 724 bp, Triticum aestivum
gcagttcacgcttttctacagagaaaaagtttataaaagaagccatccatccgcgaaacccacccgcacaaatccaaacagcattcgcccgtcggcttccaccctccccctcacgcgcgcgacctcgtcgccgtcggctcggagatctcgcccgccggccatggacgccgtcgactccgtcgtggaccccctccgcgagttcgccaaggacagcgtccgcctcgtcaagcgctgccacaagcccgaccgcaaggagttcaccaaggtggcggcgcggacggcgatcgggttcgtcgtcatggggttcgtggggttcttcgtcaagctcatcttcatccccatcaacaacatcatcgtcggctccggctaggttggaggacgacatgatgcggggatagtgcgatgccggcggttgggcctgcggtgtgttgaattaggcgcccaaagttcgttctgaagttgttgttgaagacctgttttgtgagaaattgtcaccagcttcatcttcgtaatgagtatagaccttgaagtagcgagttataaagtttatgttttgtcataattccctgtggtgcaaggtagatcgctgatcgcaagtgctgattaccggtgatacgcgcaccactgccaactacttgggccacactcacacggttctgaaaatatagaaatatgaaaaacgtaagaatctagaaataagaatatactcactccaaaaaaaaaa

SEQ ID NO: 782 - DNA, 556 bp, Triticum aestivum
agccatccgcgaaacccacccgcacaaatccaaacagcattcgcccgtcggcatccccttccccttcccctcacgcgcgcgacctcgtcgtcgtcgtcgtctcggagatctcgccttcccgccggcagcagccatggacgccgtcgactccgtggtggaccccctccgcgagttcgccaaggacagcgtccgcctcgtcaagcgctgccacaagcccgaccgcaaggagttcaccaaggtggcggcgcggacggcgatcgggttcgtcgtcatggggttcgtcggcttcttcgtcaagctcatcttcatccccatcaacaacatcatcgtcggctccggctaggttggaggacgggatgacaggatgcggggatagtgtgatgccggcagttgagcctgcggtgtgtcgaagtaggcgcccaaagtttgttctgaagttgttgttaaagacctgatttgtgagaaattgtcaccagcttcatcctcgtaatgagtatagatcttgaaacagcgagccataaagtttatgttttgtcataattccctcgtggtgcaa

SEQ ID NO: 783 - DNA, 606 bp, Triticum aestivum
cacctccacattctgcctcccacctctccggcgagatctccctcctccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggggcggcaggactagaggatgttgtccattcatgggggcggcagctggtcttcctgtcctcataccgcaaaccaattcatttaggacttcattgtagaggacattttcccttgtgttttcatttgaaacagttgtacctggagcagttttgaacctgatactggctagaccgtaatatcaagtagccaatgataaatggatcatcaccagcgatattagatttattcgtcgctttgtttgtatgttgaagaacaaatacgatgagttcacactggcatgcttagatactgtgaagcagaagcaaaaaaaaaa

SEQ ID NO: 784 - DNA, 624 bp, Triticum aestivum
agacacgagcaaacgcacctccacattctgcctcccacctctccggcgagatctccctcctccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggtgcggcaggactagaggatgttgtccattcatgggggcggcaaaccaattcatttaggacttcattgtagaggacattttcccttgtgttttcatttgaaacagttgtacctggagcagttttgaacctgatactggctagactgtaatatcaagtagccaatgatactggctagaccctatcatttcctctctggagcattgtgctatgatgcctttactttcatcaagttctttgtgtaattgtccaaaaggtaatgacatgcactagcaaggtgcccgcgttagttgaattattacttgaaacattttaac

SEQ ID NO: 785 - DNA, 507 bp, Triticum aestivum
agccatccgcgaaacccacccgcacaaatccaaagcagcattcccccgtcggcttccaccttcccctcacgcgcgcgacctcgtcgtcgtcgccggctcggagatctcgcctcgcccgccggcagcagccatggacgccgtcgactccgtggtggaccccctccgcgagttcgccaaggacagcgtccgcctcgtcaagcgctgccacaagcccgaccgcaaggagttcaccaaggtggcggcgcggacggcgatcgggttcgtcgtcatggggttcgtggggttcttcgtcaagctcatcttcatccccatcaacaacatcatcgtcggctccggctaggttggaggacgacatgatgcggggatagtgcgatgccggcagttgagcctgcggtgtgtcgaagtaggcgcccaaagtttgttctggacttgttgttaaaggcctgttttgtgagaaattgtcatcagcttaatcttcgtaatgagtatagatcttgaagtagcgag

SEQ ID NO: 786 - DNA, 561 bp, Triticum aestivum
cggcacgagggtcgatccacatcgtcagacacgagcaaacccacctccaccttctgctcccacctctccggcgagatctccctcctccccgcgccgcagccagccatggacgccgtggactccgtggtcgacccgctccgggagttcgccaaggacagcgtccgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatttggtcctccgcaggtgaggggccacaggacgagaggatggtgtccattcatggaggcggcgctggttttcttatcctcgtaccttaaagcaattcatttaggacttcattgtagaggacagttcccttgtgttttcgtttgaaacagttgtattgctagacctggagcagttttgaacctgataccggctagaccgtaatatcaagcagtgaatgacaagaattgaaaccctatcatttcctct

SEQ ID NO: 787 - DNA, 566 bp, Triticum aestivum
acgagcaaacgcacctccaccttctgcctcccacctctccggcgagatctctctctccgccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggggccgcaggacgagaggatggtgtccattcatggaggcggcgctggttttcttatcctcgtaccttaaagcaattcatttaggacttcattgtagaggacagttcccttgtgttttcatttgaaacagttgtattggtagacctggagcagttttgaacctgattccggctagaccgtaatatcaagcagtgaatgacaagaattgaaaccctatcatttcctctcaggtgcagtttgctatgctgccttgaccttca

SEQ ID NO: 788 - DNA, 423 bp, Triticum aestivum
  misc_feature (283)..(283): n is a, c, g, or t
  misc_feature (288)..(288): n is a, c, g, or t
  misc_feature (365)..(365): n is a, c, g, or t
  misc_feature (406)..(406): n is a, c, g, or t
caaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttccgtccgtcatgggttccgtcggcttcttccgttaactcatcttcatccccatcaacaacacaccgtcggtcccggctaagcttacaggantacanggcgactagcatggggagtaatgcaatactttggggagcaatagataacgagattctggccttccgaatatatgttnatgaattttccgtccgtgtgttcccgatgtaaccttgtacngattaacttccgggaac

SEQ ID NO: 789 - DNA, 456 bp, Triticum aestivum
  misc_feature (216)..(216): n is a, c, g, or t
  misc_feature (323)..(323): n is a, c, g, or t
  misc_feature (350)..(350): n is a, c, g, or t
  misc_feature (362)..(362): n is a, c, g, or t
  misc_feature (380)..(380): n is a, c, g, or t
  misc_feature (390)..(390): n is a, c, g, or t
  misc_feature (407)..(407): n is a, c, g, or t
  misc_feature (425)..(425): n is a, c, g, or t
gtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttccgtcgtcatgggattcgtcggttctttgtcaantcatcttcatccctatcaacaacatcatccgtcggtccggtgatccgtaaacctcaagctaatgggctgcaggagtgggacaatgggctcactaccttgggaggcanaccttttcaactctgattcccgcaaanattccttttaangcttgtgttgttaaaggnaatcccttanctttcctctccttgagncctgtggtaatttgggancctttgtacctggggtccaatatctttgtgg

SEQ ID NO: 790 - DNA, 488 bp, Triticum aestivum
  misc_feature (440)..(440): n is a, c, g, or t
  misc_feature (453)..(453): n is a, c, g, or t
cttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctgggtctttcgaatagtattgttaatgaaatttttcgttcggttgtgtttctgatgtaatcgttgtactgagtagaccttctggataccggattctgagtagactttgaatccctgaaggatnagccaatctcggnaaggaatttcgtattttgttgttccgttaagcgtt

SEQ ID NO: 791 - DNA, 487 bp, Triticum aestivum
acaaatcccaagcagcattaccccgtcgggttccaccttccccttacgcgggggaccttgtttttgttcccggctcggagattttgccttgcccgccggcaacaaccatggaagccgtcgactccgtggtggaccccctccgcgagtttcccaaggacagcgtcccccttgtcaagcggttccacaagcccggccccaaggagttcaccaaggtggcggcgcggacggcgatcgggtttgtcgtcatggggatcctggggggtttcgtcaagctcattttcatccccatcaacaaaattattgtcggctccggctaggttggaggacgacatgatgcggggatagtgcgatcccggcagttgagccttcggtgtgtcgaagtaggcgcccaaagttttttttggacttgttgttaaagccctcttttgtgagaaattgtcatcagcttaatcttcgtaaaaagaaaagaaaattcctaaaggccttc

SEQ ID NO: 792 - DNA, 1329 bp, Brachypodium distachyon
gatgaggcccgcggcggctgcggccgcgtccgtgctgcacgcgccgcggcgcgcgctcggtggggcggcttccatggtcgccgcccgctgcggcgcctccccttcggtcgccgccgccgccaccgcttacggtgaggagaccgcggtgtttcatcatgtgtcgtttgtcaaggaaatcgccgcaactgatccaccggagcatcttaactctttactgagcgtgcttcaagcacgaggcgaaaagatagtttctcctggagctaaaagaggtctgatcccacttgttgttcccttgtcagaaagcccagaaggtaatttaacatccctgctgagatggccaactgctccgagggggatggaaatgcctgtagtggaagttcgtaatcatgggctatggcttttggctaagaatgtcaaccaatatattcacagaatacttgtcgaggcagatgctagtgctgagaatggtgatgatttatggtctgccgtaggggaagctggtataaacctttacaaaaaaggtgatttcaaagaggcgcagctggcagatcttgatgtttatttattgaagaaggttggactcttcccggatatcatagagaggaaagcatcacgccatctagaaataggagatcaggtgtcagctcttattactggagaattctacaccagagatcaatttcctggatttggaagaccctttgtgttcaactcacacattttaaaaagagttggacgtacatctgaagccaaagagtcagctcgagtggctttgaagtcgccatggtggtcactaggctgtagatatgaagaggcggctgaattagcggggtgggaggatgagcaaatcgagtttataagagaaaaggtaaccgaggagggcaagcgtgacgatctgaagaaagggaaggctccagagcaggtggttcttgatgaggcggcatttctaatggatttggccaccgtggatggtaattgggacgacgtggtggaccggatcgctgaatgttatagagaagctgggatccacgacattgcaaagttcatcgcttacagagaataagaatatgtccctcttgagaaatttagagactggttgcacacagatctttggtttagagttagcttttgtaagtgagaaataattgcggcctgttaatcttctgtgcgtttgcatcgcataagtgaaaatgatgtcactgattcctccaggatgctgcacctctattttattttatttgaatttcatttttctcgtctatgcatgaattcgctgaaagtattaacattcataatcaatgcggagtatgtcatgcttttgagtattat

SEQ ID NO: 793 - DNA, 1367 bp, Zea mays
gcccacggctgagactcaggtgaggtccgccgcgtccccccgctgccacaacccacaaccactacctgagtacctgaccaccaccggataggatgaagccgccggtgagcagggccgccttcgcgtccgtgctgatagggccgcgcacgctcggggcctctctggtggccgcccgctgcgcctcctcctctgccgccgctgccgtcactgcctatgatcatgcatcgtttgtcaaggaaatcgccgcaaccgatcctccagagcatctcaactctctcctcaatgtgcttcaagcacgaggtgaaaagattgtttctcctggagcaaaaagagggttgattccatgtgttgttcccttatcagaaagtccagcaggtgatttgacatctctccttagatggccaaccgctccaactgggatggaaatgcctgttgtggaagttcgtaaacatgggctgtggcttttggctaaaaatgtgaaacagtatatccacagaatacttgttgaggctgacttcagtgctggaactggtgatgatttatgggctgctgtgggcgaagctggtaaaaacctttacgctaaaggcgaattcaaagagtcgcaggtggcagaccttgatgtctatttgttgaagaaggttggacttttccctgatgttatagagaggaaaacattgcgccatctcgaaaaaggagataatgtctcagctctcattactggagaattctatactagagatcaatttccaggatttggaagaccctttgtgttcaatgcagagatttttaaaagagttggacgtacatctgaagccaaagattcagctcgagtggctctgaaatcaccatggtggacacttggctgcagttacgaagaggctgctgaactagctgggtgggaggatgagcagctagagtttataagagagaaggtaactgaggagggtaagcgcgaggacctgaagagaggaaaggctccagaacaggtgattcttgacgaggcggcattcttaatggatttagcgtccgtggatggtaactgggacgaggttgtggatcggattgctgaatgttacagagaggctgggcttcatgacattgcgaatttcattgcctacagggaatagatgttagattccctatggtctagaatgttattcaagaaattttgattcatttgtgctctgctaatatatattcttatatacgggaagaacgcacaaccgttatatcgcagcagtccttttttgttttgttttgacatcagctagtgaccatagtttctttcctgtatagctctgaatgtacttgttttttccatttaaatttccatgcttattcatggttagtaagtgtcagattgagtg

SEQ ID NO: 794 - DNA, 1406 bp, Sorghum bicolor
ctgcggtgcggagtccacactccacaggaaaggccaacaacggctggctcaggtgaggtcgccgctgccaccaccaccaccaccggatcgagaccgacgccgcgcccgcgcggataggatgaggccgccggtgagcagggccgccttcgcgtccgtgctcatggggccgcgcgcgctcggggcgtctcttgtcgccgcccgctgtgccgcctcctcccctgccgccgcagccaccgctgccgtcactgcctacgatcatgcatcgtttgtcaatgaaatcgccgtaaccagtcctccggagcatctcaactctctcctgaatgtgcttcaagcacgaggtgaaaagattgtttctcctggagcaaaaagagggttgattccatgtgttgttcccttgtcagaaagtccagcaggtaatttgacatcactccttagatggccaaccgctccaactgggatggaaatgcctgttgtggaagttcgtaaacatgggttgtggcttttggctaagaatgtgaaacagtatatccatagaatacttgttgaggctgacatcaatgctgatactggtgatgatttatggactgccgtgggtgaagctggtaacctttatgctaaaggtgacttcaaagagtcacagctgccagaccttgatgtctatttgttgaagaaggttggacttttccctgatgttatagagaggaaaacattgcgccatctcgaaaaaggagataacgtctcggctctcattactggagaattctatagtagagatcaatttcctggatttggaagaccttttgtgttcaatgcagagatcttaaaaagagttggacgtacatctgaagccaaagattcagctcgagtggctctgaaatcaccatggtggacacttggctgcagttacgaagaggctgctgaactagctgggtgggaggatgagcagctcgagtttataagagagaaggtaactgaggagggtaagcgtgaggatctgaagaaaggaaaggctccagaacaggtggttcttgacgaggcggcattcttaatggatttagcgtctgtggatggtaactgggatgaggtcgtggatcggattgctgagtgttacagagaagctgggcttcatgacattgcaaatttcattgcctacagggaatagatgttagattccctatggtctacaatgttgttcaagaaattttggttctttcatgctctgatatttattcttatataagagaagaagacccaatgcctacattacagcagtccttttttttctcttgtcagttagtgatcagcaccataatttcatgcctgtatagctctgaatgtacttttgccatttaaattttcatgcttattcaggattaatatgtgcctagagcgcatttttatcttct

SEQ ID NO: 795 - DNA, 1208 bp, Panicum virgatum
  misc_feature (210)..(210): n is a, c, g, or t
  misc_feature (214)..(214): n is a, c, g, or t
  misc_feature (226)..(226): n is a, c, g, or t
  misc_feature (290)..(290): n is a, c, g, or t
  misc_feature (295)..(295): n is a, c, g, or t
  misc_feature (323)..(324): n is a, c, g, or t
  misc_feature (330)..(331): n is a, c, g, or t
  misc_feature (333)..(333): n is a, c, g, or t
gatgaggccaccggtgagcagggcggccttcgcgtccgtcctcttcggccgccgcgcttctccggtcgccgcccgctgcgcctcctcctcggccgcctcccctgccgccgccgccgccgttactgctgcctaccaccatgcatcctttgttaaggaaattgccgcaaccgatccaccggagcatctcgactctctcttgaacgtgcttcnggcncgaggtgaaaanattgtttctcctggagcaaaaacaggcttgattccggtggttgttcctttatcagaaagtccancaggnaatttaacatccctgcttagatggccanntgcccnncnggatggagatgcctgtagtggaagttcgtaagcatgggttgtggcttttggctaagaatgtgaaacaatatattcacagaatacttgttgaggctgacatcaatggtaatgctggtgacgatgtatgggctgctgtgggcgaagctggtgaaaacctttacactaaaggtgacttcaaagggtcacaactggcggatcttgatgtctatttgttgaagaaggttggacttttccccgatgttatagagaggaaaacattacgccatctagagaaaggagataatgtctcagctcttatcactggagaattctacagtagagatcaatttcctggatttggaagaccctttgtgttcaatgcagagattttaaagagagtcgggcggacatctgaagccaaagattcagctcgttcagctttgaagtcaccatggtggacactaggctgcagttacgaagaggctgctgaattagctgggtgggaggatgagcagatcgagtttataagagagaagataaccgaggagggaaagcgtgaggatctgaagaaagggaaagctccagaacaggtggttcttgacgaggcagcatttctaatggatttagcatatgtggatggtaactgggatgatgtggtggatcggattgctgagtgttacagagaagctgggcttggtgacattgcaaagttcattgcctacagggaatagatgttagattccctatgctttgcaattttatttaacaaattttgggtccttttcgtgctcttactccttattcataagagaaaatcttccaacatgttgaatttagaaatactcatccatgagctaatgcctgtgttgtcatttaatgattggcaccataataga

SEQ ID NO: 796 - DNA, 1698 bp, Aquilegia formosa
ctacgcgtttaccttttttttcttttattttatttccaacacatatagctctctctttctttcttttctctctctgtctttctctctgtgtttacttcgcagaagagattcagaagattcagagaagagaagaagagaagcttttcttcttattattacattattattattattcttttcttccctcttcgtcattacttcgaaaccctaacaacaacatcaaattctctcagatccattacaattctctctaattggtttaaatttcgagatctcttcacttcaattcttcaataaaaccctaaccctagcagatctatagaaattgtatctaatattattatttatatttaagatttgaaagagagagaaaaattgagattgaaagaatgaagagtacgggtagatttttcacaattggtttagtttcagcttggtattcatcaaatattggggttttgttgttaaacaagtatttattaagtaattatggattcaaatacccgatctttcttactatgtgtcatatgactgcttgttctttgtttagctacattgctattgcttggatgaagatggttcctatgcaaaccatccgatctcgtgttcaatttttcaaaattagtgcacttagtcttatattttgtgcatctgttgttagcggcaatgtttcccttcgatatctaccagtttcgtttaatcaggctgttggtgcaactacacctttctttactgctgtgtttgcttatattatgaccgtcaaaagagaagcttggctcacttatatcaccttgattcctgtggttactggtgttgtcattgccagtgggggtgaacctagtttccatctatttgggtttataatgtgtgttggtgctactgctgcaagggctctcaagtcagtgcttcaggggattctattgtcttcagaaggggaaaagcttaattccatgaatcttcttctctacatggctccaatagcagtagtatttcttcttccagcaacacttataatggaagaaaatgttgttggaatcacactagcacttgcaagggaggatttcaagatcatctggtacctgcttttcaattctgcgctggcgtacttcgtgaatttgacaaacttcttggtcaccaaacacaccagtgctttaactctgcaggtccttggaaatgctaaaggagctgttgcagtggttgtttctatttcaatattcagaaatcctgtctcagtgactgggatgttaggttacactctcacggtcattggcgtgatcctctacagtgaagccaagaaaaggagcagcaaatgaggattttccttcaaacatcacgcaagcatgtttttcttctattttgttttgtttcttcgcatgggtggcagcaagcttctcagagccaggattggaagacatgcttgtggcttgtgccatcgaaattcttttttatggaaatcaagaacagaaggtttccacatgtattaacaaccagcgtagaggatatagaaattttaataaaaagtctgattggacacttttccgtatgtattgggtctgcagaaatattctaccattcttttgaatatcagtccctacccaattagttctttagtttgttatctttattaatactggaaagattctataggatgattctaccattaattgacccttgtgatcagacttctccaagttgtaa

SEQ ID NO: 797 - DNA, 1594 bp, arabidopsis lyrata
aaaaattagtaacatttttttaaaaagagagagagagagcttaagccaaagatctctcattgacctttgcttcttcatcttcttcttcttctccgatcacagtttctggattccaccattcttctcttgttatcttcgtgacctaatctcgattcgatccatggaataatctctgtccgaagaagatctctcattcccccaaaagcagacagatccgaaactttcccccaaaattcgtggagtttttgtgttagggtttggattttcctcaaattgaatcgatcagatcggcttgtaaagatgaagatagcggccaatggccggtttttcacaatcggactcgtcgcgtcatggtactcatcgaatatcggagttttgttgctgaacaagtacttgttaagcaactatggattcaaatatccgatcttcctcaccatgtgtcacatgacggcttgttctcttctcagctacgtcgccattgcgtggatgaagatggttccgatgcaaacgatccgatctcgagttcagtttcttaagatcgctgcgttaagtctcgttttctgtgtgtcggtggtttttgggaatatttcgcttcggtttcttcctgtatcgtttaatcaagcgatcggtgctacgacgccgtttttcaccgccgtgtttgcttatctgataacgttcaagagagaagcttggttgacttacttcactctcgtccctgttgttaccggtgttgtcattgccagtgggggtgaaccaagtttccacctgtttggattcattatgtgcattgcagccacagctgcaagagcacttaaatcagttcttcaaggaattttgctatcttcagaaggggagaagctaaattccatgaacctcctcctttacatggctcccatagctgttgtgttcctccttcctgctacccttatcatggaaaaaaatgttgttggcattacaattgcgcttgccagagacgattttagaatcgtttggtatctgctattcaattcagcactagcttatttcgtgaacttgaccaatttcttagtcacgaaacacaccagcgctctaactctccaggtgctaggaaacgccaaaggtgcagtagcagtggtggtatccatcctgatattcaggaatcctgtctcagtgactggaatgttaggttactctctcactgtctgtggagttatcctctacagcgaagccaagaaacgaagcaaatgaaagaagcattcattatatttgttcagtccctcaggtaaacaaacacaggcaagtttcctccactgtgaactaaaaaaccttacacagcatctttggaccaaaagcaaaggatgtgtgaaagcaacaccaaaggatcagagtaccaaaagtaatcatttagaggacttcacaaataagtgatttttttccccttcttttgttccattttttgttaatcggattctctactgctttcgtcgtaggttgttctaagagtaacttcgatttagcttcttcttttttgtcgattctttacatctagttttgtgatatcaacatttacaacagtgattaattaatggaaaaggacaaagcgttttttgttttc

SEQ ID NO: 798 - DNA, 1630 bp, arabidopsis lyrata
agagaggtgttgttgcagctttagcccaaagatctctcctttttgcagagcttcttcttcttctttctctttcccagtttcttcgtctccatcattttcgcgtgttgtaacctaatccaatcttacccatcgatggaataacatcatcaggacgcgccaaattctgtgtcggaggaccgagagatctccatctcctgtccagattcgattcccaccaatcccaatttcttgaaattcgctagggttttagattaaatctcatcagtcatcagatcgagtcgacacaggaagaagaaagcgatgaagatggcgacgaatggccggtttttcacaatcgggctagtgacgtcatggtactcatcgaacattggagtattgttgctgaacaagtacttgcttagcaattacggattcaagtacccgatctttctcaccatgtgtcacatgacggcttgttcgttactcagctacgtcgccattgcttggttaaagatggttccgatgcagacgattcgatcccgagttcagttctttaagatctcagctctaagtctcgttttttgtgtgtcggtggtctttggtaacatctctcttcgctttcttcctgtttcgtttaaccaagccattggtgctacgacgccgtttttcaccgctgtgtttgcttatctgatgacgcttaagaaagaggcttggttgacttacttcactctcgtccctgtcgtcaccggagttgttattgccagtgggggtgagccaagctttcacctgtttggattccttatgtgcattgcagccacagctgcgagagcacttaaatctgtgcttcaaggaattttgctttcttctgaaggggaaaagctgaactccatgaatctcctcctttacatggctccaatagctgtcgtgttccttctgcctgctactcttatcatggagaaaaatgttgtcggcattacaattgctcttgcaagagatgatttcagaatcgtttggtatcttcttttcaattcagcgctcgcctatttcgtcaacttgacaaatttcttagtcacgaaacacactagcgccctgactttacaggtgctaggaaacgccaaaggagcagtagcggtggtggtctctattctaatcttcaagaacccggtttcagtgaccggaatgctgggttactccctcaccgtctgtggagttatcctctacagcgaagccaagaaacgaagcaaatgagaacaccgaacacataccaagcttcttcttcttcttcctccctatatatatgttttatattttctcccttatggatacacaggcaagtagtctcttttgctgttaccataactgactcttgtcttaatgaaaagctgggccaaaagcatggaattttttggcagaaacacgagaagcaaagccacacaaagattgattaccaaaggcaagaatttagagaacttcctcctatgaataagtaacctttttttgattttgttctttctcggattctcttgcctttcctgctaggttgtttgttaaaatagcttttgtttcttcgattctttacattttagttttgtgatgtcaacatttacaacaacaccgattgattaattaatcgaaagagagaaagttcctt

SEQ ID NO: 799 - DNA, 1615 bp, Arabidopsis thaliana
gaactgaataaaaattagtaacatttttaaaaagagagagcttaagccaaagatctctcattgacctttgcttcttcatcttcttctccgatcacagtttctctctttctggattccaccattcttctctttgtcgtctatgtgacctattctcgattcgatccatggaataatctctgtccgaagaagatctctcattccccttcaaaagcagacagattcgaaactttcccccaaattcgtggaaattttgtgttagggtttgggttattctcaaatagaatcaatcagatcgtttttttttttgttagaagaagatgaagatagcggccaatggccggtttttcacaatcggactcgtagcgtcatggtattcatcgaacatcggagttttattgctgaacaagtacttgttaagcaactatggattcaagtatccgatcttcctcaccatgtgtcacatgacggcttgttctcttctcagctacgttgctattgcttggatgaagatggttccgatgcaaacgatccgatctcgagttcagtttcttaagatcgctgcgttaagtctcgttttctgtgtgtcggtggtttttgggaatatctctcttcggtttcttcctgtatcgtttaatcaagcgattggtgctacgacgccgtttttcaccgccgtgtttgcttatctgattacttttaagagagaagcttggttgacttacttcactctcgtccctgttgttaccggtgttgtcattgccagtgggagtgagccaagtttccacctgtttggattcattatgtgcattgcagctacagctgcaagagcacttaaatcagttcttcaaggaattttgctttcttcagaaggggagaagctaaattccatgaacctcctcctttacatggctcccatagctgttgtgttcctccttcctgctacacttatcatggaaaaaaatgttgttggcattacaattgcacttgccagagacgattttagaatcgtttggtatctgctattcaattcggcgctagcttattttgtgaacttgaccaatttcttagtcacgaaacacaccagcgctctgactctccaggtgctaggaaacgccaaaggtgcagtagcagtggtggtatcaatcctgatattcaggaatcctgtctcagtgactggaatgttaggttactcgctcactgtctgtggagttatcctctacagcgaagccaagaaacgaagcaaataaaaaagaagcattcgttatatttgttcagtccctcaggtaaacaaacacaggcaagtttcctccactgtgaactgaaaaaccttacacagcatctttggaccaaaagcaaaggatgcgtgaaagcaataccaaaggatgagagtaccaaaagtaatcatttagaggacttcacaaataagtgattttttttcccttcttttgttccttttttgttaatcggatcctctactgctttcgtcgtaggttgttctaagagtaacttcgatttagcttcttctttttgttgtcgattctttacatctagttttgtgatatcaaacatttacaacactgattaattaatggaagaggacaaagctttttttcttttc

SEQ ID NO: 800 - DNA, 1698 bp, Arabidopsis thaliana
aataaattagttaaaaaaggaaagagaagtgttgttgcagctttagcccaaagatctctcctttttgcagagcttcttcttcttcttctccaaaaatcccaactttcttctctttcccggtttcttcgtctccagcattttcgcgtgttgtaacctaatccaaatcttacccattgatggaataacatcatcacgacgcgtcaaaattctgtatcggaggaccgagagatctccatctcctgtccagattcgattcccaccaatcccaatttcgtgaaattcgttagggttttagtttgaatctcatctcatcagatcgagtcgacccaggattaggaagaagaaaagcgatgaagatggcgacgaatggccggtttttcacaatcgggctagtcgcgtcttggtactcatcgaacattggtgtattgttgctgaacaagtacttgcttagcaattacggattcaagtacccgatctttctcaccatgtgtcacatgacggcttgttcgttactcagctacgtcgccattgcttggttgaagatggttccgatgcagacgattcgatccagagttcagttctttaagatcgcagctctaagtctcgttttttgtgtgtcggtggtctttggtaacatctctctccgctttcttcctgtttcgtttaaccaagccattggtgctacgacgccgtttttcaccgccgtgtttgcttacctgatgacgcgtaagaaagaggcttggttgacttacttcactctcgtccctgtcgtcaccggagttgttattgctagtgggggtgagccaagctttcacctgtttggattccttatgtgcattgcagcaacagctgcgagagcacttaaatcagtgcttcaaggaattttgctttcttctgaaggggaaaagctgaactccatgaatctcctcctttacatggctccaatagctgtcgtgctccttctgcctgctactcttatcatggagaaaaatgttgtcggcattacaattgcacttgcaagagatgatttcagaatcgtttggtatcttctattcaattcagcgctcgcctatttagtcaacttgacaaatttcttagtcacaaaccacactagcgccctgactttacaggtgctaggaaacgccaaaggagcagtagcagtggtggtctctattctaatcttcaagaatccggtgtcagtgaccggaatgctgggttactccctcaccgtctgtggagttatcctgtacagcgaagccaagaaacgaaacaaaaattagaacactaaacacacacaaagcttttacttcttcttcatcattcccccctatatatatgttttatattttctcccctatggatatacaggcaagtagtctcttttgctgggccaaactgactcttgtcttaatgaaaagctgggccaaaaacatctcttttttttggcagaaacagagaagcaaagccacacaaagattgattaccaaaggcaagaatttagagaacttcctcctatgaataagtaacctttttgtttttcatttttgttctttcttctcggattctcttgcctttcctctgtaggttgtttgttgaattaggtttgtttcttcgattctttacattttagttttgtgatgtcaacattttacaacaacacggattgattcatttaatcgaaagagagaaagttccttc

SEQ ID NO: 801 - DNA, 1233 bp, Artemisia annua
  misc_feature (64)..(64): n is a, c, g, or t
  misc_feature (84)..(84): n is a, c, g, or t
  misc_feature (150)..(150): n is a, c, g, or t
  misc_feature (243)..(243): n is a, c, g, or t
  misc_feature (300)..(300): n is a, c, g, or t
  misc_feature (309)..(309): n is a, c, g, or t
  misc_feature (372)..(372): n is a, c, g, or t
  misc_feature (804)..(804): n is a, c, g, or t
  misc_feature (989)..(989): n is a, c, g, or t
cccacatcaaggctattcacaataggcctagtgacgtcatggtactcatcaaacataggtgtcntgttactaaacaaatatctnctaagtaactatggtttcaaatacccaatattcttaactatgtgtcacatgacagcttgtgcattnttaagctatataggtattgcttggttgaaaatggtacctatgcagacaattagatcacgtgttcagtttatgaaaataagtgcgttgagtgcnatattttgtgctagtgttgttagtgggaatgtttctttaaggtatttgcctgtgtcntttaatcangctattggggctactacgcctttttttactgcggtttttgcgtatttgatgactttgaagaangaggcttggcttgtttatcttactttggttcctgttgttactggtgttgttattgctagtgggggtgagcctagctttcatctcttcgggtttataatgtgcattggtgctactgctgcaagagctctaaaaacagttgttcaggggatattgctttcttctgagggggagaagttgaactcgatgaatctccttctctacatggctcctattgctgttgtacttctgcttcctgcaacactttacatggaagaaaatgttgttggcattacgatagcacttgctagacaagattttgggattgtttggttgttgcttttcaactctgcacgtgcatatttcgtgaacttaaccaacttcttggtcacgaagcacaccagcgctcttacacttcaggtgctaggaaatgcaaagggtgcggtagcagtggtngtttcaatactaatatttagaaatcctgtttccgtgactgggatggctggatacacactcaccgtcatcggggttattctttatagtgaagcaaagaagcgtagcaacaaatgatcattattataacttaattaagcttagaagctaatttgttcttttgaggaattccagagtttgtattcgcngctgctactcggtcttatgtcttaccctctagattcattttgttaatttctgctctgggcttggggacagtgaagcttcacatgagtaacagcaatatggaaaattaaaaataagccattagtttcatatatgttttaaggctcatagtaaaggattgtagagattatttaaatcccctttccaaatatgtcatatttaaacttcttatagagattatttattcaggactatggtcatttttcc

SEQ ID NO: 802 - DNA, 1572 bp, Brachypodium distachyon
tcccataaacacaagctcacacgcctctgctccgagcccaaacccaccaccaattcaaccgcgacccagcccaacccccctccattcccaccaccggccacctccccctccctcagatccgcccccgctcgcggccgcgaccagccgcgatgacggcgaagggcggcgcctcgccgtcgccgggcggcgcgggagctgcggccaacgggcggttcttcacggtggggctcgtcaccgcctggtactcctccaacatcggcgtgctcctgctcaacaagtacctcctcagcaactacggcttcaagtacccaatcttcctcaccatgtgccacatgtccgcctgcgcgctcctctcctacgccgccatcgcctggctccgcatcgtgcccatgcagctcgtgcgctcgcgcgtccagctcgccaagatctccgcgctcagcctcgtcttctgcggctccgtcgtgtccggcaacgtctcgctccggtacctgcccgtgtccttcaaccaggccgtcggcgccaccaccccgttcttcaccgccgtattcgcctacatcatgaccgtcaagcgcgagtcgtggatcacgtacctcaccctcgtcccagtcgtcaccggcgttgtcatcgccagcggcggcgagcctagctttcatctgtttggattcatcatgtgcattggagccactgctgcaagggcactgaagacagttttgcaaggaatccttctgtcatcagagggggagaagcttaactctatgaatctgctcttgtacatggctccaattgctgttattctcttacttcctgctactctctttatggaggataatgttgttggcgttacaatcgaactggccaaaaaggatttcaccattgtttggttgctgttgttcaactcttgcttggcatattttgtcaatttgaccaatttcttggtgaccaaacatactagtgcattgactctacaggtccttgggaatgcaaaaggtgctgtggcagttgtcgtctcaattctgatattcaagaatcctgtatctgtaaccggaatgctcggttacactctcacagttataggtgttattctttacagtgaatccaaaaagcgtagcaaaccctgagcgcgccccagaaaaccgtacatatggccgtcctttgtcagtccagtcggtgcccagagcttatatatgatggggaactacgtcgggcgattgcaacagatcctgcgctgtttggaaccttattggatagcaaggacagagaagtccaataatacatgtagttttcccttggatctgagaggcattttgtttaactaatggagatgatcaatagaatataattttttgtgtttagagaattgtgggttgtggctcacattgccagcattggttaatacgtttagttcttggaaattgttttccgttattcatcggtcattgtaagttcatgaccctccaattctctttcttctgaagattgcctgtactgtaccaaactttcctccggagcctcctaatatattatgacactgaatttagtcacgcacatttcttttttgtgacttagtcacac

SEQ ID NO: 803 - DNA, 1451 bp, Brassica napus
  misc_feature (124)..(124): n is a, c, g, or t
  misc_feature (211)..(211): n is a, c, g, or t
  misc_feature (631)..(631): n is a, c, g, or t
tcgacctaattaataatcgaatcgatcagattcggtcggtttcaaaaggatgaagatggcggcgaacggcaggttcttcacaatcgggctcgtggcgtcgtggtactcgtcgaacatcggagtnctgctgctgaacaagtacctgctgagcaactacgggttcaagtacccgatcttcctcaccatgtgccacatgacggcgtgctcgctnctcagctacgtggccatcgcgtggatgaagatggtccctatgcagacggtccgatcccgcgtccagttcctcaagatcgcggcgctgagcctcgttttctgcgtgtcggtggtgttcgggaacatctccctccggttccttccggtctcgtttaaccaggcgatcggcgccacgacgccgtttttcacggccgtgtttgcgtatttgataacgcttaagagggaggcttggttgacttatgtcacgctcgtccctgttgttaccggtgttgtcattgccagtgggggtgaaccaagtttccacctctttggattcattatgtgcattgcagccacagctgcgagagcgcttaaatcagttctccaagggattttgctatcttcagaaggggagaagctaaactccatgaatctcctcctntacatggctcccatagctgttgtgttccttcttcctgctacccttatcatggagaagaacgttgttggcatcacaattgcactcgccagagacgatttcagaatcgtttggtatctgctattcaattcggcgcttgcttatttcgtgaacttgactaacttcttagtcacaaaacacaccagcgctctgactctccaggtgctaggaaacgccaaaggagcagtagcagtggtggtatcgattttaatattcaagaatcctgtctcagtgactggaatgttaggctactcgctaacggtcattggagttatcctctacagtgaagccaagaaacgaagcaaatgaagttaaagaaacctcttcaatttttatttgttaggtccttgcaggtaaaacacacaaggcaaagttccttttgctggaccagaagcaaaaggatgtgtaaaggcaacaccaaaggatcagagtacccataagcaataagtggttttgtttccttctttaatttttgtttacgaatcttctacagcttttgtcataggttgttctaagagtaacttcgatgtagcttcctttttttttggtcgattctttacatcttttgtgatacaacatttataacactgattaattaatggaaaagacaagtttttttttttctttcatctgtctgttaatccaacttgtgttctgtagttccactatgatttggtaaactctgtaaggcttggaactgaatttgatttctaaacagcaatgtacactgctctgtcttaatgtagtaaggggctttggaaacgcccgcgtactctgcgttgat

SEQ ID NO: 804 - DNA, 959 bp, Manihot esculenta
acataatccacgccggctgttattgaccaaaatccaccatgaagaccccatcccggttgttcacgatcggtctagtgtcctcctggtactcctcgaatatcggggttctgttactgaacaagtacttgctaagcaattacgggttcaagtacccgatcttccttaccatgtgtcatatgactgcttgtagtttgcttagctatatcgccattgcatggatgaagatggtacctatgcagacaattcgctctcgccttcaattcttcaagatcgctgccttgagtctcgtcttctgtgtatccgttgtgtttggtaacatttctttgaggttccttcccgtttctttcaatcaggctgttggtgctacgacaccgttttttactgctgttttcgcttatttgatgacccttaagagggaagcttggcttacttatgtcaccttgattcccgtcgttactggagtaattattgccagtgggggtgaaccaagttttcatctatttgggtttataatgtgcatttctgctacggctgcaagggcactcaaatcagtgttgcaagggattttgctctcttctgagggggagaagctgaattctatgaacctccttctatatatggctcctatagctgttgtctttttactcccagcaactcttattatggaaaaaaatgtggttggtattacactggcccttgccagagacgatgtcaagattgtctggtacctgctattcaactcagcgctagcatattttgtaaatttgaccaattttttggtcacaaaacacaccagtgctctgacattgcaggttctaggaaatgcaaaaggggctgtggctgttgtggtttctattttaattttcagaaatccagtttccgttaccggaatgcttggttacacgcttacagtctttggagtcatcctatacagtgaagccaagaaacggagcaaatga

SEQ ID NO: 805 - DNA, 1374 bp, Ricinus communis
aaaagtcatcacaaacccagatctcaatcccacccaaacaaagaaaaaaagaaacacaatgaaacccacatcacgtttcttcacaataggtttagtaacatcatggtactcctcaaatataggcgtattgttactgaacaagtacttattgagcaattatggatttaaatatccaatctttttaactatgtgtcatatgactgcttgtagtttattaagttatgttgctattgcttggatgaaaatggttcctatgcaaactattcgttctcgtcttcaatttttaaagatctctgctttaagtctagttttttgtgtctctgttgtttttggtaatatttctttacggtttcttcctgtttcttttaatcaagctattggtgctacgacaccgtttttcactgctgtttttgcttatttgatgacctttaagagagaggcttggcttacttatgttaccttggttcctgttgttactggagttatcattgccagtgggggtgaaccaagctttcatctatttgggttcattatgtgtattgctgctacagctgcaagggcattgaaatcagtgctgcaagggattttactttcttctgagggggagaagctgaattctatgaacctcctcctatacatggctcccatagctgttgtgtttttactccctgcaactcttattatggaagataatgtggttggtattacactggctcttgcaagagataatatcaagattatctggtacttattattcaactcagcactggcgtattttgtgaatttgaccaatttcttggtcacaaaacacacaagtgctttgactctacaggttctagggaatgcaaaaggagctgtggctgttgttgtttcaattttaattttcagaaatccagtatctgttactggaatgcttggttactcgctcacagtcatgggagtgatcctttacagtgaagcaaagaaaagaagcaaatgattcttcattgtctgaaaacatcaatctatacatttcacatattttgtttccattggtgcctgagaacagcagcaaactttcttggggagcaagcttgggtggtgaatagcgccacggattgtgccctctgaatcctatatatatatttttttgttagcttacatggaagctgggactccatttgtatcagcaacaagtgcaggattagcaagaagtagaaaactcaaaataagtgactgatttatctctattattcccagctaggggttgtcgaggaatatcattttatcctttttattctttcaggaaaaatctttgtagaattgggtctctacagaatcagtttgttattgacattcgccatattgattaattaatgaaaaaacgaaatacct

SEQ ID NO: 806 - DNA, 1506 bp, Centaurea maculosa
  misc_feature (1459)..(1459): n is a, c, g, or t
cgggggcgccttcttcttcacccccatttccatccccaaatctccatcaaaattgacttccaattccacaaaattccaccaaattcatctcagatccaccacttttctccctataaaccctcccaatttctctccaatcccccaatttcaaatccaaaaccctaattccacatgttaaacccatcatcaaacaaatccacaaaccctagatagcacaaaaaaaggaagagatttatcaatgaaaggaggaggcacgggccagtggtttacgatcgggctcgtgtcgtcatggtacgcatccaacattggagtgcttctgctgaacaaatacttgctaagcaactatggattcaagtacccgatcttcctcaccatgtgtcatatgacggcttgttctttgcttagttacattgcgatcgtttggatgaagatggtgcctttgcagatggttaggtctcgggctcagtttctgaagatctcggtgcttagtttggtgttttgtgcgtcggtggtgagcgggaatgtgtcgttgcggtatcttccggtttcgtttacgcaggcggttggagctacgacgccgttctttacggcggtgtttgcgtatgttatgacggtgaagagggaggcttggttgacgtatctcacgcttttgccggttgtcaccggtgttgttattgccagtgggggggaaccaagtttccatctgtttggttttatcatgtgtatcggtgctacagctgcaagagcgttaaagtcagtgcttcaagggattttactgtcctcagaaggggaaaaactgaattccatgaaccttttgctgtacatggcaccagtagcggttgtgatattgcttccagcaacattgtttatggaagagaatgtggtcggcatcaccattgctcttgcacgaaaagatgtcaacattgtttggtatctgctgttcaattccggtatggcttattgcgtaaacttgacgaatttcttggtaaccaagcacacaagcgccttgactctccaggtgttgggaaatgcaaaaggagcggttgctgttgtggtgtcgattttgatattcaagaatccagtgtcggtaacggggatgcttggatacttgttgacggtgctgggagtgattttgtacagcgaagccaagaaaaggacgaaataaacgacttgacacaacctttatccatacgtgtggtcgttatttttttcttactgtttgcacgaaacaaggtcgtagcaaatattagcagcagcagaagcagcaacttattctttttgggagtatttccatggtttttttgtttgattttggacttgatgatgaagaaaaggacgatttccatttgtaacgtgattatgggtccatttacgattatacggttgtataaatactactgtagaatgaatatgaatcaacataaatgcctacctggaattcaattcttcatgttttacntacttgctttatttattcccctggaaaaaacaaacaattattccttc

SEQ ID NO: 807 - DNA, 1347 bp, Cichorium intybus
gatttcaattcgtaagaataattaaattcttcccagatccatcacttttctcggcctaatcatcagataatctccccagatctcccagatttcaatcaaaaccctaaatccctatgttaaacccacacgaaatcagtaaaattcagaaaccctagataggaaaaactttgatgaagggaggcacgggccagtggtttacgatcgggctcgtgtcatcatggtatgcatcgaacattggagtactactgctaaacaaatacttgctaagcaactatggattcaagtacccgatcttcctcaccatgtgtcacatgaccgcctgttctttgctcagttacattgcgattgtttggatgaagatggtgcctttacagcatgttaggtctaggggtcagtttatcaagatctcggtgcttagtttggtattttgtgcgtcggtggttagtgggaacgtgtcgttgaggtatttgccggtttccttcacgcaggcagtcggagccaccactcctttttttactgcggtgtttgcttatattatgacggtgaagagggaagcttggttgacttatttgacgcttgtacctgtggtaaccggcgttgtcattgccagcgggggcgaaccaagtttccatttattcggttttatcatgtgtattggtgctacagctgcaagggcattaaagtcagttctacaagggattttgctgtcctcagaaggggaaaaactaaattccatgaaccttttactgtacatggcaccagttgcagttgtgatattacttccagcaacattgtttatggaagacaatgtggtgggaatcacaatagcacttgcaagaaaagatgtcaacattgtgtggtatctacttttcaattccgcaatggcatattgtgtaaatttgaccaatttcttggttactaagcacacaagcgccttaaccctccaggtgttgggaaatgctaaaggagcagcagctgttgtggtgtcaattttgatattcaagaatccggtctcggtaacagggatgcttggatacttgctcacagtgtttggagtaattctgtacagcgaagccaagaagagaacgaaataaaatcctcacgacctgctctcgcgtccacggttttacatttggtgttctttctctgaactgtacactccagtctgtgaggactgtacagttcagagcaatcttagcttatgattttgggaggacaaatgaaaaaaaaaacgaactttttagtatgattcatcgttcatgtattttccatgattttttggtttggactgatgaaaaacacaatgttttccgtttgtatcttgtgacgtgattatatgattatacg

SEQ ID NO: 808 - DNA, 1650 bp, Gossypium hirsutum
  misc_feature (161)..(161): n is a, c, g, or t
cgtttacttcctctcttgtataatcctctttttaatctctcttcgttttctcagagaattttgcagacatgcagccaatccatagctattttcataacattaaagctttactttttctgtccttttttttttttagtttaccttttaatttttcttctctntgggtttcattgatattgtaatgagaaacttgaatcagatccatgggagctagttccatcaaatcatctcaaaagaacccatttttcacaccaaaaacacccataatttcccaagctccacccagatccatcttcagataatcccaatttccttttctattaaaaacccattttttcttcatctaaattaagacacccagatcctcaaaacccaaaaagaaaccatgaaaaaccaatcgaaaatgttcacgatcgggctagtatcagcctggtactcttccaacataggtgtcttgttgttaaacaagtatttactaagcaattacggtttcaaatacccaatcttcttaaccatgtgtcacatgacagcttgttctttgttaagctacatcgcaattgcatggatgaagatggttccaatgcagaccattcgatctagggttcagtttttcaagatcacgactttgagtttagtcttttgcgtatcggtggtgtttgggaatatttctttgaggtatttgccggttagtttcaatcaggctgtcggtgctacgacaccgtttttcactgcggttttcgcttacttgatgacattgaagagggaaggttggcttacttatattactctagtccctgttgttactggggttatcattgccagtgggggtgaaccgagtttccatctatttgggtttatcatgtgcatttcagctacggctgcacgagctctcaagtcagttttacaaggaattttgctttcatccgaaggagagaagctgaattccatgaacctcctcctttacatggctccgatagctgttgtatttctacttccggcaacactcattatggaggaaaatgtggtgggtataacccttgcccttgcccgagatgatgtcaagatcatatggtatctactattcaattcagcattagcatactttgtgaatttgaccaactttttggtcacgaaacacaccagcgccctaactttgcaggttctaggaaacgcaaaaggagctgtagctgttgtggtttcgattttaatttttagaaatccagtttccgttactgggatgctcggttataccctcacggtcttcggggttatactctacagtgaagccaagaaacgaagcaaatgagacatcatcctgggattacggtattggttgtgattgtgatatattttagtgcaaggatatcaacaatgttcaaagaggcaaagtttcggtagcatacaatgctgcggatttgtatgctgcggattttgcgccatagattcctataattttcccatggaaacctgggaagctgctttttcttttgtatcggcaacagctgcgggattttagtcaaaaattagaggaaataccattttctgttcattctttcaggagaaaaaaaggttgtagaattggtctttatacattgtttagatttcccatatttcattaattaatggaaaagaaaactcgtaaaatttacc

SEQ ID NO: 809 - DNA, 1728 bp, cucumber
atttctccaatttctccaaatttccccctttttctctctctttcaactatatccccatttcccctgttccaattttcttgccctccatggagttctgttttcagatccatggaaaccccaccttcattcctctgtaatgtgtctctttctcgtttcatctttgtagatttgactttcagatccatgttctagtgtacctaatcggagctacgacctaagcctttcagaaatcaccgcaccacgatccagaccgacagccgaaatgaagggttcgagtcgttttttcacgatcgggcttgtaacttcgtggtactcctccaacattggtgttcttttgttgaacaagtatttgctgagcaactatgggttcaagtacccgatcttcttgaccatgtgccatatgacggcttgctctttgcttagctatgttgcgattgcttggttgaagatggttccgatgcagacgattcgatctcggatccaatttttgaagattgctgctcttagctttgtcttctgtatttctgttgtctttggtaacatatctcttaggtatttgcctgtttccttcaaccaagctgttggggccaccacgcctttctttacggcggtttttgcttaccttatgacgatgaagagggaagcttggctcacttacgttactctcatccctgttgttactggggtcattattgctagtgggggtgaaccgagtttccatctgtttggatttataatatgtgttgcagctacagctgcaagggcactcaaatcagtactgcaaggcattttgctttcttctgaaggagagaagctgaattccatgaatcttcttctgtacatggctccaatagccgttgtctttctgctgcctgcagcactttttatggaagaaaacgtggttggtatcactctggctcttgctcgagatgataaaaagatcatctggtatctgctattcaactcttcacttgcctattttgtaaacttgaccaactttttggttaccaagcacaccagtgcattgacacttcaggtgcttggaaacgcaaagggtgctgttgcggtggtgatttcgattttgattttcagaaatccagtctctgtcactggaatgcttggttacgccctcacggttatgggagtcatcctctacagtgaatcaaagaaaagaagcaaatgagaagaatgcaattgaggtgcattttcctactatagttttcttttgcacggtggcagcagtcgtcgagtaccagaggcagcagcggatgtagatcgaccattgactatatagcctccaaattctttctcccttctcccccactgaaaaagcttattagcttaggcattggtttatatttgtatcatcctcacaagatctgtcacaaaatagaaattttaataaggaagaattatggggtaaagttttacttctttagaaaagggattaatagaattgtttattacataaaactcgactgttattgtcactccttgatcaattaagggggaaaaacaaccttgtcttttaccattttggtacattatttttgttaattcaaagttatactgaactttgtttgagggtcatttttgtttgtttggaagaaaatacactggaaagaaagagaacaaatttacttgtcatttctccttccatggtcaggatttgagaatcccgactccaaaatattatctgaatgaagattcttacaaaatattccaatc

SEQ ID NO: 810 - DNA, 1476 bp, Zingiber officinale
  misc_feature (144)..(144): n is a, c, g, or t
  misc_feature (149)..(149): n is a, c, g, or t
ctcgtgccgaattcggcacgaggattccttcctctctttttttgttttttccatccttctgcgtcccagatccgatcggatcatcggtttttctcgctccaggagcataggcggggatcgagcgaccagcgatctgatccgagnacttnggtccccgctccctcgatctgcgcatccccgcgtagatccggaggcgatgagcggtaaggcggcagcggcggcggcggcggcgatgtcgccggcgctggcgaacggacggttcttcaccgtcgggctcgtcaccgcgtggtactcctccaacatcggagtgctcctcctcaacaagtacctgctcagcaactatggcttcaagtacccgatcttcctcaccatgtgccacatgacggcctgttccctcctcagctacgtcgccatcgcgtggctcaagatcgtgccgatgcagaccatacggtcgcgcgtccagttcctcaagatcgctgccctcagccttgtcttctgcggctcggtggtcagcgggaacgtgtcgctccggtaccttcccgtctcgttcaaccaggccgtcggcgccaccacgcctttcttcaccgccatcttcgcttaccttatgaccctccggcgggagtcgtggttaacctacattaccctcgtgcccgtggttaccggtgtcattatcgcaagcgggggggagccaagctttcatttgtttggttttattatgtgtattggagctactgctgctagagcacttaagtcagtattgcagggaattttgatgtcctctgaaggggagaagttaaactctatgaatctccttctatacatggctccaatcgctgttgtttttctacttcctgcaacaattataatggaggaaaatgtgattggtataacattggcacttgctagacaagacttcaagattatatggtatctcttgttcaactcttctttggcctactttgtgaacttgaccaatttcttggtcaccaaacatacaagtgctttgacccttcaggttctcggaaacgcaaagggagctgtcgctgtggtcatctcaatcttaatattcaggaacccagtctctgttacaggaatggctggttactcgttgactgtcatcggtgtaattctctacagcgagtcgaagaagcgtaacaagggaagttaatcccagaagccactagcctatcctcactcagtcaccagtacttatgcctcataaggtactgggtgccaatagcctcataaaacgccctatcaacttagggaattaatataattgaagtctctctgtaccattagttagccaaatagtgtgctcagaggaagagaatttgtttgttagatgcaccatttacactttacattaagtcggtaagcatctgggccttcattatcttgttatacacaaacaattatacagtctaaattctttgtaagagtattcctcaatctattataaattccaatgcgatc

SEQ ID NO: 811 - DNA, 1760 bp, Mesembryanthemum crystallinum
atcgctattctcccccagcttcctacttgcctccctttttcccactttactacgcgttttcacctctcttcatctctctctctcctttctctctcatctccctcattgacattgacattgccattctcattttacagtccccaaataccttatcgtcggtcatctcatctctttctctctcctccattgtctgcttcttctctgctcatgtcctgattctaccatgagatccgtacaatcggacattatcctcatcacaccccaacaacaaccacctcgatttgattgatcaattggggttttgttttctttccgcatcgcaaatgcagtttttccccagatccacaacacaattctagattttgggttcccccaattccaaagccctaattgccgaccaagggtttcaaattagggcaaaaaaaatgaagaacacgagcagattcttcacgatcgggctcgtcacatcatggtattcatcaaacattggggttttgttgctcaacaagtacttgctcagcaattatgggttcaagtacccgatcttcctcactatgtgtcatatgacggcttgctctttgctcagctacatcgccatcgcttggatgaagatggtccctatgcaaactattcgatcgagggtgcaattctttaagatcactgctcttagcctcattttctgtgcttctgttgttagtggcaacatttcgctgaagtatcttccggtgtcgtttaatcaagcaattggtgctacgacgccgttcttcactgctgtttttgcttaccttatgaccttcaagagggaggcttggctcacttatgtcactctcgttccggttgttaccggcgtcatcattgctagtgggggtgaaccaagtttccaccttttcgggtttataatgtgtataggtgcaacagctgctagagctcttaagtcggtgcttcagggtatcctgctgtcctctgaaggggagaagctgaattctatgaacctcctactctacatggctcctatagctgttgtatttcttctccctgcaacacttttcatggaagaaaatgtggttggtatcacgctggcacttgcaagggaggatgtcaagattgtctggtatctaattttcaattctgcgttggcgtattttgtgaatctaaccaacttcctggtcacaaaacacaccagtgctttgactctccaggtgcttggaaatgcaaagggtgctgttgctgttgtagtctcaattatgatctttaagaaccctgtctcagttactgggatgcttggttattctcttacggtccttggggtcatcctatatagtgaagcgaagaaaagaagcaaatgagaatattcagggaagtgctaggcaacggtttttatttgactcggcttcgtccataggaacaactcaactggccgtcagagcaaagcctttgacaatgcacctgaagtcgctgtcataggttctgcattttgtatctcggatttcacccccgtaatggcttggggataggtttctgcatgtaccagcaacatcaccaaattgagttgcaaaaaacaaagaaagaaaagaaaaataagactaatatctttctttattcttcacgaaatgggttaatattgggggaaaatattttgtattcttttagcgtaaggttgtagaattgcatcctcatacgttctgttctttttaacagttctaaatttgagtaattagtgaaagacattgattaatcaatgaaagattttacattgattt

SEQ ID NO: 812 - DNA, 1558 bp, Lactuca sativa
  misc_feature (784)..(784): n is a, c, g, or t
  misc_feature (851)..(852): n is a, c, g, or t
  misc_feature (1137)..(1137): n is a, c, g, or t
  misc_feature (1369)..(1369): n is a, c, g, or t
  misc_feature (1374)..(1374): n is a, c, g, or t
  misc_feature (1405)..(1405): n is a, c, g, or t
  misc_feature (1410)..(1410): n is a, c, g, or t
  misc_feature (1460)..(1460): n is a, c, g, or t
  misc_feature (1478)..(1478): n is a, c, g, or t
  misc_feature (1548)..(1549): n is a, c, g, or t
gactaactaagcagaatagtcgccggtcgtcgatcgtcgagtgtcgatcgccggtcgtccttcgcagaacgctagcgtcacctctcttcttctctatcttcaatctggtaaacacgcggttttgtttcgattcagttcatcctctgtccagattccgtaatgcttcctagatctccctcagatccaatgccgtccttgttctagttgtagaagcagagggagaagaatcaattatcatcaatcagattgaaaaaaattggtccagtttcgattttgttaagaaatgtcggcaataaagagcccgtctcccacccggttcttcacgattgggcttgtaacgtcatggtactcgtccaacattggggttttattgctcaacaaatatttgcttagcaattacggtttcaagtacccgatcttcctcactatgtgtcatatgacagcttgtgctttgctaagctacatcgctatcgcatggctaaagatggttcctatgcagactatccgatctcgtgttcagttctttaagatctctgctctgagcttaatcttctgtggatccgttgtaagtggcaacatttcgcttaggtatttacctgtatcgtttaatcaagcgattggtgctacgacgccgtttttcactgccgtgttcgcgtatctcatgactttgaagaaggaggcttggcttacttatatcaccctcattcctgttgtaactggtgttattatcgctagtgggggcgagcctagttttcatctgtttgggtttataatgtgcattggngctactgctgcaagagcattaaaacagttgttcaagggatcttgctttcttctgaaggggagaagtnnaactccatgaatctccttctatacatggctcctattgctgtcgtattcctgcttcctgcaacattatacatggaaaggaatgtcgttggtataacaatagcacttgcaagacaagattttgggattgtttggctattgcttttcaactctgcgcttgcatatttcgtgaatttgacaaactttttggtcacaaaacacaccagcgttcttacacttcaggttttgggaaacgcaaagggggcagttgcagtggttgtttcgatactaatttttagaaatccggtntctgtgactgggatggcgggatacacattgacagtgattggagttattctttatagtgaagccaagaagcgtagcaataaatgagacccataattattatttataacttaattagttaaagattacaagctcaccatggacaacttgaagcaggttaggctttatgtgctgttgcttgttgctgctgatcttgccctctaaattcatattttttatgctcataaaaccttgngcttngggacattgaagctgcatatgtgtaacagcnacatnaaaaatcaaaagtaagccattagttacatctgtgtttagggttcatagtntaagaattgtagaattantttgctatgaattatgttatattcaaacttcttatagattatttattcaaggctatgcccatttatcctnnaaaaaaaaa

SEQ ID NO: 813 - DNA, 1543 bp, Leymus cinereus x Leymus triticoides
  misc_feature (122)..(122): n is a, c, g, or t
  misc_feature (1147)..(1147): n is a, c, g, or t
  misc_feature (1417)..(1417): n is a, c, g, or t
  misc_feature (1425)..(1425): n is a, c, g, or t
  misc_feature (1431)..(1431): n is a, c, g, or t
  misc_feature (1434)..(1434): n is a, c, g, or t
  misc_feature (1478)..(1478): n is a, c, g, or t
cagagccgtctcctcccaattcccataaacacaagctcacacgcctccgctccgagcccaaacccaccaccaattcaaccgcgacccaacccacccgtcattctcaccaccggcgcctcccncctcctcagatccacgcgcgctcgcgcgcgaccagccgcgatgacggccaagggcggcgcgtcgccggcgccgggcggcgcgggagctgcggccaacgggcggttcttcacggtggggctcgtcaccgcctggtactcctccaacatcggcgtgctcctgctcaacaagtacctcctcagcaactacggcttcaagtaccccatcttcctcaccatgtgccacatgtccgcctgcgcgctcttctcctacgccgccatcgcctggctccggatcgtgcccatgcagctcgtgcgctcgcgcgtccagctcgccaagatctccgcgctcagcctcgtcttctgcggctccgtcgtgtccggcaacgtctcgctccgctacctgcctgtgtccttcaaccaggccgtcggtgccaccacccctttcttcaccgccgtattcgcctacatcatgaccgtcaagcgggagtcgtggatcacgtacctcactctcgtccccgtcgtcaccggcgtcgtcatcgccagcggcggcgagcctagctttcatctgtttggatttataatgtgcattggagccactgccgcaagggcgttgaagaccgtgttgcaaggaattcttctgtcatctgagggggagaagcttaattctatgaacctgctcttgtacatggctccgattgctgtcattctcttgcttcctgctaccctctttatggaggataatgttgttggcgttacaatagaactggccaaaaaggatttcaccattgtttggttgctgttgttcaactcttgcttgtcatattttgtcaatttgaccaatttcttggtgaccaaacatactagcgcattgactctacaggtccttggaaatgcaaaaggtgctgtggcagttgtcgtctcaattctgatattcaagaatcctgtgtctgtaaccggaatgcttggttacaccctcacagttataggcgtcattctttacagtgaatccaaaaagcgtagcaaaccctaagttccccagaaaaccngacaaatggtacatatggccgtagcctggtcggtgtccagagctaatatatgacggggaactacatccggggcgattgcaacagattctgtgctgtatgtagccggataacaaaggacagagaagtccaataatacctgtagttttcccttggatcgcagaggcactttgttttgctaatggaaatgatcaatagaatacaattttttgtgtttagagaattgtgggctgtggctcacactgccagcattggttgatacgcttagttctnggaaattnttttcngtnattcatcagttattgtaagttcatgactccagttttcttctttngaagattgcatgtaccaaactttgccaaagaacctcctaatatattatgacactgaatttagtga

SEQ ID NO: 814 - DNA, 1559 bp, Zea mays
cgtgccaacgagccaggcccaaacccaccaccaattcaaccgcgacccagcccaccgccccgcacgccattcccacatcctcaccccccctcatcactcagatctccccgcgcgcccgcgcgcgagctcgttcgtgcgcggccgccggcgttggcgacgacgaccgaggagccatggcggccaagggcggcgccacgccgtcccccggcggcacggggcccgcggcggggaacggccgcctcttcacggtggggctagtcacggcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccgggaacgtctcgctgcgctacctccccgtctccttcaaccaggccgtcggcgccaccacgcccttctttaccgccgtcttcgcgtacatcatgaccgtcaagcgcgagtcgtggatcacctacctcaccctcgtgcccgtcgttactggagtcatcatcgccagcggcggcgagcctagctttcatctgtttggattcatcatgtgcataggagcaactgcagcaagggcgttgaagacagtactgcaaggaattcttctgtcttctgatggggagaagcttaattctatgaatctgttattgtacatggctccaattgctgttattttcttgcttcctgcaactatctttatggaggataatgttgttggcatcacaattcagcttgcaaagaaggatttcacgattgtttggttgctactgttcaattcttgcttgtcatattttgtcaatttgaccaatttcttggtgaccaaacatactagcgcactgactctacaggttctcggaaatgcaaagggtgccgtggcagtcgtcatctcaatcatgatattcaggaatcctgtgtccataacaggaatgctcggttacactctcacagtttttggcgtcattctttacagtgaatccaaaaagcgcagcaacaagccgtgaccaccctagaagacagtaaatacggccatcatttctttgtcctgccagcgcctagagctaatatatgatgagaaactacaccggtggcgatcacaacaaatccaatgccgtaccgcctcagcaattggacatcaagggtagaagtccaataatacctgtagtattaaattggcatgtgggaggcattttttttaatggcattgatggatagaatatatatattttttgtgttagagaagtgtggctcagactgccagcattggttagtacgtttagctcttgggatattgcctcttctattcatcggctactgtaacttccattttcttttgttctgaagactacctgtaccagactttgatccaggttccagggcctaattaatatattgacactgaatttaagcacaaa

SEQ ID NO: 815 - DNA, 1593 bp, Zea mays
tatccatctcctctccgttctcaccaccgacaggggcgtctgtctcctccccgctgccataaacgcaggctcacgcggacgcctccctcccgtgccaagcgcccaagaccaaacccaccagcacagcaccaattcaaccgcgacccaacccaccgccccgcaccccattcccgcaccctcctcccccagatctccggccgcgacgacgccatgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccggcaacgtctcgctgcgctacctccccgtctccttcaaccaggcggtcggcgccaccacgcctttcttcaccgccgtcttcgcctacatcatgaccgtcaagcgcgagtcctgggtcacctacctcaccctcgtgcccgtcgtcaccggagtcatcatcgccagcggcggcgagcctagctttcatctgtttggattcatcatgtgcataggagcaactgcagcaagggcgttgaagacagtattgcaaggaattcttctgtcttccgatggggagaagcttaattctatgaatctgttgttgtacatggctccaatcgctgttatcttcttgcttcctgcaactatctttatggaggataatgttgtcggcgttacaattgagcttgcaaagaaggatttcacgattgtttggttgcttttgttcaattcttgcttgtcgtattttgtcaatttgaccaatttcttggtgaccaagcatactagtgcactgactctacaggttctcggaaatgcaaagggtgcggtggcagttgtcgtctcgattatgatattcaggaatcccgtgtccataacaggaatgctcggttatactctcacagtttttggcgtcattctttacagtgaatcgaaaaagcgcagcaacaagccatgaataccctaggagacagtaaatatgggaaatcatttctttgtcctgtcagtgcctagagctaatatatgatgagaaatcacatcggtggcgaccacaacaaatcctatgccatactgcctcagcaattggacatcaaggatagaagtccaataactaccttggcatatgggaggcattttgttttatggcgttgatggatagaatataaatatttttttgtgtgtgttagagaactatggctcacactgccagcattggttgatacgtttagctcttgggaaattgcctcttgtattcatcttctgctgctgcagtttccattttgttttgttgtgaagaccacctataccacactttgatccaggttccgggacctaattaatatattgtgacactgaattgatgctc

SEQ ID NO: 816 - DNA, 1727 bp, Cucumis melo
  misc_feature (312)..(312): n is a, c, g, or t
  misc_feature (953)..(953): n is a, c, g, or t
  misc_feature (1087)..(1087): n is a, c, g, or t
  misc_feature (1123)..(1123): n is a, c, g, or t
  misc_feature (1237)..(1237): n is a, c, g, or t
  misc_feature (1596)..(1596): n is a, c, g, or t
acccatttctccaatttctccaatttctccaattttcccccttttcctttctctttcaactctctccccatttcccctgtttcaattttcttgccctccatggagttctgttctcagatccatggaaacctcaccttcattcctttgtaatgtgtctctttctcgtttcattttttgtagatttgactttcagatccatgttctagtgtaccaaatcggagcttcaacctaagcctttcagaaatcgccgccccacgatccagaccgacagccgaaatgaagggttcgagtcgtttcttcacgatcgggctngtaacttcgtggtactcctccaacattggtgttcttttgttgaacaagtatttgctgagcaactatgggttcaagtacccgatcttcttgaccatgtgccacatgacggcttgctctttgcttagctatgttgcgattgcttggttgaagatggttccgatgcagacgattcgatctcggatccaatttttgaagattgctgctcttagctttgtcttctgtatttctgttgtctttggtaacatttctcttaggtatttgccggtttccttcaaccaagctgttggggccaccacgcctttctttacggcggtttttgcttaccttatgacgatgaagagggaagcttggctcacttacgttactctcatccctgttgttactggggtcattattgctagtgggggtgaaccgagtttccatctgtttggatttataatatgtgttgcagctacagccgcaagggcactcaaatcagtactgcaaggaattttgctctcttctgaaggagagaagctgaattccatgaatcttcttctgtacatggctcctatagccgttgtctttctgctgcctgccgcactatttatggaagaaaacgtggttggtatcactctggctcttgctcgagatgataaaangatcatctggtatctgctattcaactcttcacttgcctattttgtaaacttgaccaactttttggttaccaagcacaccagtgcattgacacttcaggtgctcggaaacgcaaagggtgctgttgcggtggtgntttcaattttgattttcagaaatccagtctctgtcnctggaatgcttggttatgccctcacagttatgggagtcatcctctatagtgaatcaaagaaaagaagcaaatgagaacaatgcaactgaggtgcactttccttctatagttttnttttttgcacggtggcagcagtcgtcgagtaccagaggcagcagcatgtgtagatcgaccattgactatagcctccaaattctttctccctccccactgaaaagcttattagcttaggcattggtttatatttgtatcatcctcccaagatctgtcacaaaatagaaattttaataaggaagaattatggggtaaagttttacttctttagaaaaggattaatagaattgtttatttcataaaagtcgactgttattgtcactccttgatcaattaagggggaaaaacaaccttatcttttaccattttggtacattatttttgttaattccaagttatactgaactttatttgagagncattttgtttgttgtacactggaaaaaaagaaacaaatctacttgtcatttctccttccatggtcagaggatttgagaatcccgactccaaaatattatctgaatgaagattcttacaaaatattccaatc

SEQ ID NO: 817 - DNA, 1865 bp, Mimulus guttatus
tgagggagattaattaatgaaattaatcacaagtttaacccagcacgatctctctctctctctctctctctccgcgttctctcgttctgcctgcaaacaaatgctcgtcggccgtctccaacactccactctctcaccccccacccccacccccaccccccgcattatcttgctcttatattacagctattttctcgttcatcgctgactctgtgtatactttcaatccagcaaattccacatctctgtggatttgcttttcaaaacattaatctcaatttttggtaaaaaattcttcactttttgctaattcagatccgttgaatttctcaattggatattttggatccagatccctcattttattcccttcccagtcagtcattttccagccctaattgatcccttcgaaaatctctccgtgacttcacttcagccatttatttaatcggttacagagttttctcagtcttttcccccggttaattttgggggttttttgcttttttcttttttttttttttaattctgaatttatttgattagaaaaaaagatgtctgcgatgaaatcgacgggccgattcttcacgatcgggctggtaacatcgtggtattcatccaacattggggttttgttgctgaacaagtatttgttgagcaattacgggttcaagtacccgattttcttgaccatgtgtcacatgacggcgtgctcgttgctcagctacattgcgattgcatggatgaagatggtcccgatgcagactataagatctagggttcagttcatgaagatctcggccctcagcttgattttctgcgcctcagttgtcagtggcaacatttctctcaagtacttgcctgttagcttcaaccaggcgattggggccacaacgccattttttactgccgtatttgcatacttgatgacatttaaaaggaggcctggttgacttatgtgactttgattcctgtggttactggagtcgtcattgctagtgggggtgagccgagtttccatttgtttggatttatcatgtgtgttggtgcaacagctgcaagggcactcaagtcggtggttcaggggattttgctttcttctgaaggggaaaaactgaattctatgaatctactactatacatggctcctatagcagtcgtattactacttccggccacactttatatggaggaaaatgttgttggtataacattggcattagcaagagaagatttcagaattatttggttactgctgttcaattctgcgcttgcgtattttgtgaatttgaccaattttttggtcacaaagcacaccagtgctttaactcttcaggttcttggaaatgcaaaaggggcagtagcagtggtaatatccatactaatattcaggaatccagtttccataaccggaatgctcgggtatagtctgacggtgatgggtgtgatcctctatagtgaagccaagaagcgcagtaaatgaaactgatccttccggggaaaaaaagaaaagaaaaaaaatcaaaatttggtatggggttgctttgtaatatgaattaggtgcagccattaaaagtaagttcagtcttgttgacctattttttgctcgggagctgaaaggatagagaggcttcttcaacatgtaccagcaatcaaacaaacaaacaaccacctgattggtggagtagacaagtttttttaaaataagtgactcagtcaaatgtctttattatttacagtcttggcttctaagaaatagatcctttcttttttttaccttataattctttcagtaaaggatttggatccatctacataccatgtgattatacttttttattacatatttacatcaatttaatcat

SEQ ID NO: 818 - DNA, 1478 bp, Mimulus guttatus
ctttactctccaaagaattcccccaaatcaattttccgatgtgtttccgctgaatctggaccgtcgaattccacagcaccaccaccaccacattttccctcttctacagatccgttcacaattcccctcaatccaaccccaacaattcgtcgatcgattgaaatcaatttcgaatgtcggcgatgaaatccagcgggcgattgttcacgatcgggctggtggcgtcgtggtattcatcgaacattggggtattgctgctgaacaagtatctgctgagcaattacgggttcaagtacccgattttcctgacgatgtgccatatgatggcctgctctctgctcagctacatcgcaatcgcttggttgaagatggtcccgatgcagaccataagatctagggttcagttcatgaagatttccgcactcagcttgatcttctgcgcttccgttgtcagcggcaatatttcactgaagtacttgcctgtcagctttaatcaggcgattggcgccaccacacctttcttcactgctgtttttgcttatttcatgaccttgaagaaagaggcttggcttacttacatgactctcatacccgttgttaccggcgttatcattgctagtgggggtgagcccagtttccatttgtttggatttctcatgtgtatcggcgcaactgctgctagggcactcaaatctgtccttcagggtattttgctttcttccgaaggggagaaactgaattcaatgaatctgctgctatacatggctcctattgctgtagttgtcctacttccagcgacactctttatggaagaaaatgtcgtcggtatcactttggccttagcaagagaagatatcagaattatctggttactgcttttcaattccgcccttgcgtatttcgttaatttgaccaacttcttggtcaccaagcacaccagtgctttaactcttcaggtgcttggaaatgcaaaaggggcagtagcagtagtaatatcaatattgatatttaggaaccccgtttctgtgactggaatgctcggttatactctcaccgtattcggtgtaatcctctacagtgaagccaagaaacgcactacttctaaataatcaaatccaaccactcaacatcatcatcatcatcatcatctgtgtatttgatatattctattttcggcccagaagcaaagcgaagcggcctacagaggcttttgaaccaatattagctgagtcaccacaagttctattaactttttttagtttggagtcaccaaagaaacatcttttttaccattatattatatatatatatatattctttcagcaaggctcaatctgccctatacttcatcttgttaccatatatgcttttcttttcttttttaatttttaaatgattagtgaattttttttcacaattctatcaatttgtagctatctttgattagtggttaaatggtatatggttttctccttaac

SEQ ID NO: 819 - DNA, 1711 bp, Carica papaya
gcgtttatcatcgtcgtcggctgatctccctccctgcttctctccctccttttttctcttgtacattctgcggactctcacatttactaatcggtcttcttcaaggaagctccttcttcaactctctctgaaatcctccttttttttctctgtttttttttccttgcagaaaactcttgccttttgtagacatcactatctcacagatccatggaagaacgccgacacgaaatctctctgcaaaattcatctgcacagcccagatccacctcgttttagtacaattccatcgcaggcaatccctttgttctgctgtctgtcaaaaaacccgaccccgttgagccaaccaatagccattacccaatacccagaaatccgcgaatatgaagggggcaacaaacagcagattcttcacgatcgggctggtaacttcatggtactcctcgaacattggtgttctgttgctgaacaagtacttgcttagcaactatgggttcaagtacccgatcttcctcaccatgtgtcacatgacggcttgttctctgctaagctacatcgccatagcatggatgaagatggtccccatgcaaacgattcgatcccgggtacagttctttaagatctctgctctcagtttggtgttctgcgtgtcggtggtgttcggcaacatctctctccgcttcttgccggtgtccttcaaccaggcgatcggggctacgacgccttttttcactgcggtcttcgcctacttgatgacattgaagagagaggcgtggttgacttacctcacccttgttcctgtcgtcaccggagttattatcgccagtgggggtgaaccaagcttccatctatttggattcataatgtgcattgcagctacggctgcaagagcacttaaatcagttttgcaagggattttgctttcatccgaaggggagaagctgaattccatgaacctcctcctttacatggctccgatcgctgttgtatttctactccctgcgacacttattatggaagaaaatgtcgttggtattgcacttgctcttgcaagagatgatgtcaagatcatctggtatctattattcaactcagcgcttgcatattttgtaaatttgaccaacttcttggtcaccaaacacacaagtgctctgactcttcaggtactaggaaatgcaaaaggggccgtggcagtggtggtctcaattctaatatttagaaatcctgtctctgttactggaatgctcgggtacactctcacagtcattggagttatcctttacagtgaagccaagaaacgaagcaaatgaaagaagtcagattggggaaccattaagttgagtcttggtatactttctcctcgtcacagggatggcagcaaccgaggggcaagcttggaccatgtggtagcagaggtggtttggattttgcccttttggttctatttttttccctggaagctttggaaactggtttccaatttgtatcagcaacaagtgcaggattagtcaagaaatagaaaagaaaactccaataagtgactgatttatctctattactcccagcttgggattgcagagaatatcatttttatcctttttttcttttaattctttcaggaaaagcctgtagaatttgtctctacacactcactctgttgttaccatttgtcatattgataaattaatgaaaaagacccataaatttgcaa

SEQ ID NO: 820 - DNA, 1439 bp, Raphanus sativus
  misc_feature (17)..(17): n is a, c, g, or t
  misc_feature (127)..(127): n is a, c, g, or t
  misc_feature (193)..(193): n is a, c, g, or t
  misc_feature (216)..(216): n is a, c, g, or t
  misc_feature (223)..(223): n is a, c, g, or t
  misc_feature (240)..(240): n is a, c, g, or t
  misc_feature (394)..(394): n is a, c, g, or t
  misc_feature (438)..(438): n is a, c, g, or t
  misc_feature (459)..(459): n is a, c, g, or t
  misc_feature (480)..(480): n is a, c, g, or t
  misc_feature (489)..(489): n is a, c, g, or t
  misc_feature (745)..(745): n is a, c, g, or t
  misc_feature (1273)..(1273): n is a, c, g, or t
ggacaaaacgaaactgnaaagagagagagacgagtcgaagaagaagaagaagaggcgttgttgctgctaagctttaaccaatcccaaaacctctcttcttcattctccaatcccgacctaattaacnaacactcgaattcgaatccaattccgatgaagacggcggatccgaacggccggttcttcacgatcngtctcgtggcgtcgtggtactcntcgaacntcggagtcctcctcctnaacaagtacctcctgagcaactacgggttcaagtacccgatcttcctcaccatgtgccacatgaccgcctgctccctcctcagctacgtcgccatcgcctggctcaagatggtccctatgcagaccgtccgatcccgcgtccagctcctcaagntcgccgccctcagcctcgtcttctgcgtgtcggtcgtcttcggnaacgtctccctccggttcctnccggtctcgtttaaccaggcngtcggcgcnacgacgccgttttttacggccgtgttcgcgtatatgatgacgatgaagagggaggcttggttgacttatgtcacgctcctccctgttgttaccggtgttgttattgccagtgggggtgagccgagtttccacctgtttgggttcattatgtgcattgcagccacagctgcgagagcgcttaagtctgttctccaagggattttactttcttcagaagggagaagctgactccatgaatcttcttctttacatggcncccatagctgttgtgttccttcttcctgctacactcatcatggagaagaacgttgttggcatcacgatcgcactcgccagagacgattttagaatcgtttggtatctgcttttcaattccgccctcgcttatttcgtcaacttgaccaatttcttagtcactaaacacactagcgctctgactctgcaggtgctaggaaacgccaaaggtgcagtagcggtggtggtttcgatcctgatattcaagaatcctgtctcagtgactggaatgttgggttactcgctcactgtctgtggagttatcctctacagtgaagccaagaaacgaagcaaatgagaaatgaaattattccgtttttatttgttaggtcctcagtttcaggtaaaaacacacaaaaagaagtttcttttttactgtgaacaagaaaccttaaaacagcatcttcttaggaccaagcatcaaaggatcagagtactaccaacagctatcatttagaggacttttgacaaacacgtgatattttttttncccttctttgtgttgtgttttccacagcttttgtcgtaggttgttccaagggtaacttgggtttagctttcttatttttgtcgattcttttacaatctagttctgtgatgtcaacatttacaaacactgattaattaatggaaaagacaaagggctttttctttca

SEQ ID NO: 821 - DNA, 1717 bp, Solanum phureja
ctttctctctgcaaattcgtcggtcgtctttctcaaactccatttttcattcctcaaaaacctctctttatctttctatatttgctccaaaaagttttccatttttttttttagttttgtttgttcagtacaagtaaaagttgctgcaaattcactctttttaaaataaaataaaatttggtgttgaattgaattgattgttgctgaagaaattgaatcagatccaattaatggtttcaaaattacttcttgttttctctttttctactcctagaagatccattctcctttctccttcataatatttctatatttttttttactttattactcgaaattcttgatttttgatttttggttttgggtgtatttggttctatagagtttttcctttgtgggttttgttgtttgtgagatttagggttgtgggtattgattagatcagtttataatgtcggcaatgaagagttcaggtcaattctttacaattgggctagtaacagcttggtattcatcaaacattggggttttgttactgaacaagtatttgttaagcaattatgggtttaaatacccaatttttcttactatgtgtcatatgactgcttgttctttactgagttatatagctattgcttggatgaaaattgtaccaatgcagactataagatctagggttcagtttatgaagatctctgctttgagtcttattttttgtacatctgttgttagtggcaatatctcacttaggtatttgccagtatcttttaatcaggctataggtgctactacacctttctttactgctgtatttgcttacttgatgacattcaagagggaggcatggttgacttatgtcactctaattcctgttgtcaccggggttgtcatcgccagtgggggtgaaccaagttttcatctatttggattcataatttgtatcggtgcaacagctgcaagagcactcaagtcagtgcttcaggggattttgctgtcttctgaaggggagaagctgaattccatgaaccttctactctatatggctcccatagcagttgtatttctgttaccggcaacacttatgatggaagaaaatgtagttggcatcacattggcacttgcaagagatgatagtagaatcatctggcttttgctattcaattctgcgctggcatattttgtaaatctgaccaactttctggtgacaaaacacaccagtgccctgactcttcaggtcctgggaaacgcaaaaggagctgtagctgtagtcatctcaatcttaatatttagaaacccggtgtcagttacagggatgctgggctatgcacttacagtttttggagtcatactctatagtgaagcgaagaaacgtagtaaatgagcattgaaaattttccacttgcgacttctgaaattaattgtttgttcaagaaatgattcactttcacgaggcaagtcgcggatcatgctcttgcatttgccctgaaaaacctgtgaaacaggctttcatctgtaacagccaagagaacaggactaggctgaatagcaagtcttaagaagtgacttgatttgtctatctttttgtcttttattctttcagaaagattgtaaaattgagactacacacaatatgtcactatatagttgtcaaattgatttattaatgaaaaagtatctcaatattagaaatttataaatggcttcttttgtgtgagga

SEQ ID NO: 822 - DNA, 1652 bp, Sorghum bicolor
gtcaccaccgacaggcggacacgacaggggcgggtctcctccccgctcccataaacgcaggctcacgcagccgcttccctcccgtgccaagcgcccaagcccaaacccaccaccaccaattcaaccgcgacccaacccaccgaccgcccgcacccccattcccacctcctccttcccagatctccccgcgcgcccgcccgcgcgcgcgcgagttcgtgtgcggccggcagcggcggcggcggcggcgaccgaggagccatgacggccaagggcggcgccacgccgtcccccggcggcgcggggggtgccgcggcggggaacggccgcctcttcacggtggggctggtcaccgcctggtactcctccaacatcggcgtgctcctgctcaacaagtacctcctcagcaactacggcttcaagtacccaatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccgggaacgtctcgctccgctacctccccgtctccttcaaccaggcggtcggcgccaccacgcccttcttcaccgccgtcttcgcctacatcatgaccgtcaagcgcgagtcctgggtcacctacctcaccctcgtgcccgtcgtcactggagtcatcatcgccagcggcggcgagcctagctttcatctgtttggattcatcatgtgcataggagcaactgcagcaagggcgttgaagacagtattgcaaggaattcttctgtcttctgagggggagaagcttaattctatgaatctgttattgtacatggctccaattgctgttattttcttgcttcctgcaactatctttatggaggataatgttgtcggcattacaattcagcttgcaaagaaggatttcactattgtttggttgctattgttcaattcttgtttggcatattttgtcaatttgaccaatttcttggtgacaaagcatactagcgcactgactctacaggttctcggaaatgcaaagggtgctgtggcagttgttgtctcgatcatgatattcaggaatcctgtgtccataacaggaatgctcggttacactctcacggttattggcgttattctttacagtgaatccaaaaagcgcagcaacaagccatgaacaccctagaagacagtaaatatggcaatcatttctttgtcctgtcagtgcctagagctaatatatgatgagaaatacttcggtggcgatcacaacaaatcctaagccatactgcctcagcaattggacatcgaggatagaagtccaatactacctgtagtatcaccttggcatgtgggaggcattttgtttaatggcgttgatggatagaatataattttttgtgttatagaactgtggctcacactgccagcattggttaatacgtttagctcttggaaattgtctctgctattcatctgctattgtaacttccattttctcttcttctgatgaagaccacctgtaccagactatgatccaggttccaggacctaattaatatattgtgacactgaatttaagctcaattagct

SEQ ID NO: 823 - DNA, 1383 bp, Sorghum bicolor
acccttcttcaattcgtccccctcgtcttcctcttcctcctccgccctctctcctcttcttttccctccccgcccggcgacccagtaccaacaattcctacaagaacccgatccccgtcctccacccacacccagaggtaagggaggggaaggggatgacgggcaaggatgccgccgccggcggtggcggcggcaagggccgcctcttcacggtgggccttgtcacggcgtggtactcatccaacatcggggttctgctgctcaacaagtacctgctcagcaactacggcttcaagtaccccatcttcctcaccatgtgccacatgtccgcctgctccctcttctcctacgccgccatcgcctggctccgcatcgtccccatgcagctcccgcgctcccgcctccagctcgccaagatcgctgcgctcagcctcgtcttctgcgcctccgtcgtctcaggcaacatctccctccgctacctccccgtctccttcaaccaggctgtcggcgccaccacccccttcttcaccgctgtctttgcctacctcatgaccgtcaagcgcgagtcctttctcacctatctcgcgctcgtgcccgtcgtcaccggtgtcatcatcgccagcggcggagagcccagctttaatctgtttgggttcatcatgtgcgttggagcaactgctgcgagggcactcaagacggtcttgcaagggattcttatgtcttctgatggggagaagattaattccatgaacctgcttatgtacatggcaccaatcgctgttcttctcttggtccctgcaactatcttcatggaggataatgttgttgtcattacaatacaactggccaggaaggatatcaacataatttggtacctgctcttcaactcttccttggcctacttcgtgaatctgaccaatttcctggtgacaaagcatacgagtgcattaaccctacaggtcctgggcaatgcaaaaggagccgttgcagttgtgatctccatcttgatattcagaaacccagtgtctataactgggatgctgggctacacgctgactgtcataggggtgcttctttacagtgaagctaagaagcgaaccaagcaatgaaatcaaatcggcagcgattaggacgaagcaagcctagtagtctttcttggatatagcagctatagttttgtgagcacatacaacagcattgccaataattacttgtattcttttttttttctttcaaaacaaaacgccttcccaaccccacaccaatggtatggtgtgatccacagaaaaggaaagaaatatagtgattaattctttatgtgttgtgactagtgaaaacaccttgtccatttttattaattggttcccgtgttgacaaaattct

SEQ ID NO: 824 - DNA, 1610 bp, Glycine max
cgagcggcagtgaggtaggtccctgttcctgttggaatacacacgcgcttttacctttctcatcaattcattcatcaaaatcactccctacgcttttaaatacaatcgaagagagagtattgttcttaatttcttaatcctccgtcgtgggtggcgatgttgttcttctccggagcggattctcagatccatggagcaggctcatattattaagccaaagcctctcagatccgcggtggcggcgtgacggaaatgaagtcctcaagccgtctcttcacgatcggactggtgtcggcgtggtactcctccaacattggggtactgctcctcaacaagtaccttctcagcaactatggcttcaagtatcctatcttcctcaccatgtgccacatgaccgcctgctccctctttagctacgttgccatcgcctggctcaagatggtccccatgcagaccatccgctcccgcctccagttcctcaagatcgccgccctcagcctcgtcttctgcgtctccgtcgtcttcggcaatgtctccctccgctaccttcctgtgtctttcaaccaggccgtcggcgccaccacccccttcttcaccgccgtcttcgcttacatcatgaccttcaagcgcgaggcctggctcacctatctcaccctcgtccccgtcgtcaccggcgtcgtcattgccagcgggggtgagccgagcttccatttatttgggttcatagtatgcattgcagctactgcagcacgtgccttaaaatctgtgttacaaggaattttgctttcttctgaaggagagaagttgaattctatgaaccttcttctttacatggctccaattgctgttgttttccttcttcctgctacacttataatggaagaaaatgtggtaggtattacattggctcttgccagagatgatgtgaagatcatttggtatctgctatttaattcagcacttgcttattttgtcaacctgaccaattttttggtcaccaaacataccagtgctcttacccttcaggtacttgggaacgctaaaggggctgtagcagtagtagtttcgattctgatatttagaaacccagtgtcagtcacaggaatgatgggttattcactcacagtcctcggagttgtactttatagtgaagccaaaaagcgaagcaagtgatactgatggtgtcattcatgattctgtggaaatcagcagtgaaatccctatatttgttttcatctctgtgcggacaacctccagataccatgaggcaaatttgttatcatgattatgaccagaatgtttcagactctatataaatttttggccctacatggaaaaacgggttccccattgtattagtacctgtgcagaaatagcccacagtacaaagtttcaataagtgactgatctctctaatatatacccatgttggcatataatcgaggaatgtctttttgtcatttattctttgaagaaagagttgtagaaggatctctactcatttgttgtttacattgcttacatttatttattgatgataaaatttgtatctgggatgcgccaacagcatcatgcacatgaattaatatattgatctttgcaacttttta

SEQ ID NO: 825 - DNA, 1335 bp, Selaginella moellendorffii
gtccatggcgccgcgatgaggcccagatcggcgggcgggagccaagaatcgcgcggcggcggcggcattcctcgccggatcggcgtcttcttcgcaggaatcgggcgtcgatttggccggatcggctgagaatccgccccaggtttgctcggcgcctcgcattctcggggattctcggccatggagaaggagaagctgctaagatcgggctccctggcgtcgcaggccatggcgccgggcagcgtcttcacagtagggttgattggcgcctggtactcgtccaacatcggtgttcttctcctcaacaagtatctcctcagcaactatggcttcaagtaccctatcttcctcacgatgtgccacatgacggcgtgcgcactcttcagctacattgggatcgcgtggctcaagcttgtgcccatgcaggctatcagatccaggacgcagttcgtcaagatctcggctttgagcatcatcttttgcgcgtcggtggtgagtgggaacatctcgctgcgctacctcccggtctcgttcaatcaggccgtgggagctaccacccccttcttcacggccgtgtttgcgtatctcatgacgctcaagagggaggcctgggtcacgtatcttacgctcgtcccggttgtcacgggggtgatcatcgctagtgggggcgagccaagctttcatctctatggtttcattatgtgcgtgagtgccactgctgccagagcgctcaagtcggtattgcagggaattctcttgtcctccgagggggagaagctcaactctatgaacttgctgctctacatggcaccgatcgccgtggtgctgctgctgccggcgacgctgatcatggaacccaacgtggtgggcatcacaatcgcgctcgccaggacaaacttctccatcatcggcttgctcctggttaactcggccaccgcttacttcgttaacctcactaacttcctcgtcaccaagcacacgagcgctttgactctccaggtgctgggaaatgccaagggagcagtggccgttgtggtgtccatacttttgttccggaaccccgtgtctgtggttggcatggcgggctacacactcacagtgtttggagtgatcctgtacagcgaatctaagcgtcggctcaagtagagagcactctgggaagctacagattttgagggaagcaaattttttttcttttttcttggttcggacagagggagaccaagatcatcgatcaaaacattccaggcagctaaagagatatagattcacgcgtctaaagtttctgagctcattctcttgatcggaattaatttgaaaaactctacaacttca

SEQ ID NO: 826 - DNA, 1277 bp, Saccharum officinarum
  misc_feature (920)..(920): n is a, c, g, or t
  misc_feature (1196)..(1196): n is a, c, g, or t
  misc_feature (1238)..(1238): n is a, c, g, or t
ctcttcttcttcctccgccctctcttccctccccgcccggcgacccaataccaacaattcctaccagaacccgatccccatcctccacccacacccagaggtaagggaggggaaggggatgacgggcaaggatgccggcggcggcggcaagggccgcctcttcacggtgggccttgtcacggcgtggtactcgtccaacatcggggttctgctgctcaacaagtacctgctcagcaactacggcttcaagtaccccatcttcctcaccatgtgccacatgtccgcctgctccctcttctcctacgccgccatcgcctggctccgcatcgtccccatgcagctcccgcgctcccgccaacagctcgccaagatcgccgcgctcagcctcgtcttctgcgcctccgtcgtctcaggcaacatctccctccgttacctgcccgtctccttcaaccaggctgtcggagccaccacccccttcttcaccgccgtcttcgcctacctcatgaccgtcaagcgcgagtccttcctcacctacctcgcgctcgtgcccgtcgtcaccggtgtcatcatcgccagcggcggagagcccagctttaatctgtttgggttcatcatgtgtgttggagcaactgctgcgagggcactcaagacggtcttgcaagggattcttatgtcttctgatggggagaagattaattctatgaacctgctcatgtacatggcgccaatcgctgttcttctcttggtccctgcaactatcttcatggaggataatgttgttgccattacgatacaactggccaagaaggacatcaacataatttggtacctgctcttcaactcttccttggcctacttcgtgaatctgaccaacttcctggtgacaaagcataccagtgcattgaccctacaggtcctgngcaacgcaaaaggagcggttgcagttgtgatctccatcttgatattcaggaacccggtgtctataactgggatgttgggctacacgctgactgtcataggggtgcttctttacagtgaagctaagaagcgaaccaagcaatgaaatcggcggcaataggacgaagcaagcctagtagtctttcttggatatatcagctatagttttgtgagcacatacaatagcactgcgaataattacctgtattctttttttttattcaaaacaaaacgccttnccaacctcacaccaatggtatggtgtgatccacagaaaaganagaaatatagtgattattctttatgtgttgtgactagtg

SEQ ID NO: 827 - DNA, 1637 bp, Saccharum officinarum
  misc_feature (152)..(152): n is a, c, g, or t
  misc_feature (155)..(155): n is a, c, g, or t
  misc_feature (623)..(624): n is a, c, g, or t
  misc_feature (681)..(681): n is a, c, g, or t
  misc_feature (766)..(766): n is a, c, g, or t
  misc_feature (785)..(785): n is a, c, g, or t
  misc_feature (796)..(796): n is a, c, g, or t
  misc_feature (844)..(844): n is a, c, g, or t
  misc_feature (903)..(903): n is a, c, g, or t
  misc_feature (917)..(917): n is a, c, g, or t
  misc_feature (948)..(948): n is a, c, g, or t
  misc_feature (1506)..(1506): n is a, c, g, or t
  misc_feature (1546)..(1546): n is a, c, g, or t
  misc_feature (1548)..(1549): n is a, c, g, or t
  misc_feature (1552)..(1552): n is a, c, g, or t
  misc_feature (1602)..(1602): n is a, c, g, or t
  misc_feature (1606)..(1606): n is a, c, g, or t
agtctccaccgacaggcgggcacgacaggggcgtctccagtctcctccccgctcccataaacgcagcctcacgctcacgcagcgtcgtctcccgtgccaaagccaggcccaaacccgccaccaccgattcaaccgcgacccacccaacccancgnccgcaccccattcccatctcctcctccccagatctccccccgcgcccgcgcgcgcgcgagttcgtgtgcggccggcagcggcggcggcgacgaccgaggagccatgacggccaagggcggcgtcacgccgtcccccggcggcgcgggtgggcccgcggcggggaacggccgcctcttcacggtggggctggtcaccgcctggtactcctccaacatcggcgtgctcctgctcaacaagtacctcctcagcaactacggcttcaagtacccaatcttcctcaccatgtgccacatgtccgcctgcgccctgctatcctacgccgccatcgcctggctgcgcgtcgtgcccatgcagctcgtgcgctcccgcgtccagctcgccaagatcgccgcgctcagcctcgtcttctgcggctccgtcgtctccgggaacgtctcgctccggtacctccccgtctccttcaaccnngcggtcggcgccaccacgcccttcttcaccgccgtcttcgcctacatcatgaccgtnaagcgcgagtcgtgggtcacctacctcaccctcgtgcccgtcgtcactggagtcatcatcgccagcggcggcgagcctagctttnatctgtttggcttcatcangtgcataggancaactgcagcaagggcgttgaagacagtattgcaaggaattcttctgncttctgagggggagaagcttaattctatgaatctgttattgtacatggctccaattgcngttatttcttgctncctgcaactatctttatggaggataatgttntcggcattacaattcagcttgcaaagaaggatttcacgattgtctggttgctattgttcaattcttgcttggcatattttgtcaatttgaccaatttcttggtgacaaagcatactagcgcactgactctacaggttcttggaaatgcaaagggtgctgtggcagttgtcgtctcgatcatgatattcaggaatcctgtgtccataacaggaatgctcggttacactctcacggttattggcgttattctttacagcgaatccaaaaagcgcagcaacaagccatgaacaccctagaacacagtaaatatggcaatcatttatttgtcctgtcagcgcctagagctaatatatgatgagaaattacttcggtggcgatcacaacaaatcctaagccatactgcctcagcaattggacatcgaggatagaagtccaataatacctgtagtattaccttggcatgtgggaggcattttgtttaatggcgttgatggatataatataattttttgtgttagagaactgtggctcacactgccagcattggtttatacgttnagctcttgggaaattgcctcttctattcatctgctattgnannttncattttcttttgttctgaagaccacctgtaccaagactttgatccaggtnccangacctaattaatatattgtgacactgaatat

SEQ ID NO: 828 - DNA, 1275 bp, Helianthus annuus
  misc_feature (99)..(99): n is a, c, g, or t
  misc_feature (254)..(255): n is a, c, g, or t
  misc_feature (259)..(259): n is a, c, g, or t
  misc_feature (305)..(305): n is a, c, g, or t
  misc_feature (356)..(356): n is a, c, g, or t
  misc_feature (455)..(455): n is a, c, g, or t
  misc_feature (821)..(821): n is a, c, g, or t
  misc_feature (839)..(839): n is a, c, g, or t
  misc_feature (938)..(938): n is a, c, g, or t
  misc_feature (953)..(953): n is a, c, g, or t
cgggatccaacccctctttcttccctgtgcttgctaccaatcacaacggaccaccctcaccggtcgtcggtcatcgctcctcggtcaccgtcaccaccnggtcttcccccatcaaaaccccacctcaccaccaccctaatccaccgtaacgtaatgctccccagatctccttcagatccactcctctaaatcaacaatcgaatcgaatcgaaacaaattcacccagttccaattcaatccattcgattcgatcnnatancaaaatgtcggcaatcaaacccgcaacatcctctcgcttcttcacnatcggtctcgtaacatcatggtactcatcaaacatcggggttttactcctnaacaagtatctcctcagcaactacgggttcaagtacccgatcttcttaaccatgtgccacatgacggcgtgcgccttgctcagctacatcgggatcgcntggctgaaaatggtgccgatgcagaccattcgatctcgtgttcagtttttgaagatctctgctctgagtttcatattctgtgcgtcggttgtgagtgggaatatctcgttgaggtacctgccggtgtcgtttaatcaggcgattggtgctacgacgccgttttttactgcggtgtttgcttatttgattacgttgaagaaggaggcgtggcttgtttatgttactcttgttcctgttgttactggtgttattatcgctagtgggggtgagcctagttttcatctcttcgggtttataatgtgtatcggtgctactgctgcaagagctctaaaaacagtggttcaagggatattgctttcgtctganggggaaaagttgaactcnatgaatctcctgctgtacatggctcctattgctgttgtacttctgcttcctgcaacgctatacatggaagaaaacgttgttggcataacaatagcactngctagacaagatttngggatcgtttggctgttgcttttcaactctgcactcgcgtatttcgtaaacttaaccaattttttggtcactaaacacaccagcgctcttactcttcaggtgttgggaaacgcaaagggagcggtagcagtggttgtttcgatactcatctttagaaatccggtttctataaccgggatggctggatacacgctcacggtgattggggttgctctttacagcgaagccaaaagcgtagcaacaagtgattggttataacgttaattagaaggttagggtatcggtctcttgaggcttgccattttgccatttagattgagga

SEQ ID NO: 829 - DNA, 1677 bp, Panicum virgatum
gcagcagaaagagaagccggaaaagatctctccttcccctgcgagcagagctccgtccacccaccgacggagtctcctccccggctcttcccataaacgcaggctcacgcggacgcctcgccccaagcccaaacccaccagtccaccaccaccaattcaactgcaacccgacccaacccaacgacccccgcacgcattcccacctcctccctccctccctcccccagatctctctcccccctgcgcgcgcgcgccggggtgctgccttcgccggcggcggcgacgaccgaggaccgccatgacggcgaagggcggcgccgcgccgtcccccggcggcacgggggccgcggcggggaccgggcgcctcttcaccgtggggctcgtcaccgcctggtactcctccaacatcggcgtgctcctgctcaacaagtacctcctcagcaactacggcttcaagtacccaatcttcctcaccatgtgccacatgtccgcctgcgccctgctctcctacgccgccatcgcctggctccgcgtcgtgcccatgcagctcgtgcgctcccgcgtccagctcgccaagatcgccgcgctcagcctcgtcttctgcggctccgtcgtgtcggggaacgtctcgctgcggtacctacccgtctccttcaaccaggccgtcggcgccaccacgcccttcttcaccgccgtcttcgcgtacatcatgatcgtcaagcgcgagtcgtgggtcacctacctcaccctcgtgcccgtcgtcaccggagtcatcatcgccagcggcggcgagccaagctttcatctgtttggattcatcatgtgcataggagccactgcagcaagggcgttaaagacagttttgcaaggaattcttctgtcttctgagggggagaagcttaattctatgaatttgttattgtacatggctccaatagctgttattctcttgcttcctgcaactatctttatggaggacaatgttgttggcgttacaattcagctggctaaaaaggatttcacgattgtttggttgctattgttcaattcctgcttggcatattttgttaatctgaccaatttcttggtgaccaagcatactagtgcactgactctacaggttctcggaaatgcaaagggtgctgtggcagttgtcgtctcaattatgatattcaggaatcctgtgtctataacaggaatgctcggttacactctcacagtcataggcgttattctttacagtgagtccaaaaaacgcagcaacaagccgtgagcaccctagaagacagtaaatatggccatcctttctttgtccggtcagtgcccagagctaatatatgatggggaactacattggggcggtcgcaacaaatcctacgccctttggcgcctcagtgattggacattgaggatagaagtccaataatacctgcagtgttcccttggcatctgggaggcattttgttttgctaatggtgatgatggatagaatataatttttttgtgttagagaactgtggctcacactgccagaattggttaatacgtttagttcttggaaattgtcctcttctattcgtctgctattgtaagttccatatcttttgctctgaagactgcctgtaccaaactttgctccaggacctcctaatatattatgacactgaatttaagctc

SEQ ID NO: 830 - DNA, 1785 bp, Solanum lycopersicum
agcactactcaaacactttctttctcccacgcgtttaccccaccccccacccccaccctttctctctgcaaattcgtcggtcgtctttctcaaaactccatttttcattcctcaaaaacctctctcttttatctttctatatttgctccaaaaaaatttccaattttttttagttttgttagttcagtataagtaaaagttgctgcaaatttactctttttttttgaattttttttttggtgttgaattgaattgattgttgctgaagaaattgaatcagatccaattaatggtgtcaaaattacattttgtttactcattttctactcatagaagatccattctcctttctcctttataattttctagtttttttgtttttttttaactttagtactcgaaattcttgatttttgatatttggttttgggtttatttggttctatagagtatttcctttgtgggttttgttgtttgtgagatttagggttgtgggtattgaatagatcagtttataatgtcggcaatgaagagttcaggtcaattctttacaattgggctagtaacagcttggtattcatcaaacattggggttttgttactgaacaagtatttgttaagcaattatgggtttaaatacccaatttttcttactatgtgtcatatgactgcttgttctttactgagttatatagctattgcttggatgaaaatggtaccaatgcagactataagatctagggttcagtttatgaagatctctgctttgagtcttattttttgtacatctgttgttagtggcaatatctcacttaggtatttgccagtatcttttaatcaggctataggtgctactacacctttctttactgctgtatttgcttacttgatgacattcaagagggaggcatggttgacttatgtcactctaattcctgttgtcaccggggttatcatcgccagtgggggtgaaccaagttttcatctatttggattcataatttgtatcggtgcaacagctgcaagagcactcaagtcagtgcttcaggggattttgctatcttctgaaggggagaagctgaattccatgaaccttcttctctatatggctcccatagcagttgtatttctattaccggcaacacttgtgatggaagaaaatgtagttggcatcacactggcacttgcaagagatgatagtagaatcatctggcttttgctattcaattctgcgctggcatattttgtaaatctgaccaactttctggtgacaaaacacaccagtgccctgactcttcaggtcctgggaaacgcaaaaggagctgtagctgtagtcatctcaatcttaatatttagaaacccggtgtcagttacagggatgcttggctatgcacttacagtttttggagtcatactctatagtgaagcgaagaaacgtagtaaatgaggcattgaaagttttccacttgcgacttctgaaattaattgtttgttgaagaaatgattcactttcacgaggcaagtcgcggatcatgctcttgcattttgccctgaaaaacctgtgaaacagcaggctttcatctgtgagacaggaataggctgctgatggaatagcaagtcttaagaagtgacttgatttgtctatctttttgtctttttattctttcagaaaagattgtaaaattgagactacacacaatatgtcactatagttgtcaaattgatttattaatgaaaaaggatatcaatattagaaatttataaatggattcttttgtttgagga

SEQ ID NO: 831 - DNA, 1523 bp, Triticum aestivum
cacaagctcacacgcctccgctccgagcccaaacccaccaccaattcaaccgcgacccaacccaccccgtcattctcaccaccggcgcctcccccctcctcagatccacgcgcgcccgcgcgcgaccagccgcgatgacggccaagggcggcgcgtcgccggcgccgggcggcgcgggggctgcggccaacgggcgcttcttcaccgtggggctcgtcaccgcctggtactcctccaacatcggcgtgctcctgctcaacaagtacctcctcagcaactacggcttcaagtaccccatcttcctcaccatgtgccacatgtccgcctgcgcgctcttctcctacgccgccatcgcctggctccggatcgtgcccatgcagctcgtgcgctcccgcgtccagctcgccaagatctccgccctcagcctcgtcttctgcggctccgtcgtctccggcaacgtctcgctccgctacctgcccgtctccttcaaccaggccgtcggtgccaccacccctttcttcaccgccgtattcgcctacatcatgaccgtcaagcgggagtcgtggatcacgtacctcactctcgtccccgtcgtcaccggcgtcgtcatcgccagcggcggcgagcctagctttcatctgtttggattcatcatgtgcattggagccactgccgcaagggcgttgaagaccgtgttgcaaggaattcttctgtcgtctgagggggagaagcttaattctatgaacctgctcttgtacatggctccgattgctgtcattctcttgcttcctgctaccctctttatggaggataatgttgttggcgttacaatagaactggccaaaaaggatttcaccattgtttggttgctgttgttcaactcttgcttgtcatattttgtcaatttgaccaatttcttggtgaccaaacatactagcgcattgactctgcaggtccttggaaatgcaaaaggtgctgtggcagttgtcgtctcaattctgatattcaagaatcctgtgtctgtaaccggaatgcttggttacaccctcacagttataggcgtcattctttacagtgaatccaaaaagcgtagcaaaccctaagttccccagaaaaccgtacatatggccgtcctttctcagtccggtcggtgcccagagctaatatatgacggggaactacatccggggcgattgcaacagattctgtgctgtatgtaggccggatgacaaggacagagaagtccaataatacctgtagttttcccttggatcgcagaggcactttgttttgctaatggaaatgatcaatagaatacaattttttgtgtttagagaattgtgagctgtggctcacactgccagcattggttgatacgcttagttttcggaaattgttttccgttattcatcagttattgtaagttcatgactccagttctcttcttttgaagattgcatgtaccaaactttgccaaagaacctcctaatatattatgacactgaatttgttgaaaaaaaaaa

SEQ ID NO: 832 - DNA, 873 bp, Brachypodium distachyon
acgccgtcccaccgaccgaccggccggccgttattagccgccgaggtgcgtgcgtgtcctgcaccgaggccggaacatcgatcgatattcgccatggccccgacgaccgtcgtcgccgcaccagccacgggcgccgtcgcctcgagcgtcgacgtcgggaaggccgctgcgccggggcgctccgtcgggctcgggctccccgcgctgccgccgctgccggggctcgcggcccacgcccagccccgcgtcgcctccttctgcaagaggttcgcgaggaacgtggtggccatggccgccggggagccggcagcgccgctcgcggacaacgccgagctcacagagttcatcaacgccttgaaacaggagtgggacagggtggaggacaagtacgcggtgaccacgctcgccgttgccgccacgcttggcatgtggagcgccggcggagtagtgtcggcaatcgatcggctccccgtggttccaggtctcatggaggccgtcggtatcggttacagtgggtggtttgcgtacaagaacctgctattcaagcccgacaggaaagcgttctttgccaaggtcaggaacatctacgaggatataatcagcggatagacacgacgaagtacttgcgcatgcaagcgcttatatatatccccaccgagagaaggacgatttcagggacacaaattactgttatctgtagtgtatatttcagcatagcatctgatacaatccatcagacattgtatatctatatgaattggacattaacgatatgaatagcatttcatctttttagtccccgtgtctagaattctatattgagttaattttcttctatggtttttctcatcataattatctcatttttccatg

SEQ ID NO: 833 - DNA, 750 bp, Pseudoroegneria spicata
aagcgcttaaagcgcaagtggtggtggtgagacgtgcactgaccgaaggcatcgatctccatggccccgaccgtcgccaccccagccacgggagccgtcgcctcgccgatcgcgagcgacgtcgggaaggccgcgcgctccgtcgggctcgggctccccgcgctgccgccgctgcccggcctcgcgtcccacggccagccccgcgtcgcctccttctgcaaaaggctcgcgaggaacgtggtgtcaatggccgccggtgagccggcggcaccgctggccgacaacgccgagcttaccgagttcttcaactccttgaaacaagagtgggacagggtggaggacaagtatgcggtgaccacgctcgccgtcgccgccacgctcggcatgtggagcgccggcggagtagtatcggcaatcgacaggctccccgtggttccaggtctcatggaggtcgttggcattggctacagcgggtggtttgcgtacaagaacctgatattcaagcccgacaggaaagcgttcttcgctaaggtcaggaacatttacgaggatataatcagcggctagacgatgaaatacttgaagacgcgcatcccaattgagagaagcacaaagtactcaaaacggagacgtgcagttactgtatatctgtactatatatttgagcatagcatctaatacaatccttactcaatgtatatctaaataagttggacatattgacgaaaaacttttgatgtgtttagagca

SEQ ID NO: 834 - DNA, 744 bp, Triticum aestivum
cgagcaagtggtggtggaggtgaggcgtacactgaccgaaggcatcgatctccatggccccgaccgtcgcctccccagccacgggcgccgtcgcctcgcccatcgcgagcgacctcgggaaggccgcgcgctccgtcgggctcgggctccccgcgctgccgccgctgcccggcctcgcgtcccacggccagccccgcgtcgcgtccttctgcaaaaggctagcgaggaacgtggtgtcaatggccgccggtgagccggcggcgccgctggccgacaacgccgagcttaccgagttcttcaacggcttgaaacaagagtgggacagggtggaggacaagtacgcggtgaccacgcttgccgtcgccgccaccctcggcatgtggagcgccggcggagtagtatcggcaatcgacaggctccccgtggttccaggtctcatggaggtcgttggcattggctacagcgggtggtttgcgtacaagaacctgctattcaagcccgacaggaaagcgttcttcgccaaggtcaggaacatttacgaggatataatcagcggctagacgatgaagcacttgaagaggcgcatcccaattgagagaagcacaaagtactcaaaacggagacgtgcaattactgtatatctgtactgtatatttgagcatagcatctaatataatccttactcaatgtatatctaaataagttggacatattgacgcaaaaaaacttttgatgtgtttagcc

SEQ ID NO: 835 - DNA, 868 bp, Triticum aestivum
  misc_feature (856)..(856): n is a, c, g, or t
ccacgcgtccggttataactttgcgcgcctgaacccggacgtccctaacctcccgaaggacgccgtcccggagacctcggcggtcgttattagcatccgaccaacgcgcttaacgcgcaagtggtggtggtggtgaggcgtacactgaccgaaggcatcgatctccatggccccgaccgtcgcctccccagccacgggcgccgtcccctcgccgatcgcgagcgacctcgggaaggccgcgcgctccgtcgggctcgggctccccgcgctgccgccgctgcccggcctcgcgtcccacggccagccccgcgtcgcctccttctgtaaaaggctcgcgaggaacgtggtgtcaatggccgccggtgagccggccgcgccgctggccgacaacgccgagcttacagagttcttcaacggcttgaaacaagagtgggacagagtggaggacaagtacgcggtgaccacgctcgccgtcgccgccacgctcggcatgtggagcgccggcggagtagtatcggcaatcgacaggctccccgtggttccaggtctcatggaggtcgttggcattggttacagcgggtggtttgcgtacaagaacctgctattcaagcccgacaggaaagcgttcttcgctaaggtcaggaacatttacgaggatataatcagcggctagacgatgaagcacttgaaaaggtgcatcccagttgagagaagcacaaagtactcaaaacggagacgtgcaattactgtatatctgtactatatatttgagcatagcatctaatataatccttactcaattgtatatctaaataagttggacatattgacgcaaaaaacttttgatgtgtttagncaccatctccca

SEQ ID NO: 836 - DNA, 931 bp, Hordeum vulgare
cagcctgagccaaacagggcccatttccctatcctcccacggcctctttccactactaccaccgagccaccatcccctacaaggggagggcagagaacacacattcactttgttgcttcaggttgcaacagctaaattaggctacaatggctctgaggctgtgggcgagctcagctgccaatgccctcaagatttcaagcagcggcgccagggccgctgcccccgcctactcgatctccagatacttctccactgttattgatggcttgaagtacacttcctcccacgagtgggtcaagaacgacggctccgtggccacgattggcatcagtgaccacgcccagggccatctcggggaggtggtgttcgtggagctgccggaggccggcacgaaggtgagccagggcggagccttcggcaacgtggagagtgtgaaggccaccagcgacgtcaactcgcccatctccggcgaggtcgtcgaggtcaactcgaagctgtccgaggcccccggcctgatcaactcgagcccgtacgaggaggggtggatgatcaaggtgaagccgagcagccccgcggagctggagggcctgctggactcggccaagtacaccaagcactgcgaggaggaggacgcccactagggcttcttgctcggttatcattccttttgttgcaaccatgtcgactactcttatctacaataattaaaccagctttaccatgcgttcagttcatcggttccagtttttcttgtgtttgtgtacatggtgcgcgagccacgcacagatccaccggcttgttataccatttcagtaaccatgacaaaagagaagcatgtgcagggaaatgcactttggttcttgcaggttgtatatgcacttcatataaaaaaaaatcaaaatagtttaaaatatatttttggattaaaaag

SEQ ID NO: 837 - DNA, 726 bp, Brachypodium distachyon
gattcccatttccctatcctcccactactacttccaccaccaagctactatcatctcctgcaaggtggacacagaacacagatacaccctctcgtcgcgtaggttacaagcattggcacagctagaataatggctctgaggctgtgggcgagctcagctgccaatgccctcaaaatttccagcagtggagccagggccgctgcacctgcctactctatctccagatacttctccactgtgctcgatggcttgaagtacagttcctcacacgagtgggtcaagaacgagggcaccgtggccacaattggcatcagtgaccatgcccagggacatctcggggaggtggtgttcgtggagctgccggaggccggcacgaaggtgacccagggcggagcgttcggcaacgtggagagcgtgaaggccaccagcgacgtgaactcgcccatctccggcgaggtcgtcgaggtcaacgaaaagctctccgggactcccggcctgatcaacacgagcccgtacgaggatgggtggatgatcaaggtgaagccgagcagcccgtcggagctggacgccctgctggacccggccaagtacaccaagcactgcgaggaggaagacgctcactagtgcctcttttgttctcttgaaatcatttttaactttgtggcaaacaactctaccgctctatatatcttcagtgaataaaccaacatcaccatccgttcggtt

SEQ ID NO: 838 - DNA, 802 bp, Festuca arundinacea
  misc_feature (458)..(458): n is a, c, g, or t
ggcacgaggatcctctccaccactactaccaccgagccactatcccctacaaggagagggcaaagaagaacgcatatacactttgttgcttcggttgcaaggttgcaacagctaatcaagctacaatggctctgaggctgtgggcgagctcagctgccaatgccctcaagatctcgagcagtggagccaaggctgctgcccctgcctattctatctccagatacttctccactgttctggatggcttgaagtacacttcctcccatgagtgggtcaagaacgatggctccgtggccacaattggcatcagtgaccatgcccagggtcatctcggggaggtggtgttcgtggagctgccggaggccggcacgaaggtgagccagggcggcgccttcggcaacgtggagagtgtgaaagccaccagcgacgtgaactcgcccatctccggcgaggtcgtngaggtcaatgcaaaactgtccgagactcccggcctgatcaactcgagcccgtacgaggatgggtggatgatcaaggtgaagccgagcagcccgacggagctggacgccctgctcgactcggccaagtacaccaagcactgcgaggaggaggacgcccactagtgcctttcctttttgtttgtttcaaatcctcttctcgttgtcgcaaacatacctactactgctgctctgtctagagcaaataaaccaggcttaccatgcgttcagttcgccgtcagctgttctacttgctgtctcggtgtacaaggcgtgccatgcacgagtacaatgttagagcatctcca

SEQ ID NO: 839 - DNA, 528 bp, Lolium multiflorum
cccctacaaggagagggcaaagaacacatatacaccttgttgcttttgtcacaaggttgcaacagctaatcaagctacaatggctctgaggctgtgggcgagctcagctgccaatgccctcaagatctcaagcagtggagccagggctgctgcccctgcctattctatctccagatacttctccactgttctggatggcttgaagtacacttcctcccatgagtgggtcaagaacgatggcgccgtggccacaattggcatcagtgaccatgcccagagccatctcggggaggtggtgttcgtggagctgccggaggccggcacgaaggtgagccagggcggcgccttcgggaacgtggagagtgtgaaggccaccagcgacgtgaactcgcccatctccggcgaggtcgtcgaggtcaatgctaagctgtccgagactcccggcctgatcaactcgagcccgtacgaggacgggtggatgatcaaggtgaagccgagcagcccgacggagctggacgcgctgctgga

SEQ ID NO: 840 - DNA, 853 bp, Zea mays
acacccccaccatagaaaccatatccccccacacacacctttgtttctgaattctgagccagacaatcaaaagctaccccctatccgatccaaccctctctggctgctcctccgtccggccggcatcggcagtgcaggatggctctgaggatgtgggcgagctcagccgccaatgcgctcaagctctcggcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtcgccgcgggaggacccttcggcaacgtggagagtgtcaaggccaccagcgacgtcaactccccgatctccggcgaggtcgtcgaggtcaatgccaaactgtcagagacgcccggcctgatcaacacgagcccgtacgaggacgggtggatgatcaaagtgaagccgagcagcccgggggaggcggacgccctgctggacgccgccaagtacaccaagcactgcgaggaggaagacgctcactagacccaggcccagccagcaagcgtggatgcttaccgcgacagcgcgcgtttggtggtgttgatcctccgctcagtctctctttgttgcaaaaactccaccaagcagtccgccatagccaagaaggccacactcacctttatcatccatgccttccgtttttttttggtgtgtgctactaccttttttttaaaagaaaagaagtggttctgaatatcgatcg

SEQ ID NO: 841 - DNA, 597 bp, Zea mays
gttgctacaggatgcatcagccaaattaggatacaatggctcttaggctgtgggcaagctgaacagccaatgccctcaagatttcaagcagcggcgccagggctgctgccccggcttattcgatctccagatacttctccaccggtattgatggaatgaagtacacttcctcccacgagtgggtcaagaactacggctccgtggccacaattggcatcagtgaccacgcccagggccatctcggggaggtggtgttcgaggaactgccggaggcaggcaacaaggtgagccagggcggacccttcggcaacgtggagagtgtgaaggccaccaacgaacgtcaactcgcccatctccagagaggtcaactacgtcaactcaaagctgtcagagacccccggcctgatcaactcgagcccgtacgaggatgggtggatgatcaaggcgaacccaagcaacccggcggagctggagggcctgctagactcggccaagtacaccaaacactgccaggacgaggacccccactagtgctccttgctcgcttatcattcctttttgtgggaacaatatcgactactcttgtctacaataatg

SEQ ID NO: 842 - DNA, 778 bp, Pseudoroegneria spicata
cacggcctctttccactactaccaccgagccaccatcccctacaaggagagggcagagaacacacatccactttgttgcttcaggttgcaacagctaaattaggctacaatggctctgaggctgtgggcgagctcagctgccaatgccctcaagatttcaagcagcggcgccagggccgctgccccggcctactctatctccagatacttctccaccgttcttgatggcctgaagtacacttcctctcacgagtgggtcaagaacgacggctccgtggccacgattggcatcagtgaccatgcccagggccatctcggggaggtggtgttcgtggagctgccggaggcaggcacgaaggtgagccagggcggagccttcggcaacgtggagagtgtgaaagccaccagcgacgtcaactcgcccatctccggcgaggtcgtcgaggtcaactcgaagctgtccgagacccccggcctgatcaactcgagcccgtacgaggaggggtggatgatcaaggtgaagccgagcagcccggcggagctggagggcctgctggactcggccaagtacaccaagcactgcgaggaggaggacgcccactagtgctcccttgttcgcttatcaatccttttgttgcaagcatatcgactacgcttatctacaataattaaaccagttttaccatgcgttcagttcatcggttccagttttacgcacaggtccaccgttttgttataccatttcagtgaccgtgacacaagagaagcatgttcaaca

SEQ ID NO: 843 - DNA, 762 bp, Secale cereale
  misc_feature (34)..(34): n is a, c, g, or t
  misc_feature (41)..(41): n is a, c, g, or t
  misc_feature (181)..(181): n is a, c, g, or t
  misc_feature (187)..(187): n is a, c, g, or t
  misc_feature (250)..(250): n is a, c, g, or t
  misc_feature (554)..(554): n is a, c, g, or t
  misc_feature (590)..(590): n is a, c, g, or t
cacacattcactttgttgcttcaggttgcaacanctaaatnaggctacaatggctctgaggctgtgggcaagctcagctgccaatgcactcaagatttcaagcagcggcgccagggctgctgccccagcttattcgatctccagatacttctccactgttcttgatggcttgaagtacacntcctcncacgagtgggtcaagaacgacggctccgtggccacaattggcatcagtgaccatgcccagggncatctcggggaggtggtgttcgtggagctgccggagaccggcacgaaggtgagccagggcgggccttcggcaacgtggagagtgtgaaggccaccagcgacgtcaactcgcccatctccggcgaggtcgtcgaggtcaactcgaagctgtccgagacccccggcctgatcaacacgagcccgtacgaggaggggtggatgatcaaggtgaagccgagcagcccggcggagctggagggcctgctggactcggccaagtacaccaagcactgcgaggaggaggacgcccactagtgctcccttgntcgcttatcaatccttttgttgcaaccatatcgacnactcttgtctacaataatcaaaccagctttaccatgcgttcagttcatcggttccagtttttctcttgtcggcgtacatggcgcgcgagcaacgtccagcagtttgttataccatgtgagtgaccgtgacatcgcagatacgggaaagagtttgtaagttagtttgttggta

SEQ ID NO: 844 - DNA, 912 bp, Triticum aestivum
aacaatttccttttccctatcctcccacggcctctttccactactaccaccgagccaccatcccctacaagggagagcagagaacacacattcactttgttgcttcaggttgcaacacctaaattaggctacaatggctctgaggctgtgggcgagctcagctgccaatgccctcaagatttcaagcagcggcgccagggctgctgccccggcctattcgatctccagatacttctccactgttattgatggcttgaagtacacttcctcccacgagtgggtcaagaacgacggctccgtggccacgattggcatcagtgaccacgcccagggccatctcggggaggtggtgttcgtggagctgccggaggccggcacgaaggtgagccagggcggagccttcggcaacgtggagagtgtgaaggccaccagcgacgtcaactcgcccatctccggcgaggtcgtcgaggtcaactcaaagctgtccgagacccccggccttatcaactcgagcccgtacgaggaggggtggatgatcaaggtgaagccgagcagcccggcggagctggagggcctgctggactcggccaagtacaccaagcactgcgaggaggaggacgcccactagtgctccttgctcgattatcgttccttttttgttgcaaccatgtcgactactcttgtctacaataattaaaccagcttcaccatgcgttcagttcatcggttccagttttcttttgtcgttgtacatggcgtccagcagtttgttataccatttcagtgaccgtgacatcagatatatggggaagagtttgtatgttagtttgttggtaaaaacagacattatcatccaccaacagatcatcatgtaactactctaatatggtttatctaagtttgccctttttt

SEQ ID NO: 845 - DNA, 924 bp, Triticum aestivum
ctgagccaaacaatttccttttccctatcctcccacagcctctttccactactaccaccgagccaccatcccctacaaggagagggcaaagaacacacattcactttgttgcttcaggttgcaacagctaaattaggctacaatggctctgaggctgtgggcaagctcagctgccaatgccctcaagatttcaagcagcggcgccagggccgctgccccggcctactcgatctccagatacttctccaccgttattgatggcttgaagtacacttcctcccacgagtgggtcaagaacgacggctccgtggccacgattggcatcagtgaccacgcccagggccatctcggggaggtggtgttcgtggagctgccggagaccggcacgaaggtgagccagggtggggccttcggcaacgtggagagtgtgaaggccaccagcgacgtcaactcgcccatctccggcgaggtcgtcgaggtcaattcgaagctgtccgagaccccgggcctgatcaactcgagcccgtacgaggaggggtggatgatcaaggtgaagccgagcagcccggcggagctggagggcctgctggactcggccaagtacaccaagcactgcgaggaggaggacgcccactagtgctcccttgttcgcttatcaatccttttgctgcaaccatatcgaatactcttgtctacaataattaaaccagcttcaccatgcgttcagttcatcggttccaattttcttgtgtcggtgtacatggcggccagcactttgttataccatttcagtgaccgtgacatcagagatatgggaaagagtttgtaagttatagtgtgttggtaaaaagagacattatcatccaccaacaaatcatcatatataactactctaatatggtttatctaagttttttttagctt

SEQ ID NO: 846 - DNA, 953 bp, Triticum aestivum
cccctcttattttgcccccctcttcctgagccaaacaatccacatttccctatcctcccacggcctctttccactactaccaccgagcaccatcccctacaaggagagggcaaagaacacacattcactttgttgcttcaggttgcaacagccaaattaggctacaatggctcttaggctgtgggcaagctcagctgccaatgccctcaagatttcaagcagcggcgccagggctgctgccccggcttattcgatctccagatacttctccaccgttattgatggcttgaagtacacttcctcccacgagtgggtcaagaacgacggctccgtggccacgattggcatcagtgaccacgcccagggccatctcggggaggtggtgttcgtggagctgccggaggcaggcacgaaggtgagccagggcggagccttcggcaacgtggagagtgtgaaggccaccagcgacgtcaactcgcccatctccggcgaggtcgtcgacgtcaactcaaagctgtccgagacccccggcctgatcaactcgagcccgtacgaggatgggtggatgatcaaggtgaagccaagcagcccggcggagctggagggcctgctggactcggccaagtacaccaagcactgcgaggaggaggacgcccactagtgctccttgctcgcttatcattcctttttgttgcaaccatatcgactactcttgtctacaataattacaccaacttcaccatgcgttcagttcatcggttccaattttcttttgtcggtgtacatggcgtccagcagtttgttataccatttcagtgaccgtgacatcagagatatgggaaagagtttgtatgttagtttgttggtaaaaagagacattatcatccaccaacaaatcatcatataactactctaatatgatttatctaagtttgctctcttattttacctta

SEQ ID NO: 847 - DNA, 914 bp, Hordeum vulgare
ctcccccgggctgaggaattcggacgaggcttccacaacaccccaccctcctcccccctccacgacccgaaccccagcggcggagtcgacgaagaggaggagagcaaggctcgacggacgagggcaagacctccgctctcccggcgatcgcgcgaccaccctcctcaagatggtgctgatgcaggcagatccgttcctgagcgagctgaccaacatgtacgagcggaccacggagaagggctccgtctgggtcaccatgaagcgatcctcgatgaagtgcaaggctaggttgaagaagatggcggacaagggggagctggtggagtaccggtgcctggtccgtgcctccgatggcaagaggaacatctccacctcgctgtctgcaaaggaatatctgaaattccaagcttcatactccctggttcttaaagcccacatgcatgctttgaagaagagggagaggaaggacaggaagaagacggtggaggcagagaagatacctgagaaggaaccgaagaagcagaagaaatcatcttcaaaaaaatccgcagggtccaagtagcgaggtacttgcagaattttaccgatacctttttcgcccacatgtgcggtcaagacgttgtcatccattttacccttaaattcatgtccgcgagatgaagcctgtgaatacctatatagagatgcgtcgtcgcctgacattttttgaagtagcgttttgatctggttgtaagcctcttccggattggcatgggcatgctttcttgaactgctagatcttctgaccaccaaagtctagttcagtttggaatggttcgtcggtttggtggtcttaggcctgtgatgatatgaatgaagaatctgtaacttgattgttggaaaggcaatgctggtgtgcttttgtttcgcgatcc

SEQ ID NO: 848 - DNA, 753 bp, Saccharum officinarum
  misc_feature (28)..(29): n is a, c, g, or t
cctctctctctctcagcgcgacgactannctaccgccgacgccgccgtcgccgccctacggtacggcccaaatcttcgtcggtctcttctccggcgacgagcacccaaagatggtggtcctgcaaccagataggttcctgagcgagctgacgagcatgtacgagcggagcacggagaagggatccgtgtgggtcaccatgaagcgatcgactctcaagagcaaggcacagttgcagaagatggagaagaaggggcaggaggttgagcacaggtgcctcgtccgcgcctctgatggcaagaagagcatctctacctcggtctctctaaaggagtactcaaaatttcaagcttcatacgcaacagttcttaaggcccatatgcatgctctgaagaaaagggagaggaaagacaagaagaaggctgcagatgctgagaaggcaatcgagaccgcacccaagaagcagaagaaagcatcttcaaagaaatcttcggggtccaagtcataagacgctcgcagaactcactgtgtgtctaccgctagactaatcagagtgccgtgaagttttttcttatctggtttttatccgaattcgtgtctgggagatgaaagcctgtgaatacacctatatagagccgtgccatcgatacgcatttttgaaccagagttttgaggtgaatgtgaggcgctgtggtgtcctgattgacattaacgaagagacatgagttttgaacttttaggtgctgtttggttgc

SEQ ID NO: 849 - DNA, 899 bp, Triticum aestivum
cgacccgaaccccagcggcggagccgacgaagaggagagcaaggctcggcggacaaggggaagacctccgctcccccggcgatcgcgaggccaccctcctcaagatggtgctgatgcaggcagatccgttcctgagcgagctgaccaacatgtacgagcggagcacggagaagggctccgtgtgggtcaccatgaagcgatcgtcgatgaagtgtcaggctaggttgaagaagatggcgagtaagggggagcctgtcgagtaccggtgccttgtccgcgcctccgatggcaagaggaacatctccacctcgctgtctgcaaaggagtatctgaaattccaagcttcatatgccctggttcttaaagcccacatgcatgctttgaagaagagggagaggaaggacaggaagaagacggtcgaggcagagaagatacccgagaaggaaccgaagaagcagaagaaatcatcttcgaagaagtctgcagggtctaagtagtgaggtacttgcagaatttaccgagacctttttcgcccacatgtgcggtcaagacgttgtcacctgttttacccttaattcatgtccgcgagatgaagcctgtgaatacctatatagagacgcgtcgtcgcctggcattttgaagcagcgttttgatctggttgtaagcctccctggatggcatgggcatgctttcttgaactgctagatctgaccaccaaaagtcttagttcagtttggaatggttcatcggtttgatggttttaggcctatgatatgaatgaagaatctgtcgcttggttgttggaaaggcaatgctggtgtgtttttgtttcgtatcccatgtcaagtggttgccagaatattgttatttggggttaggtacgtacctccctcctctgc

SEQ ID NO: 850 - DNA, 994 bp, Triticum aestivum
atctcccccgccccgtgatctgccccgtccgtcttcccacaacaccccaccctcccctctccccctcccccgtcttcgacccgaaccccagcggcggagccgacgaagaggaggagaccaaggctcgacggacaaggggaggacctccgctctctcggcgatcgcgagactaccctcctcaagatggtgctgatgcaggcagatccgttcctgagcgagctgaccaacatgtacgagcggagcacggagaagggctccgtgtgggtcaccatgaagcgatcatcgatgaagtgtcaggctaggttgaagaagatggcgagtaagggggagcctgttgagtaccggtgcctggtccgcgcctccgatggcaagaggaacatctccacctcgctgtctgcaaaggagtatctgaaattccaagcttcatatgccctggttcttaaagcccacatgcatgctttgaagaagagggagcggaaggacaggaagaagacggtcgaggcagagaagatacccgagaaggaaccgaagaagcagaagaaatcatcttcgaagaaatccgctgggtctaagtagtgaggtacttgcagaatttactgagacctttttcgcccacatgtgcggtcgagacgttgtcacccgttttacccttaattcatgtccgcgagatgaagcctgtgaatacctatatagagacgcctcgtcgcctggcatttttgaagcagtgttttgttctggttgtaagccccacccttgcctctagaaaaggcatgctttcttgaactgctagatctgacaattgaagcctagtaagtacaatttgcaatggtttctcggtttgatggtgaagaatctgtagctttggttgctggtgtgttttagcttcgtgatctcatgtcaagtggttgcgagaatattgttatttgcgggttaggtatgttgcctaaagaaatggcacacctctctctgcagctgctgaatcaacaacatgcaa

SEQ ID NO: 851 - DNA, 898 bp, Triticum aestivum
  misc_feature (54)..(54): n is a, c, g, or t
  misc_feature (56)..(57): n is a, c, g, or t
  misc_feature (59)..(61): n is a, c, g, or t
  misc_feature (63)..(64): n is a, c, g, or t
  misc_feature (68)..(68): n is a, c, g, or t
  misc_feature (70)..(71): n is a, c, g, or t
  misc_feature (75)..(75): n is a, c, g, or t
  misc_feature (86)..(86): n is a, c, g, or t
ctcgtgccgaattcggcacgagccgtcagatctcccccgccccgtgatctcccncnncnnncnncccncnnctcnccccctccccnatctccgacccgaaccccagcggcggagccgacgaagaggaggagaccaaggctcggcggacaaggggaagacctccgctccctcggcgatcgcgagaccaccctccacaagatggtgctgatgcaggcagatccgttcctgagcgagctgaccaacatgtacgagcggagcacggagaagggctccgtgtgggtcaccatgaagcgatcgtcgatgaagtgtcaggctaggttgaagaagatggcgagtaagggggagcctgttgagtaccggtgcctggtccgcgccaccgatggcaagaggaacatctccacctcgctgtctgcaaaggagtatctgaaattccaagcttcgtatgccctggttcttaaagcccatatgcatgccttgaagaagagggagaggaaggacaggaagaagacggtcgaggcagagaagatacccgagaaggaaccgaagaagcagaagaaatcatcttcgaagaagtccgcagggtctaagtagtgaggtacttacagaattcaccgagtcctttttcgcccacatgtgcggtcaagacgttgtcacccgtttttacccttaattcatgtccgcgagatgaagcctgtgaatacctatatagagacgcgtcttcgcctggcattttttgaagcagcgttttgttctggttgtaagcctcttccagatggcatgggcatgctttcttgaactgctagatctgaccaccaaagtcttggttcagtttggaatggtttgatggttttaggcctatgatgatatgaatgaagaatctgtagcttggttgttggaa

SEQ ID NO: 852 - DNA, 799 bp, Triticum aestivum
cccagcggcggagccgacgaagaggaggagaccaaggctcgacggacaaggggaagacctccgctcccccggcgatcgcgaggccaccctcctcaagatggtgctgatgcaggcagatccgttcctgagcgagctgaccaacatgtacgagcggagcacggagaagggctccgtgtgggtcaccatgaagcgatcgtcgatgaagtgtcaggcgaggttgaagaagatggcgagtaagggggagcctgtcgagtaccggtgcctggtccgcgcctccgatggcaagaggaacatctccacctcgctgtctgcaaaggagtatctgaaattccaagcttcatatgccctggttcttaaagcccacatgcatgctttgaagaagagggagaggaaggacaggaagaagacggtcgaggcagagaagatacccgagaaggaaccgaagaagcagaagaaatcatcttcgaagaagtctgcagggtctaagtagatgaggtacttgcagaatttaccgagacctttttcgcccacatgtgcggtcaagacgttgtcatctgttttacccttgattcatgtccgcgagatgaagcctgtgaatacctaaacctatatagagacgtgtcgtcgcctggcatttgtgaagcagtgttatgttttggttgtaagccccacccttgcctctagaaaaggcatgcttcctgcttgaactgctagatctgacaattgaagcctagtacaatttgcaatggttcatggtttgatggttttaggcctatgatatgaatgatgaagaatctgt

SEQ ID NO: 853 - DNA, 1423 bp, Hordeum vulgare
cacgcgtccggtcactcttcctcgcgctcacatcaaaagagcgagagaacgccccgacgattcagagaaacgccgccaccgcggaccacgcaccactcgacagccgagaatgctcctcctcctcgctttcctcgccgccgccggcgccgccgccttcttcctcttcaagttcgtcaccgccgatggggatttcaccctcttgtcgtgcggccggccgcggcgggacaaagtggacggcaaggttgtgtggataacgggagcgagccgtgggattggggaggttctttcgatgcagtttgcgagtttaggagcaaagctcatactatctgcacgtaacaaggaggagcttgagagagtgaaacataacatcatgagcaagcatccagatagcaaagttgaagtgttacccatggatttatcatctgatgaaaaatctctgaaagaagttgtacattcagcggaatctctcttttccagtgctggcattgactatatgatgcacaatgcagcctttgagcgtccaaaaaggggagccctggaagaaaccgaggaaggtcttaaggctacttttaaggtcaatgtctttggaacaattactttgactcgccttcttgcacccttcatgttggatagagggatgggtcattttgttgtgatgagtagtgcagctggaaaggtgcccacacctggtcaggctctttactctgcttccaaacatgctctcaatgggtactttgcttctctgcgttctgagttatgtacgaaaggcattaaggtcactgttgtctgtcctggacctattgaaacaccagaatcttctggtgcaacttcttcatcacaaaggcattcgtccgagaaacgtgtttcagtggaaagatgtgctgaactgacaatagttgccgcaactcatggactaaaagaagcatggatatcatatcagcctgtgctggctgttatgtacgtggtgcaatacatgccaacaattggatgctggcttatggataaggttggtgcgaagcgagttgatgccgctgcaaagaaaggcaacgcctacagctggaatctcctcttcggtggcaaaaagtcggcttgacgatgaagttgctcattacacctatagttggaatctacaagatgcgagaggacgttggagatgtacatcaaaataactgtttatgtccgtttaatcctataggtgtacttcctctgtacctaaataactgactagttctctccaactacaattatctaggtaagggagtacaagtctatatagattatgaaccttgttaccctttttcatctttatgtgcgacatgaccaatgggaaggcaagcacgccttgtaccgtcacctagtcagtgagtttcaagtattttagaactcaaatacaaatcagccttttgatcttcgcattcccatg

SEQ ID NO: 854 - DNA, 1261 bp, Brachypodium distachyon
gactccaaagagatagcacacaggattcacagccgccaacacgcgccgcggaagagccgagaatgctcctccttctcctctccgcgctcctcgccggcgccggcgccggcctcctcttcaagttcgccacggccgatggggatttcacgctcctatcgcgtcgctcaccgcggcgggagaaagtcgatgggaaggttgtgtggatcacgggagcgagccgtgggattggggaggttctttcaatgcagtttgcgagcttaggagcaaagctgatactatctgcacgtaacaaggaggagcttgagagagtgaaacataacattgtctgcaagcatccagaaagcagagttgaagtgttacccatggatttatcatctgatgaagaatctctgaaagaagttgtacatgcggcggaatctctcttttcaagtgcaggcattgactatatgatacataatgcagcctttgaacgtccaaaaagaggcgctctggaagaaactgaggatggtcttaaggcaacttttaatgtcaatgtatttggaactattactttgactcgccttcttgcaccctcaatgttggacagagggatgggtcattttgttgtgatgagcagtgcagccggaaaggtccccacgcctggtcaggccctttactctgcttccaagcatgctctgaacggctacttcacctctctgcgttctgagttatgtacaaaaggcattaaggtcactgttatctgtcctggaccaattgaaacaccacaatctactggtgcaacctcttcatcgcaaaggcattcttcagagaaacgtgtttcagtggaaagatgtgctgaactgacaatagttgcagcaactcatggactgaaagaagcatggatatcatatcagcctgtgctggctgttatgtacttggtgcaatacatgccaacaattggttactggcttatggacaagattggtgcaaagcgtgtggatgcagccgcaaagaaaggcaacgcctacagtttgaatctcctcttcggtggcaagaagtcggcttgatgaagttgctcattcaccagataggaattcttgataggaattcttaatagtcatatacagtctttctggattatgtaactggttaattttcattacaattgtatatctaaaaggaccaaaggaaagcaaggtggagtacatttcaactcgagcacatgtcagcgttccagcttagtatttccatgcaagaatggatcatccatatattagattat

SEQ ID NO: 855 - DNA, 1264 bp, Leymus cinereus x Leymus triticoides
  misc_feature (4)..(6): n is a, c, g, or t
  misc_feature (33)..(33): n is a, c, g, or t
  misc_feature (43)..(43): n is a, c, g, or t
  misc_feature (62)..(62): n is a, c, g, or t
  misc_feature (140)..(140): n is a, c, g, or t
  misc_feature (152)..(152): n is a, c, g, or t
  misc_feature (186)..(186): n is a, c, g, or t
  misc_feature (194)..(194): n is a, c, g, or t
  misc_feature (206)..(206): n is a, c, g, or t
  misc_feature (224)..(224): n is a, c, g, or t
  misc_feature (230)..(230): n is a, c, g, or t
  misc_feature (305)..(305): n is a, c, g, or t
  misc_feature (344)..(344): n is a, c, g, or t
  misc_feature (413)..(413): n is a, c, g, or t
  misc_feature (801)..(801): n is a, c, g, or t
  misc_feature (807)..(807): n is a, c, g, or t
  misc_feature (920)..(920): n is a, c, g, or t
  misc_feature (930)..(930): n is a, c, g, or t
  misc_feature (941)..(941): n is a, c, g, or t
  misc_feature (954)..(954): n is a, c, g, or t
  misc_feature (959)..(959): n is a, c, g, or t
  misc_feature (978)..(978): n is a, c, g, or t
  misc_feature (995)..(995): n is a, c, g, or t
  misc_feature (999)..(999): n is a, c, g, or t
  misc_feature (1002)..(1004): n is a, c, g, or t
  misc_feature (1009)..(1009): n is a, c, g, or t
  misc_feature (1018)..(1018): n is a, c, g, or t
  misc_feature (1029)..(1029): n is a, c, g, or t
  misc_feature (1045)..(1045): n is a, c, g, or t
  misc_feature (1055)..(1056): n is a, c, g, or t
  misc_feature (1103)..(1103): n is a, c, g, or t
  misc_feature (1120)..(1120): n is a, c, g, or t
  misc_feature (1152)..(1152): n is a, c, g, or t
  misc_feature (1169)..(1169): n is a, c, g, or t
  misc_feature (1174)..(1174): n is a, c, g, or t
  misc_feature (1180)..(1180): n is a, c, g, or t
  misc_feature (1200)..(1200): n is a, c, g, or t
ctcnnnagccgagaatgctcctcctcttcgcgntcctcgccgncgccgccgccgccgccttnctcctcttcaagttcgccaccgccgatggggatttcaccctcttgtcgtgcggccggccgcggcgggacaaagtgganggcaaggttgtntggattacgggagcgagccgtgggattggggagnttctttcnatgcagtttgcnagtttaggagcaaagctnatactntctgcacgtaacaaggaggagcttgagagagtgaaacataacatcatcagcaagcatccagatagcaaagttgangtgttacccatggatttatcatctgatgaagaatctctnaaagaagttgtacattcagcggaatcactcttttccagtgcaggcattgactatatgatgcacaatgcngcctttgagcgtccaaaaaggggggccctggaagaaactgaggaaggtcttaaggctacttttcatgtcaatgtctttggaacaattactttgactcgccttcttgcacctttcatgttggacagagggatgggtcattttgttgtgatgagtagtgcagctggaaaggtgcccacacctggtcaggctctttactctgcttccaaacatgctctcaatggctactttgcttctctgcgctctgagttatgtacgaaaggcattaaggtcactgttgtctgtcctggacctattgaaacaccagaatcttctggtgcaacttcttcatcacaaaggcattcatctgagaaacgtgtttcagtggaaagatgtgctgaactgacaatanttgccncaactcatggactaaaagaagcatggatatcatatcagcctgtgctggctgttatgtacgtggtgcaatacatgccaacaattggatactggcttatggacaaggttggtgcnaagcgagtgnatgccgctgcnaagaaaggcaacncctanagttggaatctcctcttcngtggcaaaaagtcggcntgangannnagttnctcattacncctacagttgnaatctcatagagattntgaaatagtnntacacgtctatctatatagattatgaaccttgttaccctttttcatntttatgtgtgaaacgancaacggaaagcaagcactccttcagtgagttnaaagtattttagaactnagatncaagtnagcattccagcttcgcattnccaagaaagaataaatcatgcaagatggactatctttctgtcgaaaaaaaaaaggaaaaaatgc

SEQ ID NO: 856 - DNA, 1223 bp, Pseudoroegneria spicata
cgcaccactcgacagacgagaatgctcctcctcttcgcgctcctcgccggcggcgccgccgccgccttcctcctcttcaagttcgccaccgccgatggggatttcaccctcttgtcgtgcggccggccgcggcgggacaaagtggacggcaaggttgtatggatcacgggagcgagccgtgggattggggaggttctttcgatgcagtttgcgagtttaggagcaaagctcatactatctgcacgtaacaaggaggagcttgagagagtgaaacataacatcatcagcaagcatccagatagcaaagttgaagtgttacccatggatttatcatctgatgaagaatctctgaaagaagttgtacattcagcggaatcactcttttccagtgcaggcattgactatatgatgcacaatgcggcctttgagcgtccaaaaaggggggccctggaagaaactgaggaaggtcttaaggctacttttcatgtcaatgtctttggaacaattactttgactcgccttcttgcacctttcatgttggatagagggatgggtcattttgttgtgatgagtagtgcagctggaaaggtgcccacacctggtcaggctctttactctgcttccaaacatgctctcaatggctactttacttctctgcgttctgagttatgtacgaaaggcattaaggtcactgttgtctgtcctggacctattgaaacaccagaatcttctggtgcaacttcttcatcacaaaggcattcatccgagaaacgtgtttcagtggaaagatgtgctgaactgacaatagttgccgcaactcatggactaaaagaagcatggatatcatatcagcctgtgctggctgttatgtacgtggtgcaatacatgccaacaattggatactggcttatggacaaggttggtgcgaagcgagtggatgccgctgcaaagaaaggcaacgcctacagttggaatctcctctttggtggcaaaaagtcggcctgacgaagaagttgctcattacgcctacagttgtaatctcctcagagattatgaaccttgttaccctttttcatctttatgtgcgaaacgaccaacgggaagcaagcactccttgtaatgtcacctagtcagcgagttgaagtattttagaactcagatacaagccagcattccagtttcgcatttccacaaaagaataaatcatgaaagttttcctggta

SEQ ID NO: 857 - DNA, 1450 bp, Sorghum bicolor
gcccaccagtcagcgcaaagcaggtcgcccagcgcacgtcgaccccaagaaccccagagaatcgcccgtcagccgtcgccacgctgcgccggggccaagaaatgcttctcctgctcctcatcgctgtcctcaccgccgtcgctgccttcctcctcttcaagttcgccaccgtcgtcgatggggacttgacgctcgtatcccgcggcccgccgcggcgggatagggtggacggcaaggttgtgtggattactggagctagccgcgggattggggaggttcttgcaatgcaatttgcaaatttaggagcaaagctgatactatctgcacgtaccaaggatgagcttgagagagtgaaaaaaaacatcctcagcaagaatccagatagcagagttgaagtgttacccatggatttatcagctggtgaagaatctctaaaagaagtcgtacatgtggcagaatcatttttttctaatgcaggcgttgactatatgatccataatgcagccttcgaacgtcctaaacggggggctctggaagaaagtgaggaaggtcttaaggctactttgaatgtcaatgtctttggaactattactttaactcgccttctagcaccttacatgctggatagaggaacgggacattttgttgtgatgagcagtgctgctggaaaggttcctgctcctggccaggccatttactctgcctccaaacatgctcttaatggatattttgcttctctgcgatctgagttgtgtacaaagggcattaaggtcactgttgtctgccccggaccgattgaaacaccacaatcttctgctgcagcctctcaagtacaaacacattctgctgagaaacgtgagaaacgtgtttcggtggaaaggtgtgttgaacttacaattattgctgctactcatggactgaaagaagcatggatatcatatcagcctgtgttgactgttatgtacttggtgcaatacatgccaacagttggttactggctcatggacaaggttggtgcaaaacggctggatgcggctgcaaagaaagggaacacgtatagttggaatctcattttcggcagcaagaaatcagcatgaccaagttactcgtagctcctagtaccagggtatttctggattcggatggtcacgtgactttatgcttgtaagcaaaaagtttagactgaaaaggaacagagcatctatagaagctatacagtttagtgaaaaactggactcttaactatggcagggtctaggtaatcgtcatttgtcctaggttgctttttaaggatattctagtctctctagatgaaatgctatttgtgtgagccaatggtcaatatgttggttggtataaaggacaactttctgttgatgtatgtttattgaagttgattaatagttgtgggatgaatacacatttcatgattaatatgaaaaaaacttgt

SEQ ID NO: 858 - DNA, 1676 bp, Panicum virgatum
gatcccgtgaacctcagcagaacccaaaagaatcggcggccaagaaaatgctcctcctcatcctcttcgcccttctcgccggcgccgccgccttcctcctcttcatgttcgccaccgtcgtcgatggggacttgacgctcgtgtcgcgcggcccgccgcggcgggagagggtggacggcaaggtcgtgtggattactggagcgagccgcgggattggggaggtccttgcaatgcaatttgcaaacttaggagcaaagctgatactatctgctcgtaacaaggacgagcttgagagagtaaaacaaaacattctcagcaagaatccagatagcagagttgaagtgttacccatggatttatcagctggtgaaaaatctctgaaacaagttgtacatgcggcagaatcactcttttctaatgcaggcgttgactatatgatccataatgctgcctttgaacgtcctaaacggggggcactggaagaaagtgaggaaggtctcaaggctactattaatgtcaatgtcatcggaactattactctaacacgccttcttgcaccttatatgctggatagagggatgggtcattttgttgtgatgagcagtgcggctggaaaggttcctgctcctggtcaggccatttattctgcatccaaacatgctctcaatggatacttcgcctctctgcgttctgagttgtgtacaaaaggcattaagatcactgttgtatgccctggaccaattgaaacaccacaatcttctgcagcagcatcttcggtacaaagtcattcttctgagagacgtgtttcggtggaaagatgtgttgaactgacgatcattgcagcaactcatgggcttaaagaagcatggatatcatatcagcctgtgctgactgttatgtacttggtgcaatacatgccaacgattggttactggcttatggacaaggttggtgcaaaacggctggacgcagctgcaaagaaaggcaacacctatagttggaatctcatttttggcggcaagaagtcagcatgaccaagttgcccgtcacttctgctaccagggatatttcaacactccaagctccacgagtcacttgtatgcttatatacaaaaaaaggttaaactgaaaaggaacagagcatctatagacgggtttagttgaaaaatggactcatgtgttaagtgttatgacacagtgaggtatggttaaagttgaaacatgttgaaccggcattttctttgaaatcaagcacagggtaaatcagcgccggtaatgtcactttgattttcagcatccattcaagaacaccacatcaggatgattgctatacactgaccagacagggttgtccttgaatctatgttccttgtatcacgtctagttgcagtagtctcaaacttttgtttgtcctctgccctcgacttgatccacaaagaacattgttgggcaagtgacaaggcgcatgctatcgctggatgcttgatgtagtgctagaaatcgtgaaggctgtcactctcagttaatggcctatccttggagatttattttttatttttgcctggtgagctgacatgttcatagcagaatacgcgttttcctctcatttcgtgtaaaataattaatctggatgtgaattgtgtttcagaatatataaaggcttataagtttgactc

SEQ ID NO: 859 - DNA, 1297 bp, Triticum aestivum
cgccgccgccacggaccacgcaccgctcgacagccgagaatgctcctccccttcgcgctcctcgccggcgccgccgccggcgccttcctcctcttcaagttcgccaccgccgatggcgatttcaccctcttgtcgtgcggccgggcgcggcgggacaaagtcgaaggcaaggttgtatggattacgggggcgagccgtgggattggggaggttctttcgatgcagtttgcgagtttaggagcaaagctcatactatctgcacgtaacaaggaggagcttgagagagtgaaacgtaacatcatgagcaagcatccagatagcaaaattgaagtattacccatggatttatcatctgatgaagaatctctgaaagaagttgtacattcagcggaatcactcttttccagtgcaggcattgactatatgatgcacaatgcggcctttgagcgtccaaaaaggggggccctggaagaaactgaggaaggtcttaaggctacttttcatgtcaatgtctttggaacaattactttgactcgtcttcttgcacctttcatgttggatagagggatgggtcattttgttgtgatgagtagtgcagctggaaaggtgcccacacctggtcaggctctttactctgcttccaaacatgctctcaatggctactttgcttctctgcgctctgagttatgtacgaaaggcattaaggtcactgttgtctgtcctggacctattgaaacaccagtatcttctggtgcaacttcttcatcacaaaggcattcatccgagaaacgtgtttcagtggaaagatgtgctgaactgacaatagttgccgcaactcatggactaaaagaagcatggatatcatatcagcctgtgctggctgttatgtacgtggtgcaatacatgccaacaattggatgctggattatggacaaggttggtgcaaagcgagtggatgccgctgcaaagaaaggcaacgcctacagttggaatctcctcttcggtggcaaaaagtcggcttgacgatgaagttgttcattacgcctacaggtggaatctcattgagattctgaaagtcatacacatctatctatatagattatgaaccttgttaccctttttcatctttatgtgtgaaatgaccaacgggaagcaagcactccttgtaatgtcacctagtcagcgagttggaagtattttagaactcggatacaagtcagcattccagctttgcatttccacgaaagaataaatcagcaagatggactatttatctgttgtgtttcctgtgtatatc

SEQ ID NO: 860 - DNA, 1344 bp, Triticum aestivum
gcggggacgccaaacaagcacaaccggaaattctccacccagcaactcacacggtcacactccctcgcgctcacatcaaaacagcgagagaacgcgccgccgccgtggaccacgcaccgctcgacagccgataatgctcctcctcttcgcgctcctcgccggcgccggcgccgccgccttcctcctcttcaagttcgccaccgccgacggagatttcaccctcttgtcgtgcggccgggcgcggcgggacaaagtggacggcaaggttgtatggatcacgggagcgagccgtgggattggggaggttctttcgatgcagtttgcgagtttaggagcaaagctcatactatctgcacgtaacaaggaggagcttgagagagtgaaacgtaacatcatcagcaagcatccagatagcaaagttgaagtgttacctatggatttatcatctgatgaagaatctctgaaagaagttgtacattcagcggaatcactcttttccagtgcaggcattgactatatgatgcacaatgcggcctttgagcgtccaaaaaggggggccctggaagaaactgaggaaggtcttaaggctacttttcatgtcaatgtctttggaacaattactttgactcgccttcttgcacctttcatgttggatagagggatgggtcattttgttgtgatgagtagtgcagctggaaaggtgcccacacctggtcaggctctttactctgcttccaaacatgctctcaatggctactttgcttctctgcgctctgagttatgtacgaaaggcattaaggtcactgttgtctgtcctggacctattgaaacaccagtaccttctggtgcaacttcttcatcacaaaggcattcatccgagaaacgtgtttcagtggaaagatgtgctgaactgacaatagttgccgcaactcatggactaaaagaagcatggatatcatatcagcctgtgctggctgttatgtacgtggtgcaatacatgccaacaattggatggtggcttatggacaaggttggtgcgaagcgagtggatgctgctgcaaagaagggcaacgcctacagttggaatctcctcttcggtggcaaaaagtcggcttgacaatgaagttgctcattacgcctacagttggaatctcattgagattctgaaatagtcatacacatctatctatatagattatgaaccttgtcaccctttttcatctttatgtgcgaaatgaccaacgggaagcaagcactccttgtaatgtcacctagtcagcgagttgaagtattttataactcagatacaagtcagcattccagctttgcattccacgaaagaat

SEQ ID NO: 861 - DNA, 1358 bp, Triticum aestivum
tcacatcaaaacagcgagagaacgcgccgccaccacggaccacgcaccgctcgacagccgagaatgctcctcctcttcgcgctcctcgccggcgccgccgccgccgccttcctcgtcttcaagttcgccaccgccgatggggatttcaccctcttgtcgtgcggccggccgcggcgggacaaagtggacggcaaggttgtatggattacgggggcgagccgtgggattggggaggttctttcgatgcagtttgcgagtttaggagcaaagctcatactatctgcacgtaacaaggaggagcttgagagagtgaaacgtaacatcatcagcaagcatccagatagcaaagttgaagtgttacccatggatttatcatctgatgaagaatctctgaaagaagttgtacattcagcggaatcactcttttccagtgcaggcattgactatatgatgcacaatgcggcctttgagcgtccaaaaaggggggccctggaagaaactgaggaaggtcttaaggctacttttcatgtcaatgtctttggaacaattactttgactcgccttcttgcacctttcatgttggatagagggatgggtcattttgttgtgatgagtagtgcagctggaaaggtgcccacacctggccaggctctttactctgcttccaaacatgctctcaatggctactttgcttctctgcgctctgagttatgtacgaaaggcattaaggtcactgttgtctgtcctggacctattgaaacaccagtatcttctggtgcaacttcttcatcacaaaggcattcatccgagaaacgtgtttcagtggaaagatgtgctgaactgacaataattgccgcaactcatggactaaaagaagcatggatatcatatcagcctgtgctggctgttatgtacgtagtgcaatacatgccaacaattggatgctggcttatggacaaggttggtgcaaagcgagtggatgccgctgcaaagaaaggaaacgcctacagttggaatctcctcttcggtggcaaaaagtcggcttgacgatgaagttgctcattacgcctacagttggaatctcattgaggttctgaaatagtcatacacatctatctatagagattatgaaccttgttaccctttttcatctttatgtgcgaaatgaccaacgggaagcaagcactccttgtaatgtcacctagtcagtgagttgaagtattttagaactcaagcactccttgtaatgtcacctagtcagtgagttgaagtattttagaactcggatacaagtcagcattccagcttcgcatttccaaaaagaataaatcatgcaagatggatgactaaaaaaaaaa

SEQ ID NO: 862 - DNA, 1786 bp, Hordeum vulgare
tcgccctcctcctccgcctccccgcgccgcggcggccggcgcgcgccctcctccgtccgctgcgacgcctctcccccggcggcgtccgcgtcggcctccctcgacccggacttcgacaagaaggccttccgccacaacctcacccgcagcgacaactacaaccgcaagggcttcggccacaagaaggagaccctcgagctcatgagccaggagtacaccagcgacgtgataaagacgctcaaggacaacgggaacgagtacacctgggggcccgtgaccgtgaagctggcggaggcctacggcttctgctggggcgtcgagcgcgccgtgcagatcgcctacgaggcgcgcaagcagttccccgaggagcgcatctggatcaccaacgagatcatccacaaccccacggtcaacaagaaattggaggacatgggtgtcaaagatattcctgttaacgctggtattaaggattttgatgttattgaacaaggtgatgttgttgtcttgcctgcatttggagctgctgtggatgagatgtacacgctaaatcagaagaacgtgcaaattgttgatacgacatgcccttgggtttcaaaggtgtggaacatggttgagaagcataagaagggcgactatacttctattattcatggaaagtatgcccatgaagagactgttgccactgcttcttttgctgggaagtacattattgtgaagaatatggtcgaggcaacatatgtatgtgattatatacttggtggccaacttgatgggtctagcgcaactagagaggagttccttgagaaattcaaaaaggctgtttctccaggattcgatcctgatgttgacttggaaaaggtgggcattgcaaatcaaacaacaatgcttaaaggagaaactgaagaaattggaaaacttgttgagaagactatgatgcgtaagtttggagtcgagaatgccaatgaacactttgttgccttcaacactatttgtgatgctacacaggaaagacaagatgcaatgtatcacctagtgaaggaaaaggttgaccttattctggtcattggagggtggaattccagtaatacttctcatttgcaagaaattggagaactcagtggtattccgtcctactggattgacagtgaacaaaggattggaccaggaaacaggattgcctacaagctaaatcacggcgagcttattgaggcggaaaactggctaccagaagggcctatcacaattggagttacttccggtgcctcaactccggacaaggttgtcgaggatacgctacacaaggtatttgagatcaagcgtcaagaagttttgcaggttgcatagattttcagcaaaattggtcaggggataataatagctgatggcctagcaaaggttagtagaaccattgcgcgacctatcgttgtacagtagctaagaatgtaatgctttaggcacatacttctacgaggatgtctgtgctgggatacatatatatgttgtaatgttgtaatcacttgtaccacgaacagttgtgcacttgtatcggctgctatcaccctttgccccttgaaaaattgttttcataggctgattacatagatatcaaccactgggtttgttgttggatagaggtcaaatgcaggactccctgtatatagcaagtgcaagaaatgcagggtttcctgtgtagtatatatattagggtgcaagtccaatttccactctggtatgttcatgtgtcatctgttgtaatagaatttcacttttctccgtattcactttc

SEQ ID NO: 863 - DNA, 2008 bp, Brachypodium distachyon
ccagacgcaccaatccccactccgttccgcgccccggcacttggcgtcgtccgcccactctagcccagctccacacgcccaggtcctccaccgcaagcgatggcgaccatcaccacgcagctccgctccgccctcctctccgcggccgccgcctcctccacctcctcctcatccccgcgccgcagcggccggcgggcgccctcctccgtccgctgcgacgcctctccgcccgcggcgtccgcgtcggcctccctcgacccggacttcgacaagaaggccttccgccacaacctcacacgcagcgacaactacaaccgcaaggggttcggccacaagaaggagaccctcgagctcatgagccaggagttcaccagcgatgtgataaagacgctcaaggacaacgggaacgagtatacatgggggccggtgaccgtgaagctggccgaggcctacggcttctgctggggcgtcgagcgcgccgtgcagatcgcctacgaggcgcgcaagcagttccccgaggagcgcatctggctcacgaacgagatcatccacaaccccacggtcaacaagagactggaggacatgggcgtcaaagatattcctattaacgctggtattaaggattttgatgttattgaacaaggtgatgttgttgtcttgcctgcatttggagctgctgtggaagagatgtacacactaaatgagaagaatgtacagattgttgatacgacatgcccgtgggtttcaaaggtttggaacatggttgaaaagcataagaagggcgactacacctctattattcatggaaagtatgcccatgaagaaactgttgccactgcctcttttgcaggaaagtacatcattgtgaagaatatggtcgaggcaatgtatgtatgtgattatatacttggtggccaacttgatgggtcaagctcaacaagagaggagttccttgagaaattcaaaaaagctgtttctccaggattcgatcctgatgttgacttggaaaaagtgggcattgcaaatcaaacaacaatgcttaaaggagaaacagaagaaattggaaaacttgttgagaaaactatgatgcgtaagttcggagttgagaatgctaatgaacactttgttgccttcaacaccatttgtgatgccacacaggaaagacaagatgcaatgtatcagttagtgaaggacaaagttgaccttattctggtcattggaggatggaactccagtaatacctctcatttgcaagaaattggagaactcagtggaattccatcctactggattgacagtgaacaaaggattggaccaggaaacaggatcagctacaagctaaatcatggtgagcttattgagactgaaaactggctaccagaagggcctatcacaataggagttacttctggtgcctcaactccagacaaggttgttgaggatgcactacacaaagtatttgagatcaagcgtcaagaaattttgcaggttgcataaattttcagcaaaattgatcaagggataatagctgatggcctggcaaaggttagtagaaccattgcacaacctattcttgtacagtagctaagaatgtaatgctttaggcaaatactattacgaggatatctgtgttgggatacatatatgttgtaaacacttgtaccacgaaaagttctatacttgtatcagctgttataactctttgcccccttaaaagaagctgtgataggctgattacataggtatcacccagtgagtttgttgttggatagcactcgagtgcaggattccctgtatatagtaagtgcaagaaacacagggtttcctgtgtatattaagtgtaagtccaatccttatagccacaggtcatctgttgtaatagaatttctccctatccattttctatgtttggtatgctatttcacgtattactactacatcaattagcatgtgttcatgtcagccttgttaaccaaacttgtatgtagaattgtagattattgtagga

SEQ ID NO: 864 - DNA, 1684 bp, Ricinus communis
agattttatttatacatcaaacgggctgagaccaaaccaaagccatttctttcttctcttgcttcagatttctctctcaatctccaaaaacagcctttcactttgtttcttgtcttgaacaaagaaatggcaatctccctacagctctgccgtctctctctccgcactgatctcttttctcgagacaacaactcgtctcctcttcttcgccgtaaacctttctcaattcgatgctctgctgctgctgcttccgacgatgaatcatcttctgcctctgtagctatggactccgattttgatgctaaggtttttaggcataatttgacgagaagcaagaattacaatcgcagaggctttggtcataaagaagaaactcttcaactcatgagccaagaatataccagtgatattattaagactttgaaggagaatgggaatgagtatacttggggaaatgttactgttaaattggctgaagcttatgggttttgttggggtgttgaaagggctgttcagattgcttatgaagctaggaaacaatttcctgatgagaagatttggattactaatgagattattcataaccctactgttaataagcgtttggaagagatgaatgttgaaaatattcctcttgaggaagggaggaaacagtttgaagttgtgaacaatggcgatgttgtgattttgcctgcttttggagctgcagtggatgagatgttgactctgagcaacaaaaatgtacaaattgttgatacaacttgcccttgggtatctaaggtctggaatactgttgagaagcacaagaagggagattatacttcaattattcatggtaaatattctcatgaggaaaccatagctactgcttcttttgctggaacgtatatcattgtcaagaatatgaaggaggcaatgtatgtatgtgattacattcttggtggccaacttaatggatctagctcaaccaaagaggagtttcttaagaaatttaaaaacgcagtatctaagggatttgatccagatgttgacctggttaaggttggtatcgcaaatcaaacaacaatgcttaagggagaaacagaagatattggtaaattggtggagaagaccatgatgcagagatatggtgtggaaaatgtcaatgaccactttattagcttcaacaccatttgtgatgctactcaagaacgacaagacgcaatgtttaatttggtggaggagaagctggatcttatattagtaattggtgggtggaactcaagcaacacttcacacctccaagaaattgctgagctccgtggaattccttcatactggattgacagtgaacagaggattggtccaggaaatagaatagcttataagttgaatcatggggagttggttgagaaagaaaacttcctaccagaaggtcccattacaattggtgtaacatctggtgcctctactccagacaaggttgtggaagatgccctagtcaaggtgttcgacatcaaacgtgaggaagccttgcaactggcataaatttaggttgtggtacaaaatcaactgtgccattttagatatgtataactgagtgtatcatgaacaaaaaaggatctgcaagattgttactatagatatcaaatgtattcaaattcataatgatggcaatagaggaggtggttttaagagctgcaac

SEQ ID NO: 865 - DNA, 1874 bp, Zea mays
gaactcagaaggccgcagggataagagagagcgggtcccgtccgagccgaggcagcccattcgccgtccgccccgcctcttcctgccgccgagcgccacgaggcccacgcccgcgatggcgactatcacgacgccgctccgctccgctctgttctctccggccgcctcgtccgcgggccgccaccgcgggggccggcgccgcgcgccctcctccgtgcgctgcgacgcctccccgccctcgcacgccgcggccgcctcgctcgacccggacttcgacaagaaggcgttccgccacaacctcacgcgcagcgacaactacaaccgcaaggggttcgggcacaagaaggagacgctcgagctcatgagccaggagtacaccagcaacgtcatcaagacgctcaaggagaacggcaaccagtacacctggggccccgtcaccgtgaagctcgcggaggcctacgggttctgctggggcgtcgagcgcgccgtgcagatcgcgtacgaggcgcgcaagcagttccccgaggagcgcatctggctcaccaacgaaatcatccacaaccccaccgtcaacaagaggttggatgagatgggtgtagaaatcattcctgttgacgcgggtatcaaggatttcaatgtcgtcgagcaaggtgatgttgttgtgttgcctgcatttggagctgctgtggaggaaatgtacacgctaaatgagaagaaggtgcagattgttgatacgacatgcccttgggtttcaaaggtctggaatatggtcgaaaaacacaagaagagtgaatatacttcaattattcatggaaagtattcccatgaagaaactgttgccactgcttcttttgcaggaaagtacatcattgtgaagaatatggcagaggcaacctatgtgtgtgattatatacttggtggccaacttgatgggtctagctcaacaaaagaggagttccttgagaaattcaagaaagctgtttctccagggtttgatcctgatgttcatcttgatatggtgggaattgcaaatcaaacaacaatgcttaaaggagaaactgaagaaattgggaagcttattgaaaagacgatgatgcaaaaatatggagttgaaaatgtaaacgatcacttcatggccttcaatactatttgtgatgccactcaggaaagacaagatgctatgtatcagctggtgaaagagaaagttgaccttattcttgttgttggaggatggaattcaagtaacacctctcatctgcaagaaatcggagaactcagtggaattccatcatactggattgacagtgaacaaaggattggaccaggaaacaggatcagctacaagttaaatcatggtgaactggttgagaaaaataactggttacccgaggggcctattaccattggtgttacttcaggtgcctcaactccagataaggttgttgaggatgctcttcagaaggtatttgagatcaagcgtcaggaaattttgcaggttgcataaattttaagcagagatttggtgaagagctgaatagttttggcttggcaaaggttactagaaacgttgcacaggcaaatgtttgtacagtagctaaggatgtaacgagttgggcacgaatactaccacgagtcactatccttgtgctggaatttacagtacggtggaaactaaaatggtgttatcattggtccgaataacatttgcatcagcctttctaaggtctaactttttgccacttaaattgatgtcagggaagacactcagatgtataagttaagaatgcacagttcctacgtgtaaaaagcttagttccagtacttgaactctcatcagttgggacaaaatcgcaataaaacctcgaattgctcta

SEQ ID NO: 866 - DNA, 1906 bp, Pseudoroegneria spicata
  misc_feature (8)..(9): n is a, c, g, or t
agcgcacnntatccccattccgttctctgccgcggcacttggcgttgtccgccccgcagctcagctccacacgcccactcccgccaccacaagcgatggcgaccatcaccacgcagctccgctccgccctcctctccccggccgcctcttcctcctgctcctccccgcgccgcggcggccggcgcgcgccctcctccgtccgctgcgacgcctctcccccggcggcgtccgcgtcggcctccctcgacccggacttcgataagaaggccttccgccacaacctcacccgcagcgacaactacaaccgcaagggcttcggccacaagaaggagaccctcgagctcatgagccaggagtacaccagcgatgtgataaagacgctcaaggacaacgggaacgagtacacctgggggccggtgaccgtgaagctggcggaggcctacggcttctgctggggcgtcgagcgcgccgtgcagatcgcctacgaggcgcgcaagcagttccccgaggagcgcatctggattaccaacgagatcatccacaaccccacggtgaacaagaaattggaggacatgggtgtcaaagatattcctgttaatgctggtattaaggattttgatgttattgaacaaggtgatgtcgttgtcttgcctgcatttggagctgctgtggatgagatgtacacactaaatcagaagaacgtgcaaattgttgatacgacatgcccttgggtttcaaaggtatggaacatggttgagaagcataagaagggcgactatacttctattattcacggaaaatatgcccatgaagagactgttgccactgcttcttttgcagggaagtacattattgtgaagaatatggtcgaggcaacatatgtatgtgattatatactaggtggccaacttgatgggtctagctcaactagagaggagttccttgagaaattcaaaaaggctgtttctccaggattcgatcctgatgttgacttggaaaaggtgggcattgcaaatcaaacaacaatgcttaaaggagaaactgaagaaattggaaaacttgttgagaagactatgatgcgtaagtatggagtcgagaatgccaatgaacactttgttgccttcaacactatttgtgatgccacacaggaaagacaagatgcgatgtatcacctagtgaaggaaaaggttgaccttattctggttattggagggtggaactccagtaatacctctcatttgcaagaaattggagaactcagtggaattccgtcctactggattgacagtgaacaaaggattggaccaggaaacaggattagctacaagctaaatcacggtgagcttattgaggcagaaaactggctaccagaagggcctatcacaattggagttacttccggtgcctcaactccggacaaggtcgtcgaggatacgctacacaaggtgtttgagatcaagcgtcaagaagttttgcaggttgcatagattttaagcaaaattggtcaggggataataatagctgatggcctggcaaaggttagtagaaccattgcgctatctatcgttgtacagtagctaaaaatgtaatgctttaggcacatacttttacgaggatatctgtgctgggatacatatatatgttgtaatcacttgtaccatgaacagttgtacacttgtatcagctgctataaccctttgccccttgaaagattgttttcataggctggttacatagatatcaaccacttggtttgttgttggatagaggtcaaatgaaggactccctgtatatagcaagtgcaagaaatgcagggtttcctgtgtatattagggcgcaagtccaattcccattatgatatgttcatgtgtctatctgttgtaatagaatttaacttttctccgta

SEQ ID NO: 867 - DNA, 1733 bp, Sorghum bicolor
ccacgacgctcgcgaccgcgatggcgaccatcacgacgccgctccgcgccgcgctgctctccccggccgccgcctcgtccgcgggacggcgccgcgggggcgggggccggcgccgcgcgccctcctccgtccgctgcgacgcctccccgccctcgtcctcggccgcctcgttcgacccggacttcgacaagaaggcgttccgacacaacctcacacgcagcgacaactacaaccgcaaggggttcggctacaagaaggagacgctcgagctcatgagccaggagtacaccagcgatgtgatcaagacgctcaaggagaacggcaaccagtacacctggggccccgtcaccgtgaagctcgccgaggcctacggattctgctggggagtcgagcgcgccgtgcagatcgcgtacgaggcgcgcaagcagttccccgaggagcgcatctggctcaccaacgaaatcattcacaaccccaccgttaacaagaggttggatgagatgggtgtagatatcattcctgttgacgcgggtatcaaggatttcaatgtggtcgaacaaggtgatgttgttgtgttgcctgcatttggagctgctgtggaggagatgtacacgctaaatgagaagaaagtgcagattgttgatacgacctgcccttgggtttcaaaggtctggaacatggttgaaaaacacaagaagagcgaatatacttcaattattcacggaaaatattcccatgaagaaactgttgccactgcttcttttgctggaaagtacatcattgtgaagaacatggcagaggcgacctatgtgtgtgattacatacttggtggccaacttgatgggtctagctcaacaaaagaggagttccttgagaaattcaagaaagctgtttctccaggatttgatcctgatgttgatcttgatatgttgggaattgcaaatcaaacaacaatgcttaaaggagaaactgaagaaattgggaaacttgttgaaaagactatgatgcaaaaatatggagttgaaaatgtaaacgatcacttcatggccttcaatactatttgtgatgccactcaggaaagacaagatgctatgtatcagctggtgaaagagaaagttgatcttattcttgttattggaggatggaattcaagtaacacctctcatctgcaagaaattggagaactcagtggaatcccatcctactggattgacagtgaacaaaggattggaccaggaaacatgattagctacaagttaaatcatggtgaacttgttgagaaagagaactggttacccgaggggcctattaccattggtgttacttcaggtgcctcaactccggacaaggttgttgaggatgcccttcagaaggtatttgagatcaagcgtcaggaaattttgcaggttgcataaattttaagcagagatttgtgtaagagcggaatagctttggcttggcaaaggttactagaaccgttgcacaggcaatgtttgtacagtagcaaaggatgtaacggtttaggcacgaatactaccacgaggcactatccttgtgctggaatttacagtctggtggaaacgaaaatgttgttatcattggtctgaataaaagttgcagcagctgttctaaggtctgccctgttgacccttaaattgatgtcagggaagacactcagatgtgtaagtcatggattgagctcggttgcaggatttcctgtgcctatatgctaa

SEQ ID NO: 868 - DNA, 1560 bp, Saccharum officinarum
  misc_feature (640)..(640): n is a, c, g, or t
  misc_feature (870)..(870): n is a, c, g, or t
  misc_feature (1348)..(1348): n is a, c, g, or t
cctcgctcgacccggacttcgacaagaaggcgtttcgccacaacctcacccgcagcgacaactacaaccgcaagggtttcggctacaagaaggagacgctcgagctcatgagccaggagtacaccagcgacgtgatcaagacgctcaaggtgaacggcaaccagtacacctggggccccgtcaccgtgaagctcgcggaggcctacggattctgctggggcgtcgagcgcgccgtgcagatcgcgtacgaggcgcgcaagcagttccctgaggagcgcatctggctcaccaacgaaatcatccacaaccccactgtcaacaagaggttggatgagatgggtgtggaaatcattcctgttgacgcgggtatcaaggatttcaatgtcgtcgaacaaggtgatgttgttgtgttgcctgcatttggagctgctgtggaggagatgtacacgctaaatgagaagaaagtgcagattgttgatacaacctgcccttgggtttcaaaggtctggaacatggtcgaaaagcacaagaagagtgaatatacttcaattattcatggaaaatattcccatgaagaaacagtcgccactgcttcttttgcaggaaagtacatcattgtgaagaatatggcagaggcganctatgtgtgtgattatatacttggtggccaacttgatgggtctagctcaacaaaagaggagttccttgaaaaattcaagaaagctgtttctccaggatttgatcctgatgttgatcttgatatggtgggaattgcaaatcaaacaacaatgcttaaaggagaaactgaagaaattgggaaacttgttgaaaagactatgatgcaaaaatatggagttgaaaatgtaaacnatcacttcatggccttcaatactatttgcgatgccactcaggaaagacaagatgctatgtatcagctggtgaaagagaaagttgaccttattcttgttattggaggatggaattcaagtaacacctctcatttgcaagaaattggagaactcagtggaattccatcctactggattgacagtgaacaaaggattggaccaggaaacatgatcagctacaagttaaatcatggtgaacttgttgagaaagtgaactggttacccgaggggcctattacgattggtgttacttcgggtgcctcaactccggacaaggttgttgaggatgctcttcagaaggtatttgagatcaagcgtcaggaaattttgcaggttgcataaattttaagcagagatttggttaagagcggaatagcttcggcttggcaaaggttactagaaccgttgcacaggcaatgtttgtacagtagcaaagtacntaaccgtttaggcacgaatactaccacgaggcactatccttgtgctggaatttacagtctggtggaaacaaaaatgttgttatcattggtctgaataacagttgcaccagctgttctagtgtctgatagaaaaagtaaaaaaaagaatactaggagaaatacaaactgaactacttcaatggagccctagactatactttatatatgacctg

SEQ ID NO: 869 - DNA, 1658 bp, Panicum virgatum
gtcgctcgacccggacttcgacaagaaggccttccgccacaacctcacccgcagcgacaactacaaccgcaagggcttcggccacaagaaggagacgctcgagctcatgagccaggagtacaccagtgatgtgatcaagacgctcaaggagaacgggaaccagcacacctggggccccgtcaccgtgaagctggcggaggcctacggattctgctggggcgtcgagcgcgccgtgcagatcgcctacgaggcgcgcaagcagttccccgaggagcgcatctggctcaccaacgaaatcatccacaaccccaccgtcaacaagaggttggatgagatgggtgtagaaatcattcctgttgatgcaggcatcaaggatttcaatgttgttgaaaaaggcgatgttgttgtgctacctgcatttggagctgctgtggaggagatgtacacactgaatgataagaaagtgcagatagttgatacaacctgcccttgggtttcaaaggtctggaacacggtcgaaaagcacaagaagagtgaatacacttcaattattcacggaaaatattcccatgaagaaactgtcgccactgcttcttttgcaggaaagtacatcattgtgaagaatatagcagaggcaacctatgtgtgtgattatatacttggtggcaaacttgatgggtctagctcaacaaaagaggctttccttgagaaattcaaaaatgctgtttctccaggatttgatcctgatgttgatcttgataaggtgggcattgcaaatcaaacaacaatgcttaaaggagaaactgaagaaatcgggaaacttgttgagaggactatgatgcaaaggtatggagttgaaaatgtcaatgatcacttcatggccttcctcactatttgtgatgctacccaggaaagacaagatgctatgtatcagctggtgaaggaaaaagttgaccttattctggttgttggaggatggaactccagtaacacctctcatttgcaagaaatcggagaacttagtggaattccatcctactggattgacagtgagcaaaggattggcccaggaaacaggatcagctacaagctaaatcatggtgaacttgttgagaaagagaactggttacccgaggggcctattacaattggtgttacttctggtgcctcaactccggacaaggttgttgaggatgcgcttcagaagatattcgagatcaagcgtcaggaaattttgcaggctgcctgaattctaagcaggaaaagagtgtaatagtgatggcttggcgaaggttagtagaactgttgcacaggcaatgcttgtacagtagataagaatgttacgatttaggcatgtattaccacgaggcactgtgcttgtgctcggatttatcgtctggtgggaagaaattgttggaatcattcgtatggataacagttacatcagttgtaactttttggcccttaaattagtatcagagtaagtgcctcttccatacgaagaaaatctgatgtgtcagttcgtgcattgagctcagatgcaggatttcttgtaccaacacaagtgcagaaacgcggagtccctctgtataataagtttctgtccagtccagtcttgatgtatcatcagatgtaaaagaaattacattgaaacgttc

SEQ ID NO: 870 - DNA, 1938 bp, Triticum aestivum
cctcgtgccgcccattccaaacccagcgcacctatccccatttcgttccccgccgcggcacttggcgtcgtccgccccgcagctcagctccacacgcccgcccactccctccgccgcaagcgatggcgaccatcaccacgcagctccgctccgcgctcctctccccggccgcctcgtcctcgtcctcctcctccccgcgccgcggcggccggcgcgcgccctcctccgtccgctgcgacgcctctcccccggcggcgtccgcgtcggcctccctcgacccggacttcgacaagaaggccttccgccacaacctcacccgcagcgacaactacaaccgcaagggcttcggccacaagaaggagaccctcgagctcatgagccaggagtacaccagcgatgtgataaagacgctcaaggacaacgggaacgagtacacctgggggccggtgaccgtgaagctggcggaggcctacggcttctgctggggcgtcgagcgcgccgtgcagatcgcctacgaggcgcgcaagcagttccccgaggagcgcatctggatcaccaacgagatcatccacaaccccacggtcaacaagaaattggaggacatgggtgtcaaagatattcctgttaatgctggtattaaggattttgatgttattgaacaaggtgatgttgttgtcttgcctgcatttggagctgctgtggatgagatgtacacattaaatgagaagaacgtgcaaattgttgatacgacatgcccttgggtttcaaaggtgtggaacatggttgagaagcataagaagggcgactatacttctattattcacggaaaatatgcccatgaagagactgttgccactgcttcttttgcagggaagtacattattgtgaagaatatggtcgaggcaacatatgtatgtgattatatacttggtggccaacttgatgggtctagctcaactagagaggagttccttgagaaattcaaaaaggctgtttctccaggattcgatcctgatgttgacttggaaaaggtgggcattgcaaatcaaacaacaatgcttaaaggagaaactgaacaaattggaaaacttgttgagaagactatgatgcgtaagtatggagtcgagaatgccaatgaacactttgttgcattcaacactatttgtgatgccacacaggaaagacaggatgcgatgtatcacctagtgaaggaaaaggttgaccttattctggttattggagggtggaactccagtaatacctctcatttgcaagaaattggagaactcagtggaattccgtcctactggattgacagtgaacaaaggattggaccaggaaacaggattagctacaagctaaatcacggtgagcttattgaggcagaaaactggctaccagaagggcctatcacaattggagttacttctggtgcctcaaccccggacaaggttgttgaggatacgctacacaaggtgtttgacattaagcgtcaagaagttttgcaggttgcatagattttcagcaaaattggccaggggataataatagttgatggcctggcaaaggttagtagaacaattgtgcgacctatcgttgtacagtagctaagaatgtaatgctttaggcacatacttttacgaggatatctgtgctgggatacatatatatgttgtaatcacttgtaccacgaacagtagtacacttgtatcagctgctataacccctggccccttgaaaaatcgttttcataggctggttacatagatatcaaccactgggtttgttgctggatagggctcaaatgcaggactccctgtatgtagcaagtgcaagaaatgcagggtttcctttgtatattagggcgcaagtccaattcccattctgatatgttcatgtgtcatctgttgtaattgaatttaacttttctccgtattc

SEQ ID NO: 871 - DNA, 821 bp, Musa acuminata
ggggtcggtggaatccaagaaataagggccaaccaaatccccatccccatcgccgtcgcctgttcttcctcttcgtcttcgctcagaggagtctgttttcttgataggagctagaagatggattccaacaggcgtcagagtggaattcagcaattgttggctgcagagcaggaagcacaacgcattgtcaatgaggctagaaatgccaaaatggcaaggctgaagcaggctaaagaagaagcagataaggagattgctgcatatcgggcacaaatggaagccgagtttcagaagaaggttgctcagagcagtggagattctggtgcaaatgttaagcggcttgagctagaaactgaggaaaagatccagcacctcaagtcacaggcagccaatatttccgaggatgtgggtcaaatgcttttgaagcatgtgaccaccgtgaagaattaggcaccatcaccacaaaaaaaagaaaaaggacagtaaatggataaataagattttgaaccctgattggtctgtcaactgaacatccatttgtgcacgcacgatgctgtgtttgttgtttccttgaataagatagatgcctttgtggttgtatcgaggcgcctgtaccactgcggaggtatatcctaataccgactatttcttttcttttgtttatttgatacgagggaagagtagtctttgtttggaagaacaaatggcaataatttttttttttttgcttgatttaagtggatacgatctgcgtatatacagcagagcgtttgatgatgttgactgaggtatttgattgcttgtttattcgttgaagtgaa

SEQ ID NO: 872 - DNA, 637 bp, Musa acuminata
  misc_feature (68)..(68): n is a, c, g, or t
  misc_feature (601)..(601): n is a, c, g, or t
  misc_feature (624)..(624): n is a, c, g, or t
ggagggcacgtctcctgtgtcatcgggttggtggaagccgggaatctcgccctctcccccatcttccncttcgccccaggaggtactagaagatggattccagcaggcgtcagagtggaatccaacaattgttggctgcagagcaggaagcacagcgaattgtcaatgaggctaggaatgctaaaatggcaaggttgaagcaggctaaagaagaagctgacaaggagattgccgcatatcgtgcacaaatggaagcggagttccagaggaaggttgctcagagcagcggagattctggtgcaaatgtaaagcgccttgagctagaaaccgaagagaagatccagcacctgaagtcacaggcagcaaatatctcccaggatgtggttcaaatgcttttgaagcatgtgaccaccgtgaagaattagggatcatctcgtgagatcaacgccatcaaataattttgaacacccaattggtcagttgagtccaaacttttatctgtaagcatacgatgcagtatttgtggttccttgaattagccgccgcttttgtacttcaccgtttacattatccgcatggagtttatgcgcactgaggtgtnatcctttgataaagtatggaacnttcgcgaaaaaaa

SEQ ID NO: 873 - DNA, 1259 bp, Hordeum vulgare
aagcagtggtatcaacgcagagtgtccattatggcaggggttgaaaggtcggggccacgacggcgagaggagcagcagaggattagcttttccccacggatccttctcgtcttccacgtgattcgagtcgcctctctccgtcagcccaaacatggacgcaagcaggcgcccaagtggaatccagcaattgcttgctgcagagcaagatgctcagcaaattgtaaatgctgccagggctgctaaaacggcaaggcttaggaaagcaaaagaagaggcggagagagagatagctgagtaccgtgcgcagatggaggctgatttccagagaaagctcaccgagaccagcggtgactctggtgcaaatgtcaaacgccttgagcaagagacaaacgtaaaaattgaacagctcaagcagcaggcagcaaacatctccccagaggtgattcagatgcttctgaggcacgtcaccactgtgaagaactaaaggttgatgagtcggccctgcatattatgatgacaactttgtactatctgtttatttctttgggaggtgttataagaaatggcttttgccacttccagctgtaattccttgttctttgtcttggaaataagctgctacagttgagcagcagccatgtctgatactacttgctaaacctttggtgattagttcgtaaattttgtcgatttaaaccctttttgtctctcccttgtatggctaccagtatatgtattttttatgtgagatgtatcattcataagagtaaataagttttaaatccatggtgaactttgagcggccgctcatataattaccccaaaagaagcatccacacagacatacaaaacaacaccaaagcagcatccagttgagctgctggcgaagataaggtggggaaggcaagagccaacagaaagctcaacaatggagacaaggactaacaataaccggggcctttgatgggtttgtggccttcataacaggaagctctactctaagttgtaaccatgtgtgttgcttgcctaactgtaacaactcaaactaccttggatgtttgtaatcgacgaggttgagttgtgacgcaccagtagcttaatatactgcactatctatcatgctgctgatgcatcctcgtgtttccacatggcaatgaatcctagaaccccagtgacagaagagcatcacaaatactagtgtagtttggaccaaattaacaatatattgttaaggaaatactactagtgtagttggagca

SEQ ID NO: 874 - DNA, 691 bp, Brachypodium distachyon
acctggatttcgccactaataaatcagcttcaaactcggggccacgaccacgactccacgagaaagatatcttttccccatcgggtccttctcgtcttccacgtgattgcagtcggctctcctgctgctgctcaaagatggatgcgaacaggcgccaaagtggaattcagcaattgctggctgcagaacaggaggctcagcaaattgtaaatgctgctagggctgctaaacttgcaaggcttaggcaagcaaaagaggaggctgagagggaaatagctgaataccgtgcccagatggaggctgacttccagaggaagcttgcagagagcagcggtgactctggcgcaaacgtcaaacgtcttgagcaagagacaaacgaaaaaattgcacaactcaagcagcaggccgcaaccatctcccctgaggtgattcaaatgcttctgaggcatgtcaccactgtgaagaactaaagcttgacgggcaatgtgtcctgcatacgaatgtgaacttgtattatctgtttatttatttgggaggtgtgataagaaatggtatctgccacttccagctgtaatttattgtcctttatcttagaataagctgctgcagtttcagcagcagccatgtctgatactacttgctaaaccttcggtgattagttggtattattctttttgtcgattcccgctct

SEQ ID NO: 875 - DNA, 703 bp, Brachypodium distachyon
atgctttgagatcagtcataagatcgtcctcctcctcgcgcgagcgccgcgacgactacccatcccgctgccgagcgccccagccccctcgttccgtcgctcgtcttcctgctcgggcaagcgccgccgccagctgcccaaagatggatgcgaacaggcgccaaagtggaattcagcaattgctggctgcagaacaggaggctcagcaaattgtaaatgctgctagggctgctaaacttgcaaggcttaggcaagcaaaagaggaggctgagagggaaatagctgaataccgtgcccagatggaggctgagttccagaggaaggttgcagagagtagtggtgactctggcgcaaatgtcaaacgtcttgagcaagagacgaacgaaaaaattgcacaactcaagcagcaggctgcaaccatctcccccgaggtgattcaaatgcttctgaggcatgtcaccactgtgaagaactaaagctctctgtgcaatctgtcctgcatacgaatgcaaactttgtattatctgtttatttatttgggaggtgtgataagaaatggcatttgccacttccagctgtaatttcttgatctttatctttcaataagctgctgcagtttcagcagcagccatgtctgatactacttgctagacctttggtgattggttggtattctttttctcgatttcgattcttgccatgg

SEQ ID NO: 876 - DNA, 805 bp, Cenchrus ciliaris
cctcaacctctcggtcgcggccgctccaccaccaccgccctccgctccgccgccgcccccgcccgatccacatccacccccgcccgatccgcatccaggtaccgctcgcgccgagatccctccctccctccgcgcctcctctcccccctcctcccggatccgtcgccgcggtgtcgagatccggccggtccgcacgaagatcgcccgtcccgtcccggcggatcggttcgtgggaaacctgagagatggacgcgagcaggcgccagagcgggattcagcagctgctggctgcggagcaggaggctcagcagatcgtcaatgccgctagggctgctaagtcggcaaggcttaggcaagctaaagaggaggctcagagggaaatagatgaatatcgtaagcagatggagaacgagtttcagaggaaggttgcagagagcagcggtgactctggtgcaaatgtcaagcgtctcgagcaagagacagcggcaaagatcgagcagctcaaccaacaggctgcaaacatctccccagaagtcattcagatgctactgaggcatgtcaccaccgtgaagaactaagcgcttctgtgcccaaaaatatgtttgcaagcttgtatcatctgtatttattattttggagagtcgtggtgagaaataatttgtggcttttggctgtaattccttgttcttgaccacggaataagctgctgcagtagagcagcaactgtgcctggtactatcagaacttgcccattgtttggtatattggtaaatattttcctcctgttcgaattttgaacatacta

SEQ ID NO: 877 - DNA, 644 bp, Festuca arundinacea
  misc_feature (95)..(95): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (374)..(374): n is a, c, g, or t
  misc_feature (383)..(383): n is a, c, g, or t
  misc_feature (386)..(386): n is a, c, g, or t
  misc_feature (404)..(404): n is a, c, g, or t
  misc_feature (439)..(439): n is a, c, g, or t
  misc_feature (448)..(448): n is a, c, g, or t
  misc_feature (451)..(451): n is a, c, g, or t
  misc_feature (453)..(453): n is a, c, g, or t
  misc_feature (469)..(469): n is a, c, g, or t
  misc_feature (473)..(473): n is a, c, g, or t
  misc_feature (480)..(480): n is a, c, g, or t
  misc_feature (490)..(490): n is a, c, g, or t
  misc_feature (604)..(604): n is a, c, g, or t
ggcacgagggaggattagcttttccccatcgaatcgttctcgtctcgtctcgtctcgtcgtcctccacgtgaattcctgtcgcctctccgccagnccaaagatggacgcaagcaggcgcccaagcggaattcagcaattgctggctgcagagcaagaggctcagcaaattatcagtactgctagggctgctaaatcggcaaggcttaggcaagcaaaggaagaggctgagagagaaatagccgagtaccgtgcgcagatggaggctgatttccagaagaagcttgcagagactagcggtgattctggcgcaaacgtcaagcgccttgagcaggagacaaacgaaaanatngaacanctcaagcagcaggcagcnagcatctcnccngaggtgattcagatgctnctgaggcacgtcaccactgtgaagaactaaaggtngatgtgcantcngncctgcatatgatggcnaacntgtattntctgtttatntatttggaaggtgtgataagaattggcttttgccacttccagctgtaattccttgtttattgtattcgaataagctgctgcagctcagcagcaaccatgtctgatactacttgntaaacatttggtcattagttggtaaattttgtggagttcc

SEQ ID NO: 878 - DNA, 778 bp, Actinidia deliciosa
gttttggctctggttctggtctaatgttttcatttgacagattcgttcatattttctcatcaatcaaaacacaacacaactcagtgattcagttgacctaactccgcttcaatagtgcagctgctttagtaattttcagaaagtatggaagccagcagggggcagaatggaattcaaatgttgttagctgcagagcaagaagctcagcgaattgtcaatgctgcaagagctgcaaaaatggctagactaaagcaggccaaagaggaggcagaaaaggagattgctgagttccgtgctcaaatggaagctgcgttccaaagaaaggttgcagagagtagtggagactcaggtgctaatgtgaagcgtcttgaacaagagacagaggcaaagatccatcacctgaagaaagaggctgcaagaatttctccagacgtggtccagatgcttctgaggcatgtcacaactgtaaagaactaggttctccgtttagccttgccgactgtaatgtttgggtgctctcttctgttgctttcctaaagttgggtttcctgattgtgagaacgagaagctttgctgtcatcttgatgcgcaatatctttagagtatttatctgttgtattggttgattgtgtctcttgattaaataaaacctttcaataaatgttctcatgtatcaatgcgcaacgctagtggcagatacattcatcttatgcttattaagattggtggcttacttattctacatccaataatagaactttccgccaaaaaaaaaaaa

SEQ ID NO: 879 - DNA, 633 bp, Leymus cinereus x Leymus triticoides
gcgccagaggatagcttttccccacggatccttctcgtcttccacgtgattcgagtcgcctctctccgtcagcccaaacatggactcaagcaggcgcccaagtggaatccagcaattgcttgctgcagagcaagacgctcagcaaattgtaaatgctgctagggctgctaaaacggcaaggcttaggcaagcaaaagaggaggccgagagagaaatagctgagtaccgtgcgcaaatggaggctgatttccagaggaagctcactgagaccagcggtgactctggcgcaaacgtcaaacgccttgagcaagagacgaacgtaaagattgagcaactcaagcagcaggcagcaaacatctctccagaggtgattcagatgctcctgaggcatgtcaccactgtgaagaactaaaggctgatgagtcagccctgcatatgatggcaactttgtactatctgtttatttatttgggaggtgtgataagaaatggcttttgccacttccagctgtaattccttgttctttgtcttggaaataagctgctactgttcggcagcagccatgtctgatactacttgctaaacctttggtgactagtccgtaaattttgtcgatttccacccttttgtctc

SEQ ID NO: 880 - DNA, 706 bp, Lolium multiflorum
gaggatcagcttttccccatcgaatcgttctcgtctcatctcgtctcgtcgtcctccacgtgaattcctgtcgcctctccgccagcccaaaagatggacgcaagcaggcgcccaagcggaatccagcaattgctggctgcagagcaagaggctcagcagattatcagtactgctagggctgctaaatcggcaaggcttaggcaagcaaaggaagaggctgagagagaaatagccgagtaccgtgcgcagatggaggctgatttccagaagaagcttgcagagactagcggtgactctggcgcgaacgtcaagcgccttgagcaggagacaaacgaaaagatcgaacaactcaagcagcaggcagccagcatctctccagaggtgattcagatgctcctgaggcacgtcaccactgtgaagaactaaaggttgatgtgcattctgtcctgcatatgatggcgaacttgtattatctgtttatttatttggaaggtgtgataagaatttgcttttgccacttccagctgtaattccttgtttattgtcttggaataagctgctgcggctcagcagcaggccatgtctgatactacttgataaacatttggtgattagaaattttgtggagttccaactcatttctctttcttgtgtatcgttgtatggctacaattgttcttatttatgtgagggctagcattcttgt

SEQ ID NO: 881 - DNA, 916 bp, Eragrostis curvula
  misc_feature (35)..(35): n is a, c, g, or t
  misc_feature (39)..(39): n is a, c, g, or t
  misc_feature (47)..(47): n is a, c, g, or t
  misc_feature (87)..(87): n is a, c, g, or t
  misc_feature (95)..(95): n is a, c, g, or t
  misc_feature (109)..(109): n is a, c, g, or t
  misc_feature (114)..(114): n is a, c, g, or t
  misc_feature (127)..(127): n is a, c, g, or t
  misc_feature (183)..(183): n is a, c, g, or t
  misc_feature (201)..(201): n is a, c, g, or t
  misc_feature (219)..(219): n is a, c, g, or t
  misc_feature (228)..(228): n is a, c, g, or t
  misc_feature (234)..(234): n is a, c, g, or t
  misc_feature (289)..(289): n is a, c, g, or t
  misc_feature (294)..(294): n is a, c, g, or t
  misc_feature (318)..(318): n is a, c, g, or t
  misc_feature (327)..(327): n is a, c, g, or t
  misc_feature (347)..(347): n is a, c, g, or t
  misc_feature (372)..(372): n is a, c, g, or t
  misc_feature (402)..(402): n is a, c, g, or t
  misc_feature (408)..(408): n is a, c, g, or t
  misc_feature (422)..(423): n is a, c, g, or t
  misc_feature (426)..(426): n is a, c, g, or t
  misc_feature (428)..(429): n is a, c, g, or t
  misc_feature (448)..(448): n is a, c, g, or t
  misc_feature (470)..(470): n is a, c, g, or t
  misc_feature (475)..(475): n is a, c, g, or t
  misc_feature (479)..(479): n is a, c, g, or t
  misc_feature (481)..(483): n is a, c, g, or t
  misc_feature (495)..(495): n is a, c, g, or t
  misc_feature (511)..(511): n is a, c, g, or t
  misc_feature (572)..(572): n is a, c, g, or t
  misc_feature (574)..(574): n is a, c, g, or t
  misc_feature (612)..(612): n is a, c, g, or t
  misc_feature (805)..(807): n is a, c, g, or t
  misc_feature (809)..(809): n is a, c, g, or t
aacagaatctgtttcccaatctcgcaggctctccncctncgccccgnccgccgatcccgcccgcccagatccagatccagctgaaanatggacgngagcaggcgccagngcggnattcagcaattgntggctgcggagcaggaggctcagcaaattgtcaatgcggccagggctgctaagtcngcaaggcttaggcaagcnaaggaggaggctgagagngagatagcngagtancgtgcccagatggaggctgagttccagaggaaggttgcagagagcagcggtgacnctggngcaaacgtcaagcgtcttgaggangagacggcngcgaaaatcgaacagctcanccaacaggctgcaagcatctccccngaagtcattcagatgcttctgaggcatgtnaccacngtgaagaactgaannctncnntcacggtcgcaaagttgtnttatctagtacttgttcatttnggagngtgntnnnaaataatgtcanttctggctgtaattcnttgttcttaccacggaataagctgcagtttagcagcaaccgtgtctggtactatctaactngnccattatttggtatattggtaaatattgttttctggangatgaaaaaaaaaaaaaaaaaaaaaaaaaaaaaattccccgggtttaaaaccccggctaaccccaagggatttcccgccccccggcgggtcaacaaaaggggaaaccccccaacgctttggaggcaaagttggaaaattcaaaagggcccccaaaaaacctgggggaaacatggccaaaacctttttaaaaannngngtggttttttttttttcccccccccccccttgcgggggggggggggggtcgcccccccccccccccccccggggggggggtaagagctttggcgccgccccaaaaaa

SEQ ID NO: 882 - DNA, 689 bp, Zea mays
atacgcggatcacggatcaccgtcctcctcgcccgctcattgcttgcctccagtctccagagaacgcgatttgttctgttgttcggtccccaatcttcgcctccgctccgcccgccccgacccagatcaggagctgagagatggacgccaacaggcgccaaggtgggattcagcagttgctggctgcggagcaggaggctcagcaaattgtgaatgcggctagagctgctaagtcagcaaggcttaggcaagcgaaagaggaggcagagagggaaatagccgaataccgtgcccagatggaggctgagttccagaggaaggtcgcagagagcagtggtgactctggtgcgaacgtcaagcgtctcgaggaagagacaacggcgaaaatcgaacagctcaaccagcaggctgcaagcatctccccagatgtcattcagatgcttctgaggcatgtcaccaccgtgaagaactgagaagtgctgctcccaaactatgctcatcggtctatttatttttgtcagagcaggtgaggaataataatatggcccttgtaccagtaattctttttttaactacggaataagccgcagcagctttagcggcaaccgtgactgttactaccagaacttgccattatttggtataatcggcaaattaaataatattgttttatattggatttttgaaca

SEQ ID NO: 883 - DNA, 680 bp, Pennisetum glaucum
ggattcaatgattcggatatccatccagatcttgaaagagttcgaaggacatctggagcgttcctccccacaaccttggcaacctgcaggatcttcagcgccctccacgcctcgatccagatccagcggctgaaagatggatgcgaacaggcgccagagtggaattcagcagttgttggctgcagagcaagaggctcagcagattgtaaatgcagctagggctgctaagtccgctaggcttaagcaagccaaggaggaagctgagagggaaatagctgaataccgttcccaaatggaggctgaattccagagaaaggttgcagagagcagtggtgactccggtgcaaacgttaaacgtcttgagcaagagacagcagcaaaaatcgagcaactcaatcaacaggctgcaagtatctcccctgaagtcattcagatgctgctgaggcatgtgaccactgtgaagaactaaacgttgatgtgcgccaaatatgatggcaaccttgtaatttcaatatattcttctatattagagtggtaataaatgatgtgccattataatagctgtgatcacatgttctcgagcacagaataagctgctgcactttagcagcaaacctgcctggtactatcagcacttggttcatttggtatcagtaaatattgcttttttctttgtaaag

SEQ ID NO: 884 - DNA, 659 bp, Pennisetum glaucum
ggacccccgatctgttccccaacctccgctcgtggccgctccagctccaccaccaccgccctccgctccggcagctgaacccgtccgcccccgatccatccaggtgcagtgagatggacgcgagcaggcgccagagcgggattcagcagctgctggctgccgagcaggaggctcagcagatcgtcaatgccgccagggctgctaagtcggcaaggcttaggcaagctaaagaggaggctcagagggaaatagatgaataccgtacgcagatggagaacgagtttcagaggaaggttgcagagagcagcggtgactctggtgcaaatgtcaagcgtctcgagcaagagacagcagcaaagattgaacagctcaaccaacaggctgcaaacatctccccggaagtcattcagatgctcctgaggcatgtcacaaccgtgaagaactgagcgtgtctgtgcccaaaaatatgatcgcaagcttgtatcatctgtctatttattattttgttgagtcgtggtgagaaataatgtggccttttgctgtaattccttgttcttgaccacggaataagctgctgcagtagagcagcaaccgtgcctggtactgttggaacttgcctattgtttggtatattggtaaatattttcttcaaaaaagaa

SEQ ID NO: 885 - DNA, 848 bp, Ananas comosus
  misc_feature (488)..(488): n is a, c, g, or t
  misc_feature (502)..(502): n is a, c, g, or t
  misc_feature (610)..(610): n is a, c, g, or t
  misc_feature (816)..(816): n is a, c, g, or t
ataccaacagtgcataccattaaccctatgtaatatgccaattgtaccctccaacatcccccaaaccctatcaacaccaccgttcctatcgctctctgacacgcacgctgcccccccccccctctctctctctctctctctctctctctctctctctctcgcacgaacgactatcctcttcctatcctcttctacagcgtcatcctccaagctagaagatggatcccaacaggcgtcaaggtggaatccagcaattgctagcagctgagcaagaagctcaacagattgtgaatgctgcaagaaatgcgaaattggctaggttaaagcaggctaaagaagaggcggataaggagattgctgaatatcgtgcacacatggaagctgaatttcagaagaaggtcgcggagagtagcggcgattctggtgcgaatgtcaagcgccttgaacaagaaacagaagcaaagattcgagcacctcaagtcacaagncgaaagcatctccngtgatgtcgttcaaatgcttttaaggcatgtgaccactgtcaaaaattaagcgatcctatggataattaccaaataatagttgacgttggttgtttctatgccatttngatggttttgttgttttgagaactcatgggtgggaattgaattccatgcccgtagtcgtcactctggcattttcctagaataaactactactgtgttgtccacagactcggtcattattgtataagtttggtgcttgcacttgtgctgttgcatcagcattcacattaagtgtttgctatcttttcctggcaggattatttggtgnaatctatgttatccattcgacttggctgccgc

SEQ ID NO: 886 - DNA, 745 bp, Oryza sativa
atggggaagtacggcgtggagctggacgccgtcgccctcaactcccttctctctgtcatgtgccgcggggacgaccgcgcgcaggcggcacaggacctgttcgagcacacctgccgctcctaccacccccacagatccgctcctggctcctgcaaggctgcaacctgcaaccccaacaccccttcgagaatcgtcgtgcgcgcagcagaaggaagatggatgctaacagacgccaaggtggaattcagcaattattggctgcagagcaagaagctcaacagattgttaatgctgctaggagcggcaaaagaggaggctgagagagaaatagctgagtaccgtgctcagatggaagctgagttccagaggaaggttgcggagagtagcggtgattctggtgcaaacgtaaaacggcttgagcaagaaactgacacgaaaattgcgcaactgaaggagcaggctgcaaatgtctcccctgaagtgatccagatgcttcttaggcatgtaaccaccgtgaagaactgataaaagttggacgtcctgccgacaaattaagcagagattgggctcaaattgtgtgctacctttttgttaattccaagatggattacaaatttacggatgtcagctatagccacgaaccctgttcttagtcatacaataccaataagccgcagcagatttattggtgaacacgagggatgattatacaataagcattcttgttgatgtgatttggcgagcc

SEQ ID NO: 887 - DNA, 733 bp, Sorghum bicolor
agaccaggcccgtgctccagtagtctcacgtgtaggtggagccacgttgtatacgccggatcaccaatcaccgtcctcctctcctcgcctccagagaagtcgatttgttcccccaaatctccgccctccgctccaccggccgccgcgccccgatccagatcaggagctgtgagatggacgcgaacaggcgcgccagtgggattcagcagctgctggctgcggagcaggaggctcagcaaatcgtgaacgcggctagagctgctaagtcagcaaggcttaagcaagcgaaagaggaggctgagcgggagatagccgaataccgtgcccagatggaggctgagttccagaggaaggttgcagagagcagtggtgactctggtgcgaacgtcaagcgcctcgaggaagagacagcggcgaaaatcgaacagctcagccagcaggctgcaagcatctccccagacgtcattcagatgcttctgaggcatgtcaccaccgtgaagaactgaggaacgatgtctccaagttatgcttgcaaacttgtatcatcgaatctatttatttttgttggagtggtggtgatgaataatatgtcgcttgtatccatgattccttttcttgactacggaataagccggcacagctttagcggcaaccttgacttggtactatcagaccttgccattatttggtacatttggtaaataatattgttttataaattggttttttgaac

SEQ ID NO: 888 - DNA, 875 bp, Sorghum bicolor
gagtcgcggacgatccgttccgacgtccgactggatggatcatcagatcaaccaggccagaattctaccttcacggctacacgtgaccttacgaacccggactggagactggactgcctccctacgggcttttcttctcccgttcacctcgccttgcgcgcgccctctctttctagtgccgacgaccacgacgtaagaccgccgccgcatccctgcgctaggcgcccaggtcttcgtccggcccttcgccagccgcgacgagcacccaccagcagctgaaagatggatgcgaacaggcgccagagtggaatccaacagttgttggctgcagagcaagaggctcagcagattgtaaatgcagctagggctgctaagtcagcaaggcttaggcaagccaaggaggaggctgagagggaaatagctgaataccgtgcccagatggaggctgaattccagaggaaggttgcagagagcagcggtgactctggtgcaaatgttaaacgtcttgaggaagagacaacagcaaaaattgaacaactcagtcaacaggctgcaagtatatccccagaagtcattcagatgcttctgaggcatgtcaccactgtgaagaactgaatgttgttgtccgcaaatatgcttgcaagttgcaacattgtattatctatctatctatatatttattagtacaagaaagtggtaataaatgaaatccacttttagctgtaattctatgttcttaatcatagaataaggtcccgtacaatcaatactcgttcatcggttggtgcatgtaaatgtttttttccctagttttcctttttatcaaatgttattttcgtctggctttctgaacagagtgattttttatatccaac

SEQ ID NO: 889 - DNA, 634 bp, Saccharum officinarum
  misc_feature (316)..(316): n is a, c, g, or t
atttgttccccaatctccgcacccgctgctccaccgccctccgctccggtcgccgaacccgccggacccgatccagatcaggagctgagagatggacgcgaacaggcgccagagtgggatccagcagttgctggctgcggagcaggaggctcagcaaattgtgaacgcggctagagctgctaagtcagcgaggcttaagcaagcgaaagaggaggctgagcgggagatagccgaataccgtgcccagatggaggctgagttccagaggaaggtcgcagagagcagtggtgactctggtgcaaacgtcaagcgtctngaggaagagacagccgcgaaaatcgagctgctcaaccagcaggctgcaagcatctccccagatgtcattcagatgcttctgaggcatgtcaccaccgtgaagaactgaggaatgctgctcccaaactatgctcgcaagcttgtatcatcgaatctatttatttttgtcagagtggtgaggaataatatgtcgcttgtatccataattccttttcttaataactacggaataaaccgccacagctttagcggtaactgggactggtactatcagaactcgccattatttggtacaattggtaaataatattgttttaaa

SEQ ID NO: 890 - DNA, 740 bp, Saccharum officinarum
  misc_feature (738)..(738): n is a, c, g, or t
cgtccgcccgtgctcccgtgcaggtggagccacgttgtatacgcggatcaccaatcaccgtcctcctcgcctacagagaactcgatttgttccccaatctccgcacccgctgctccaccgccctccgctccggtcgccgaacccgcccgacccgatccagatcaggagctgagagatggacgcgaacaggcgccagagtgggattcagcagttgctggctgcggagcaggaggctcagcaaattgtgaacgcggctagagctgctaagtcagcgaggcttaagcaagcgaaagaggaggctgagcgggagatagccgaataccgtgcccagatggaggctgaattccagaggaaggtcgcagagagcagtggtgactctggtgcaaacgtcaagcgtcttgaggaagagacaaccgcgaaaatcgagctgctcaaccagcaggctgcaagcatctccccagatgtcattcagatgcttctgaggcatgtcaccaccgtgaagaactgaggaatgctgctcccaaactatgctcgcaagcttgtatcatcgaatctatttatttttgtcagagtggtgaggaataatatgtcgcttgtatccataattccttttcttaataactatggaataaaccgccacagctttagcggtaactgggactggtactatctgaacttgccattatttggtataattggtaaataatattgttttaaaaaaaacccaaaagcgcgcgngt

SEQ ID NO: 891 - DNA, 685 bp, Saccharum officinarum
  misc_feature (26)..(26): n is a, c, g, or t
  misc_feature (61)..(61): n is a, c, g, or t
  misc_feature (107)..(107): n is a, c, g, or t
  misc_feature (114)..(114): n is a, c, g, or t
  misc_feature (140)..(140): n is a, c, g, or t
  misc_feature (196)..(196): n is a, c, g, or t
  misc_feature (291)..(291): n is a, c, g, or t
  misc_feature (331)..(331): n is a, c, g, or t
  misc_feature (358)..(358): n is a, c, g, or t
  misc_feature (402)..(402): n is a, c, g, or t
  misc_feature (467)..(467): n is a, c, g, or t
  misc_feature (516)..(516): n is a, c, g, or t
  misc_feature (519)..(519): n is a, c, g, or t
  misc_feature (522)..(522): n is a, c, g, or t
  misc_feature (527)..(530): n is a, c, g, or t
  misc_feature (535)..(535): n is a, c, g, or t
gcttttcttctcccgttcaccccggnttgcgcgcgccctctctttctagtgccgacgaccngacgcctgtacgaccgccgccgcatccctgcgccaggtgcccaggntttcgtngggcccttcgccagcgacgagcaccnaccagcagctgaaagatggatgcgaacaggcgccagagtggaattcagcagttgtnggctgcagagcaagaggctcagcagattgtaaatgcagctagggctgctaagtcagcaaggcttaggcaagccaaggaggaggctgagagggaantagctgaataccgtgcccaggtggaggctgaattccaganaaaggttgcagagagcagcggtgactntggtgcaaatgttaaacgtcttgaggaagagacagcaacaaaanttgaacaactcaatcaacaggctgcaagcatatccccaatgcttctgaggcatgtcaccactgtnaagaactgaacgttgtgcacaaacttgcaagttgcaatattgtacgtantantanatatnnnntagtncaagacagtggtaatagaatgaaaatttcacttttagctgcacttttatattcttaatcctagaataaggtgtggcatgggagcagcaaacctggtctgtacaatcaatacctcgtcatcagttggaacatgtaataggtttttcttttt

SEQ ID NO: 892 - DNA, 655 bp, Panicum virgatum
gaccccgatttgtttcgttccccatcctcgcggccgctccaccaccgccgccgccgccctccgctccggtcgccgaagtccccgattcagatccagggcccgagagatggacgcgagcaggcgccagagcgggatccagcagctgctggccgcggagcaggaggcgcagcagatcgtcaatgcggctagggctgctaagtcggcaaggcttaagcaagcgaaagaggaggctgagagggaaatagctgaataccgtaaacagatggaggctgaattccagaggaaggttgcagagagcagcggtgactctggtgcaaatgtcaagcgtctcgagctggagacggcggcgaagatcgaacagctcaaccaacaggctgcaagcatctccccagaagtcatccagatgcttctgaggcatgtcaccaccgtgaaaaactgagccttgctgtgcctgaaaatatgattggaagcttgtatcatctgtccatttattatttcggagagcgtggtgagaaataatttgacttatggctgtaattccttgaccacggaataagctgctgcagtagagcagcaaccgtactggtactgtcagatcttgctttgtttggtatattggtaaatattttcttcatgttcaaattttgaacatact

SEQ ID NO: 893 - DNA, 775 bp, Panicum virgatum
ggcgtggaggtggggagccacgtcgtatatccgctggccagcaagtctagccacagagtccgatcccgatttgtttcgtttccccatccttgcggccgctccaccgccgccgccctcagctccggccgccgaggtcaccgattcagatccaggacccgagagatggacgcgagcaggcgccagagcgggatccagcagctgctggccgcggagcaggaggcgcagcagatcgtcaatgcggccagggctgctaagtcggcaaggcttaggcaagcgaaagaggaggctgagagggaaatagctgaataccgtaaacagatggaggatgaattccagaggaaggttgcagagagcagcggtgactctggtgcaaatgtcaagcgcctcgagcaggagacagcggcgaagatcgaacagctcaaccaacaggctgcaagcatctccccagaagtcatccagatgcttctgaggcatgtcaccaccgtgaagaactgagccttgctgtgcctgagaatacgatcgcaagcttgtatcatctgtccatttattatttcggagagcgtggtgagaaataatttgacttgtggctgtaattccttgaccacggaataagctgctgcagtagagcagcaaccgtgcctggtactatcagatcttgcattgtttggtatattggtaaatattttcttcatgttcaaattttgaacaatactatcttgttgagtcccaatctggtgctcctagtttcctatatatcacatgagatctgcaaact

SEQ ID NO: 894 - DNA, 703 bp, Panicum virgatum
catctgcatcgttcctcctcacccagccttgcagattgcaggatctccagcacctccacgcctcgatccagatccagcagctgaaagatggatgcgaacagacgccagagtggaattcagcagttgttggctgcagagcaagaggctcagcaaattgtaaatgcagctagggcagccaattcggcaaggcttagacaagccaaggaggaagctgagagggaaatagctgaataccgctcccaaatggaggctgaattccagagaaaagttgcagagagtagtggtgactccggtgcaaatgttaaacgtcttgagcaagagacagcggcaaaaattaaacaactcaatcaacaggctgcaagtatctcccctgaagtcattcagatgctgctgaggcatgtgaccactgtgaagaactaaacgttgatgtgcagcaaatatgactgcgaccttgtattttctatctaattctttatatcagagaggagtaataaaggatttgtcacttataactgtaattctgtgttcttgttcacagaataagctgctgcagtttagcagcaaacctgtctattactatcaaaacttggtgatcatttggtaattatcactttctcttgtttctgttgtaaggaaatgttattttcaccccttcctgaagaaactaatcaaccttttgcaacaagttcatttttgagtatca

SEQ ID NO: 895 - DNA, 746 bp, Nicotiana tabacum
  misc_feature (617)..(617): n is a, c, g, or t
tgcggccgctggagcagcagaggattagcttttccccacggatctttctcgtcttccacgtgattcgagtcgcctctctccgtcagcccaaacatggacgcaagcaggcgcccaagtggaatccagcaattgcttgctgcagagcaagatgctcagcaaattgtaaatgctgccagggctgctaaaacggcaaggcttaggaaagcaaaagaagaggcggagagagagatagctgagtaccgtgcgcagatggaggctgatttccagagaaagctcaccgagaccagcggtgactctggtgcaaatgtcaaacgccttgagcaagagacaaacgtaaaaattgaacagctcaagcagcaggcagcaaacatctccccagaggtgattcagatgcttctgaggcacgtcaccactgtgaagaactaaaggttgatgagtcggccctgcatattatgatgacaactttgtactatctgtttatttctttgggaggtgttataagaaatggcttttgccacttccagctgtaattccttgttctttgtcttggaaataagctgctacagttgagcagcagccatgtctgatactacttgctaaacctttggtgattagtncgtaaattttgtcgatttaaaccctttttgtctcttccttgtatggctaccagtatatgtattttttatgtgagatgtattattcataagagtaaataagttttaaatccaaaagcggccgcatgaggg

SEQ ID NO: 896 - DNA, 715 bp, Triticum aestivum
gaattcggcacgagggaggatagcttttccccacggatccttctcgtcttcctcttgattcgagtcgcctctccccgtcagcacaaacatggactcaagcaggcgcccaagtggaatccagcaattgcttgctgcagagcaagaagctcagcaaattgtaaatgctgctagggctgctaaaacggcgaggcttaggcaagccaaagaagaggctgagagagaaatagctgagtaccgtgcacaaatggaggctgatttccagaggaagctcactgagaccagcggtgactctggcgcaaacgtcaaacgccttgagcaagagacaaccgtaaagattgagcagctcaagcagcaggcagcaaacatctctccagaggtgattcagatgcttctgaggcacgtcaccactgtgaagaactaaaggttgatgagtcagccctgcatatgatggcaactttgtactatctgttcatttctttgggtggtattataagaaatggcttttgccacttccagctgtaattccttgttgtcttggaaataagctgctacagttcagcagcagccatgtctgatactacttgctaaacctttggtgattagttcgtaaattttgtcgatttccgacctttttgtctctcccttgtatggctatcagtatatgtatttttttatgtgaggtatattattcataagagtaaataagtttttaatc

SEQ ID NO: 897 - DNA, 716 bp, Triticum aestivum
gaggatagcttttccccacggatccttctcgtcttccacgtgattcgagtcgtctcgcctctcctccgtcagcccaaacatggactcaagcaggcgcccgagtggaatccagcaattgcttgctgcagagcaagaagctcagcaaattgtaaatgctgctagggctgctaaaacggcgaggcttaggcaagccaaagaagaggctgagagagaaatagctgagtaccgtgcacaaatggaggctgatttccagaggaagctcaccgagaccagcggtgactctggcgcaaacgtcaaacgccttgagcaagagacaaacgtaaagattgagcagctcaagcagcaggcagcaaacatctctccagaggtgattcagatgcttctgaggcacgtcaccactgtgaagaactaaaggttgatgagtcagccctgcatatgatggcaactttgtactatctgttcatttctttgggaggtattataagaaatggcttttgccacttccagctgtaattccttgttgtcttggaaataagctgctacagttcagcagcagccatgtctgatactacttgctaaacctttggtgattagttcataaattttgtcgatttccgtcctttttgtctctcccttgtatggctatcagtatatgtatttttttatgtgaaatatattattcataatagtaaataagtttttaatcaaaaaaaaaa

SEQ ID NO: 898 - DNA, 660 bp, Triticum aestivum
  misc_feature (627)..(627): n is a, c, g, or t
  misc_feature (648)..(648): n is a, c, g, or t
  misc_feature (658)..(658): n is a, c, g, or t
aggagcagcagaggatagcttttccccacggacccttctcgtcttccacgtgattcgagtcgcctcgcctctcccccgtcagcccaaacatggactctagcaggcgcccgagtggaatccagcaattgcttgctgcagagcaagaggctcagcaaattgtaaatgctgctagggctgctaaaacggcaaggcttaggcaagccaaagaagaggctgagagagaaatagctgagtaccgtgcacaaatggaggctgatttccaagaggaagctcactgagaccagcggtgactctggcgcaaacgtcaaacgccttgagcaagagacaaacgtaaagattgagcagctcaagcagcaggcagcaaacatctctccagaggtgattcagatgcttctgaggcacgtcacaactgtgaagaactaaaggttgatgagtcagccctgcatatgatggcaactttgtactatctgttcatttctttgggaggtattataagaaatggcttttgccacttccaactgtaattccttgttgtcttggaaataacctgctacagttcagcagcagccatgtctgatacactcaaacttgggatagtctaattgcaattcgtcctttgccccctgntgcatataagtatttagtaanaatatcaaanat

SEQ ID NO: 899 - DNA, 619 bp, Triticum aestivum
  misc_feature (69)..(69): n is a, c, g, or t
gaggatttgttcccccaaatctccgccctccgctccaccggccgccgcgccccgatccagatcaggagntgtgagatggacgcgaacaggcgccagagtgggattcagcagctgctggctgcggagcaggaggctcagcaaatcgtgaacgcggctagagctgctaagtcagcaaggcttaagcaagcgaaagaggaggctgagcgggagatagctgaataccgtgcccagatggaggctgagttccagaggaaggttgcagagagcagtggtgactctggtgcgaacgtcaagcgcctcgaggaagagacagcggcgaaaatcgaacagctcagccagcaggctgcaagcatctccccagacgtcattcagatgcttctgaggcatgtcaccaccgtgaagaactgaggaacgatgtctccaagttatgcttgcaaacttgtatcatcgaatctatttatttttgttggagtggtggtgatgaataatatgtcgcttgtatccatgattccttttcttgactacggaataagccggcacagctttagcggcaaccttgacttggtactatcagaccttgccattatttggtacatttggtaaataatattgttttcta

SEQ ID NO: 900 - DNA, 679 bp, Triticum aestivum
  misc_feature (434)..(434): n is a, c, g, or t
  misc_feature (571)..(571): n is a, c, g, or t
cattcaccaatcgccttcctgtcgccctcccgctcggctcggcgaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccacaacatctccccggatgtcattcanatgcttctgcggcattcaccaccgtcaagaactgaggagtgctgttcccgaactatgctcgcagacttgtacgtcgatctatttatttgtcaagagtgagagtggtgaggaataatatgcccgcttgtatccataantcctgttcgtaactacggaataagccgccgcagctttagcggcaaacgtgactagtactgtcagaacctaccattgttatttggtacaattggtaataatattgtttt

SEQ ID NO: 901 - DNA, 710 bp, Festuca arundinacea
  misc_feature (32)..(33): n is a, c, g, or t
  misc_feature (88)..(88): n is a, c, g, or t
  misc_feature (91)..(91): n is a, c, g, or t
  misc_feature (235)..(235): n is a, c, g, or t
  misc_feature (268)..(268): n is a, c, g, or t
  misc_feature (274)..(274): n is a, c, g, or t
  misc_feature (281)..(281): n is a, c, g, or t
ggcacgagggttgctggcttgctgccttctcnncgcgacagaaatggcgttcacgctggtgggagccttcaagggcctctccctctcntcntcctcctccttcctccgcggcgaccgcgccgcgctcggaggcaacagcgtcgggatgggcgtgggcgtggcgacgctgccggcgcgcgggctgacgatccagatggcgcacaagaagggggccggtagcaccaagaacgggagngactccaagggacagcgcctcggggtcaagatntacggngaccagntcgccaagcccggcgccatcatcatccgccagcgcggcaccaaggtctatcctggaaataatgttggaatgggcaaggatcacaccctcttcgctttgattgatggacttgtcaagtttgagaaatatggaccagacaggaaaaaggtaagcgtttacccatatgagaaacagcctgagaacccaaacagttacagagcaaggaagagagagaacttccgcttgcagcgtgaacgcaagaaggcaagagcagagagaacttatgagccccagttggtgttggcagctgccgatgaaagtgttgaggccaaagcagactgctgataagtttactgtaatgtatttctctttttttacagtccaggcttgacaaatatttctcgattgtaaatggtcgacttcaagttaaatgcaagtccagcttcatttt

SEQ ID NO: 902 - DNA, 724 bp, Leymus cinereus x Leymus triticoides
gcacgaggcttgctgcttgcctttctccgtgcgacagaaatggcgttcacgctggtgggagccttcaagggcctgtccctcgcgtcctcctcctccttcctccgcggcgacagggccgcgctccccggcggcgccggaggcgtgggcgtggtgacgctgccggcgcgcgggctgaccatccagatggcgcacaagaagggggccgggagcaccaagaacgggagggactccaagggccagcgcctcggggtcaagatttacggcgaccagctcgccaagcccggcgccatcatcatccgccagcgcggcaccaaggtctatcctggaaataatgttggaatgggcaaggatcacaccctcttttctttgattgatggacttgtcaagtttgagaaatatggaccagacaggaaaaaggtaagcgtctacccatatgagaaacagcctgagaacccaaacagttacagagcaaggaagagagagaacttccgcttgcagcgcgaacgcctgaaggcaagagcagagggatcttatgagccagagttggtactggcagctgcagatgcaagtgttgaggtcaatgcagactgctgataggtttactgtaatgtacttctttttacacaatccatgcttgacaaatctttctcaaatgtaaatcatcaactgcaagatgaatgcaagtccagcactccagcttcattttaaattttagctgtgccca

SEQ ID NO: 903 - DNA, 801 bp, Zea mays
cgttatcaccagtacccacccattacctcaccgcctcatctgctctcatcccccgtcttcttcccaagctgccacgttgcctccctccctccgctccagcggcctccatggcgttcgccctggcgggggccttcaagggcctctccctggtgcccaccaccacctcctccttcccgcgcggcgaccgcgcctcgctctccgtcggcggcgcagcgggcgtgccggtgccggtgccggcgcggcggctcaccatccagatggcgcacaagaagggggccgggagcaccaagaacggccgcgactccaagggacagcgcctcggggtcaagatatacggcgaccagctcgccaagcccggggccatcatcatccgccagcgcggcaccagggtctatcctggaaataacgttggaatgggcaaggatcacacactcttttctttgatagatggactcgtcaagtttgagaagtatgggccggacaagaaaaaggttagtgtttacccatatgagaaggagcctgaaaacccaaacagttacagagcaaggaagagagagtacttccgcatgcggcgtgaacggaagaaggcgagagcggagggcgccgctgagcctcagttggtactagctgctgttgatgaaaactctgaggtcagcgcggactgctgataagtttcctgtgtggtgtttctctttttcacagcccttgttacactttttcttccttaattgtaagaccacatgatctataaaggtcatatttacatgtgttgtttagataaatggatatgttctacttgta

SEQ ID NO: 904 - DNA, 709 bp, Pseudoroegneria spicata
ggctcgctgctgccttcttctccgcgcgacagaaatggcgttcacgctggtgggagccttcaagggcctgtccctcgcgtcctcctcctccttcctccgcggcgaccgcaccgcgctccccggcggcaccaccgggggcgtgggcgtggcgacgctgccggcgcgcgggctgaccatccagatggcgcacaagaagggggccgggagcaccaagaacggcagggactccaagggccagcgcctcggggtcaagatttacggagaccagctcgccaagcccggcgccatcatcatccgccagcgcggcaccaaggtttatcctggaaataatgttggaatgggcaaggatcacacccttttttccttgattgatggacttgtcaagtttgagaaatacggaccggacaggaaaaaggtaagcgtttacccatatgagaaacagcctgagaacccaaacagttacagagcaaggaagagagagaacttccgcttgcagcgcgaacgcctgaaggcaagagccgagggatcttatgagccagaattggtgttggcagctgcagatgcaagtgttgaggtcaatgcagactgctgataggtttactgtaatgtacttctctttttacacaatccatgtttgacaaatctttcttgaatgtaaatcatcaactgcaagatgaatgcaagtccagcactatagcttcattttaaa

SEQ ID NO: 905 - DNA, 793 bp, Sorghum bicolor
tcaccgcctcatctgctctcttccccctccttcccaaactgccgttgcctccctccaggctccagcttcctccgcgcatggcctccatggcgttcgctctggcgggggccttcaagggcctctccctggcgcccaccaccacctccttcctgcgcggcgaccgcgtctcgctctccgtcggcggcggcagcggcgccgtgggcgtgtcggtgccggcgcggcggctcaccatccagatggcgcacaagaagggggccgggagcaccaagaacggacgagactccaagggacagcgcctcggggtcaagatatacggcgaccaggtcgccaagcccggggccatcatcatccggcagcgcggcaccagggtctatcctggaaataacgttggaatgggcaaggatcatacactcttttctttgattgatggactagtcaagtttgagaagtatggtccagacaagaaaaaggtaagtgtttacccatatgagaaagagcctgaaaacccaaacagttacagagcaaggaagagagagtacttccgcatgcggcgtgaacggaagaaggcaagagcggagggagctactgagcctcaattggtactagctgctgttgacaaaaactctgaggccagcgccgactgctgataagtttcctgtgtagtatttctctttttcacagcccttgttacatattttttccctgaattgtaagacacatgatctatataaggttatatttacatgttgtttagatatgttctacatcttgtgccctttgtgtggtagttatg

SEQ ID NO: 906 - DNA, 737 bp, Saccharum officinarum
ctcacctcactgcctcatcttttctcttccccctccttcccaccacagcttcctccgcgtatggcctccatggcgttcgccctggcgggggccttcaagggcctctccctggcgcccaccaccaccaccttcctgcgcggcgaccgcgcctcgctctccgtcggcggcgccgtgggcgtgccggtgccggcgcggcggctcaccatccagatggcgcacaagaagggggccgggagcaccaagaacggccgcgactccaagggacagcgcctcggggtcaagatatacgacgaccaggtcgccaagcccggggccatcatcatccggcagcgcggcacaagggtctatcctggaaataacgttggaatgggcaaggatcatacactcttttctttgattgatggactagtaaagtttgagaagtatgggccggacaagaaaaaggtaagtgtttacccatatgagaaagagcctgaaaacccaaacagttacagagcaaggaagagagagtacttccgcatgcggcgtgaacggaagaaggcaagagcggagggagccactgagcctcaattggtaatagctgctgttgacgaaaactctgaggtcagcgcggactgctgataagtttcctgtgtagtgtttctctttttctcaccccttgttacatattttcttcctgaattgtaagacgcatgatctatataatgtcatatttacatgtcggttagatatgttcc

SEQ ID NO: 907 - DNA, 710 bp, Panicum virgatum
tccaaggcttctccgctcatggcgtccatggcgttctcactggcaggagccttcaagggcctctccctcgcgtccccttcctcttccatgcgccctgccttcctccgcggcgaccgcgccgcgctctccgtcggcggcgccgcggtgggcgtgccggtgccggcgcggcggctgaccatccagatggcgcacaagaagggagccgggagcacaaagaacggccgtgactccaaggggcagcggctgggagtcaagatatacggcgaccaggttgccaagcccggggccatcatcatccgccagcgcggcaccagggtctatcctggaaataatgttggaatgggcaaggatcatacactcttttctttgattgatggactagtcaagttcgagaaatatggaccagacaagaaaaaggtaagtgtctacccatacgagaaacagcctgaaaacccaaacagttacagagcaagaaagagagagtacttccgcatgcagcgtgaacgcaagaaggcaagagcagagggagccattgagcctcaattggtattagccgctgtagacgaaaactctgaggtcagcacagactgctgataagcttactgtgtagtatttctcttatttttttttccacaagccatgtttgatattttctccctaatttgtaagactgcatgatccattaaaggtcatattacacgatgttgttt

SEQ ID NO: 908 - DNA, 896 bp, Panicum virgatum
agcctcctccgctcatggcgtccatggcgttctcactggcaggagccttcaagggcctctccctcgcgaccccttcctcttccatgcgcccgtccttcctccgcggtgaccgcgccgcgctctccgtcggcggcgccgcggtgggcgtgccggtgccggcgcggcggctgaccatccaaatggcgcacaagaagggagccgggagcacaaagaacgggcgcgactccaaggggcagcgtctgggagtcaagatatacggcgaccaggtcgccaagcccggcgcaatcatcatccgccagcgcggcaccagggtctatcctggaaataatgttggaatgggcaaggatcatacactcttttctttgattgatggactagtcaagttcgagaaatatggcccagacaagaaaaaggtaagtgtctacccatacgagaaacagcctgaaaacccaaacagttacagagcaagaaagagagagtacttccgcatgcagcgtgaacgcaagaaggcaagagcagagggagccgttgagcctcaattggtattagccgctgtagacgaaaactctgaggtcagcgcagactgctgataagcttcctgtctagtatttctcttgttcacaagccatgtttgatattttctccctaagactgcatgatcccttaaaggtcatattacacgatgttgtttagatgtggtctatctgctgtgctttttctggttgttttgctttggagtcacagtggagtctattccaacttcctggaccgcaaactccaggtttaatggtgtgatggacgttgtcgcaagctcacctgaatcttgaaattagtggtatccaagagatgccacattgttgcaatacatcaagccactgttgaacagcgtcatcatc

SEQ ID NO: 909 - DNA, 962 bp, Triticum aestivum
ctcgtgccgaattcggcacgagccgttgctggcttgctgctgctgcgtttctccgagcgacagaaatggcgttcacgctggtgggagccttcaagggcctgtccctcgcgtcctcctcctccttcctccgcggcgaccgcgccgcgctccccggcggcgccaccgggggcgtgggcgtggcgacgctgccggcgcgcgggctgaccatccagatggcgcacaagaagggggccggaagcaccaagaacggcagggactccaagggccagcgcctcggggtcaagatttacggcgaccagctcgccaagcccggcgccatcatcatccgccagcgcggcaccaaggtttatcctggaaataatgttggaatgggcaaggatcacaccctcttttccttgattgatggacttgtcaagtttgagaaatatggaccagacaggaaaaaggtaagcgtctacccatatgagaaacagcctgagaacccaaacagttacagagcaaggaagagagagaacttccgcttgcagcgcgaacgcttgaaagccagagcagagggaacttatgaaccagaattggtgttggcagctgcagatgcaagtgttgaggtcaatgcagactgctgataggtttactgtaatgtacttctctttttacacaatacatgcttgacaaatctttctcgaatgtaaatcatcaactgcaagatgaatgcaagttcagcactccagcttcatttttaaaaaaaaaaaaaaacctcgtgccgaattcggcacgaggtgctatcaggcaagagcttgccaagctcaagaaggaggttgctgcttagaatatcctagtggatggcatgttgagttttttgttccaagttggatctgctctatgttccagtgttcttaaagccagaattagtacaactgttttcagcgaactatttcatattttgtcatggctgttattgaata

SEQ ID NO: 910 - DNA, 1334 bp, Triticum aestivum
  misc_feature (57)..(57): n is a, c, g, or t
ttcggcacgaggcgcatatatccccgcctctcctgttgccccttcgtccccaccagntcggttgattcatccctccctctctctgccacgatccagcgcgtttctttgcgtcttctgttatccttttggagctgcctactgccatgggagcggggatggtggagctcgggcccggggtggtggaggttggtgcggcggaggccgcgcagaccgtgccgccggccaagaggaggcgggtgctggccgttaagaccgcggcggcggcggcggcaggaaggaggccgcggcgcgacaggaggccgaccgccatccagcggctcttccaggcctgccgcgccgtcttcaagggccccggcaccgtgcccaagcccgccgaggtcgccctgctccgcgccatgctcgacaaaatgagaccagaggacgtcggcctaagctcaaacatgcccttcttcaggaatagagaggcggcaaccgaagggacccccaccatcacacacaccaccatatacaaatctgagaaattttccatggttctcttcttcttgccgacgaatgcggtcatccctctgcacaaccaccccggtatgacggtgttcaacaagctgctcatcggatcgatgcacgcaaagtcatatgactgggctgatcctgatgatccggctaatgagagtggcgcttcgtcgcctgacggtaaattgagactggcacaactagtcgtggatgatgttttcacagcgccgtgcgacacgtcggtcctgttcccgacggcgggaggcaacatgcaccggttcagggccgtcgcgccatctgcgttccttgacatccttggccccccttactccatcgaagaggaccgagactgcacgtactacacggacattccatactccgagcatcgcatgaccagcaatgagcccatcggcgacgagcaagaaggccggcgtctcgcgtggctgaaagaggtcgagatgccgaaggatctgaagatgtgcagcgtccggtatggcggcccgccaatctccggcagatgatcgatgatcctttccttccagccctttgcaaccgatgatgagctgtcaagtgtcaacccaactcaaaccagatggtgtcagaatcgctgtttaccttgtgaatacagcagcaagctagttagttgagccataagaataggtctcagtttgtgcatgatgtctcaatcagttatggcagtttaccatgtaaaagtgcttgcttgcttgcttttgcagcagctgtgtacgtggaccttgtccagcagatccctttgttgatcttttctcaatatatagatcatgccatagattttaaaaaaaaaa

SEQ ID NO: 911 - DNA, 785 bp, Brachypodium distachyon
aaactgaaagggcatggcaaacgaacaccttgtgctcgttcatggggaagggcatgggggttggtgctggttcaagctccggtggctcctcgagggctctggctaccgggtgacctgcatagacctcgccggaggtggggtcgatcctaccgaccccaacacggtccggtcattcgagcagtatgacaagccgctcctggacctcatctccgccttgccggagggtgagaaggtgattctgatcggacatggtattggagggctgagtgtgatccatgcaatgcatgaatttgttgacaggatcaaggaagcaatttttgtggcagctgctatgctaccatttggacttcaaactgatgaagataagaaagatggcttaccaagtttacctgagaatgaggttcaattgacatttggtgcaggagcagatgacccgccaactactgtggccttgaggttagaattccagcgtgatcgactatcccagcaaagccctgaggaggactcaatactggcttcgatgctgatgcgcccatggcccgtgagtgctatcggtactgcaagcttcgaaggagacgatgagagattgaatcgaataaaacgagttttcataaagacacagcgtgatcacatgctggaacctcagcagcaagactccatgatcaagaagtggccacccagtgaggttttgatcatagatacagatcacagccccttcttctctgcaccagaacagctctttaatctaattgtcaaatctctatgatgcaaatatgcagataact

SEQ ID NO: 912 - DNA, 972 bp, Zea mays
ggattgtccacgaaaatgcagctcccctgcctcatgcccatcaaatcgttaaacttgttagatcggtaggcagagagaggccagactgatgggaatggcagcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtgattctaatcggacatggtgctggagggctgagtgtgattcatgcaatgcacgaatttgttgacagaatcagccaagcattttttgtggcagctacaatgctaccatttggatttcaagctgatgaagataagaaagatgggttaccaactttgcctgagaacgagattgagttgacacttggtgcgggagcagatgatcctccaacaaccatttccttgaggccagaattccagcgtgatcgactatcacaacaaagccctgaagaggaatcagtacttgcttcaatgctgatgcgtccgtggcctgcaacagctatcagtacagcaagcttcgaaggagatgatgaaagattgaaccgaatcaaacgaattttcataaagatgcagcgtgaccacatgctggatcctcaacagcaagattccatgatcaagaagtggccacccagcgaggttttggccatagatacagatcacagtcccttcttctctgcaccagaacagctgtttaatttaatagtcaaatctctatgatgcataaatgcagaaagctacagactggggttgcccggattcttgtaacactacccacaaacaataatcaacacaagatttacgacctcagatttgtcaaacatgcttctcagtgattcttc

SEQ ID NO: 913 - DNA, 985 bp, Zea mays
tttggactggcgaagaaaatgcaggcccccctgctgctgctgcacgtccgtcaaatagattggtagggagcccagagggtgatgggaatggcgaaggagcagcacttcgtgcttgttcatggcgaagggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgggttaccgactttgcccgagaacgagattgagttgacacttggtgcaggagcagatgatcctccaacaaccattgccttgaggccagaattccagcgtgatcgactatcacaacaaagccctgaagaggaatcagtacttgcttcaatgctgatgcgtccgtggcctgcaacagctatcagtacagcaagcttcgaaggagatgatgagagattgaaccgaatcaaacgaactttcataaagatggagcgcgaccacatgctggatcctcaacagcaagactccatgatcaaaaagtggccacccagtgaggttttggtcatagatacagatcacagccccttcttctctgcaccagaacagctgttcaatttaatagtcaaatctctatgatgacaaatgcagaaagctactgactggggttgcccaaattcttgtaacactacccacaaacaataatcaccacaagatttaggacctcagatttgtcaaacatgcttctcaatgaatcttcctggcatatccgcatatctac

SEQ ID NO: 914 - DNA, 960 bp, Oryza sativa; identical to SEQ ID NO: 24

SEQ ID NO: 915 - DNA, 828 bp, Oryza sativa
gcgcaaatgtagttgtcctggaggatatcaatcaaataatccccctccatccttcagtaattggcctccaaacacagagcccgaatgagcatggcaagggagcactttgtgcttgttcatggagaagggcatggatcctggtgttggttcaagcttcgttggctccttgagagctctggttaccaagtaacatgcatagaccttgctggagctggtgttgaccctaccgaccccaacacagttcgatcatttgagcagtatgacaagccgctcctggacctcatctcagccataccagaggatgagaaggtgattttggttggacatggttcaggagggttgagtcttattcatgcaatgcaccaattcgttgacaggattagacaagcaatttttgtggcagctacgatgctaccatttggacttcaaactgacgaagataagaaagatggtttaccaacattgcctgagaatgagatcaatttgatattcggcacaggagcagatgatcctccaacaactgctgccctgagaccagaattccagagagagagattatcccaacagagtcctgaagaggaatcagtactcgcttcaatgctgatgcgtccatggcctgtgacagctattagcactgcaagctttgaaggagatgatgagagactaaatcgaatcaaacgggttttcataaagacagaacgtgaccatatgctgaaccctcagcagcaagattccatgatcaagaagtggccacccaggaaaagctgccaaagaaggcaacctcctccaatcactccttccttccaagaactcaagaaaattctgtaa

SEQ ID NO: 916 - DNA, 1069 bp, Sorghum bicolor
actggacgccttgtcggtttgacatttaatttggactggccatgaaaatgcagctcccctgctgcatgtccatcaaatagttaaacatagattggtaggcagaggccagactgataggaatggcagcaaaggagcactttgtgcttgttcatggtgaagggcatggagcctggtgttggttcaagctccgctggctccttgagggcgctggctaccgtgttacatgcattgaccttgccggaggtggcgtcgatcctactgatcccaacacaatccggtcgttcaagcagtatgacaagccgctcatagatctcatttcaaccttgccagagggggagaaggttattctagtcggacatggtgctggagggctgagtgtgatccatgcaatgcatgaattcgttgacaggatcagtcaatcattttttgtggcagctacaatgctaccatttggatttcaagctgatgaagataagaaagatggattaccaactttgcctgagaacgagattgagttgacacttggtgcaggagcagatgatcctccaacaaccattgccttgaggctagaattccagcgtgatcgactatcacaacaaagccctgaagaggaatcagtacttgcttcaatgctgatgcgtccgtggcctgcaacagctatcagtacagcaagcttcgaaggagatgatgagagattgaaccgaatcaaacgaattttcataaagacggagcgtgaccacatgctggatcctcaacagcaagattccatgatcaagaagtggccacctagtgaggttttggtcatagatacagatcacagtcccttcttctctgcaccagaacagctgtttaatttaatagtcaaatctctatgatgcacaaatgcagaaagctacagactggggttgcccaaattcttgtaacactacccacaaacaataatcaccacaagattttggacctcagatttgtcaaacatgctcctcagtgaatcttcaaggcatatctgcaaaaatggtttaatgctgcaagactgcaataaaacatcgctcagcgcgaacacttacct

SEQ ID NO: 917 - DNA, 1005 bp, Panicum virgatum
aattggccatgcaaatgcagttaccctgctgcatgtccatcaaatagttaatatccatggtaacagaaacttggattgatagggagaggccaaactaatgggcatggcaaaggagcactttgtgcttgttcatggggaaggtcatggagcctggtgctggttcaagctccgttggctccttgagggctccggttaccgcgtcacatgcattgaccttgccggaggtggagttgatcctaccgatcccaacactgtccgatcattcaagcagtacgacaagccgctcatggacctcatctcaaccttgccagagggtgagaaggtgattctagtcgggcatggtgctggagggctgagtgtaattcatgcaatgcatgaatttgttgacaggatcagtcaagcattttttgtggcagctacaatgctaccatttggattgcaaactgatgaagataagaaagatcagatgatcctccaacaaccgttgccttgagactagaattccaacgtgatcgactatcccaacaaagccctgaagaggaatcagtccttgcttcaatgctgatgcgaccgtggcctgcagcagctatagtactgcaagctttgaaggagacgatgagagattaaatcgagtcaaacggattttcataaaggcagagcgtgaccatatgctgaaccctgaacagcaagattccatgatcagaagtggccacccagtgaggttttggtcatagatacagatcacagtcccttcttctctgcaccagaacagctctttaatttaatagccaaatctctatgatacaagtatgcagaaagctacagtgtggggcctaccctactcgtaatattagccacacacaataatcagcaccagatttaggatctcacttttgtgaaagatgtttctaagtgaatattcaaggtacatctgcataaatggttcaagggtgcaactaagatatggtcttgttccattttaaacatgatcacaagtcactcatg

SEQ ID NO: 918 - DNA, 2603 bp, Oryza sativa
aaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgccgtcgtccccgccctcaccgcctccaccgccgactccctctggccctccaacggcttcctcctccagctctccgacggcctccactccacctacgtccagccctcctccgccgacgccgacgccctcgtctccgcgcgcccgcaactcgtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtaggagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggaagccactgaacgaagagacgcagcagcaattgctgcagctgatgctctgcaggaggcattaatcactgaatccgtaatcaggaacctaagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaa

SEQ ID NO: 919 - DNA, 872 bp, Brachypodium distachyon
gtcgatggcgaaatgcagcaagatccgcaacatcgtgtggctgcggcagacgctgcggcggtggcggtcgcgcgccgcggcccgttccgcctcgtcctcgtctccggtcccggcgggccacgtggcggtgtgcgtgggcggcgcgtcgcggcggttcgtggtgcgggcggcgcacctgaaccacccggtgttccgggagctgctgaggcaggcggaggaggagctcggcggcttcccgtccttccatggccccgtcgcgctcccgacctgcgacgaggcgctcttcgagcacgtcctccgccacctctcctccccttcccccgccgcgcgcttcctcaccctcgacgacctccagtcagccgccggcgccgccctctccccctgctgctgcgccgccgccgacgcgctcccgctcctccgcggcatctcctccgacaagttcgtctggtgatctcatctccaagcaagcgaagctagctatagccgccgcgcgctccacgccatttgtggtggccgtcgtgttattttctctttctttttcctccttttttttgggggttctcttctccctgtccctgcattgccgagaggtcggagctgcgctgccgcgacggagcgaggtcgagcggccggccggaggcggtggagtgagatggctgagaacgtctttgggattttttggagacggccgagtctagccatccattcattcgattcaaacccgggagaaattatttagtgccggtgatttgttcttttttctttcttttttttctctcggttcagtcactgaataatttcacccactgtaaatagcctgtgctatgatccggccgacaattgcaagtgaaatgaaacattctttttctgga

SEQ ID NO: 920 - DNA, 1174 bp, Zea mays
tgcctccaagtccaagccacctctcagctctcaccagctagctctactctcgcggcgcttcccctcgccgttcgtcgccatcgattgacattggtccaacccaaccgcgcagctagatagatctacgtcgaccggcggccgtgagggacgaggcgcgcgctcggtcgctcgctcgtgcgtcgacatggcgaaatgcagcagcaagatccggtacatcgtgtggctgcggcagacgctgcggcggtggcggtcccgcgcggcggctcgcgcggcggtcccggcggggcacgtggcggtgtgcgtgggcggcgcggcgcggcggttcgtggtgcgggcggcgcacctgaaccaccccgtgttccgggagctgctccggcaggcggaggaggagtacgggttcccgtcgggggcctgcgcgggccccatcgcgctcccctgcgacgagggcctcttcgagcacgtcctccgccacctctcctccccgtccaagtccgcccgcttcgtcaccctcgaggacctcgagagcggcgcactgtcctgctgctgcgtcgccgccgccggagactcgctcccgctcctccgcggcatctccgccgacaaggccgtctggtgagcgcgccgccctgcccattgcgggcgcgggcgcgacggccgtttcgccggagactcgctcccgctcctgtacggcgacggccatttcgtcgtctcgtctcttttttcttcttttaaccactttttcgcgctcgctcccttcgttccaatcccacccgagtggagtggagctggacgcggcggggacagacacctcgacgacgagcaagaggagtgcggccggccggaggcggtgaagtgagatggctgagaaagtcctaggattttttagacgactgtcaagtctagtcatccattcattccccccctgttgtaagatcaattcgggaatttagtggctaagttttatttctttttttctttgcctttttttaataatcattcagtactgctgcggttcggccagcattgttgcaagtgaaaaacattcgtttattttcccgctacagcggagtaaaaccgtgatcgtgtggactgcttggccgacgcgcgggtatttttcttttgggtcttgcctctctgcgtagtattttccaaatgttctcacttcccgagtgcttta

SEQ ID NO: 921 - DNA, 1074 bp, Sorghum bicolor
gcctccaaaagccagccagctcgatttcacctcgccaccaccagctccgctctcgccgccctcccccacgccgtccgtcgccattgattgagattggcccaacccaacgcaacccaaccgcgcggctagagcttcctcgaccggaggccgtgagggcgtgcgctcgctcgctcgctcgtgcgtcgacatggcgaaatgcagcagcaagatccggtacatcgtgtggctccggcagacgctgcggcggtggcggtcccgggcggcggcgcgcgcggcggtggaggcggcggcggtcccggtcccggcgggccacgtggcggtgtgcgtgggcggcgcgtcgcggcggttcgtggtgcgggcggcgcacctgaaccaccccgtgttccgggagctgctccggcaggcggaggaggagtatgggttcccgtcgggggcctgcgccggccccatcgcgctcccctgcgacgagggcctcttcgagcacgtcctccgccacctctcctccccgtccaagtcctcccgcttcgtcaccctcgaggacctgaagagcggcgccggcctatcctgctgctgcgttgtcgccgccggcgactcgctcccgctcctccacggcatctccgccgacaaggccgtctggtgagcgcgccgccctgcttgccggagccagccaccaccgtgcccactgcgcgcgcgacggccatttcgtcctcctctatttttcttctttttcccctttttcgcgctcgctccctccgtttccacctgagtgagtggagctgaacgcggcggaggcagacaacctcgacgagcaagatgagcggccggccggaggcggtgaagtgagatggctgagaaagtcctaggatttttagacgactgtcaagtctagtcatccattcattcccctgtcaaatcaatgcgggaaattttagtggctaccgagatttattcttttctctttctttttattttctctctcactcactcaataatcctccactgtaaatacatgtgtgctactgcggctcggcctgcattgttgcaagtgaaaaaaaacattcgttttcttctgct

SEQ ID NO: 922 - DNA, 1325 bp, Saccharum officinarum
  misc_feature (846)..(846): n is a, c, g, or t
  misc_feature (1085)..(1085): n is a, c, g, or t
  misc_feature (1269)..(1269): n is a, c, g, or t
cggacgcgtgggttcacctcacaccaccagctccgtgctcccccacgccgcccgtcgccattgattcacccgacccgacccgacccgacccaaccgcgcggctagagctacctcgaccggcggccgagagggcgtgcgctcgctcgctcgctcgtgcgtcgacatggcgaaatgcagcagcaagatccggtacatcgtgtggctccggcagacgctgcgccggtggcggtcccgcgcagcggcgcgcgcggctgcggtggaggcggcggcggtggtcccggtcccggcgggccacgtggcggtgtgcgtgggcggcgcgtcgcggcggttcgtggtacgggcggcgcacctgaaccaccccgtgttccgggagctgctccggcaggcggaggaggagtacgggttcccgtcgggggcctgcgcgggccccatcgcgctcccctgcgacgagggcctcttcgagcacgtcctccgccacctctcctccccgtccaagtcctcccgcttcgtcaccctcgaggacctcaagagcggcgccggcctgtcctgctgctgcgtcgccgccgccggcgactcgctcccgctcctccacggcatcgccgctgacaaggctgtctggtgagcgcgccgccctgctcgccggagccagccaccccagtgcccattgcgcgtgcgacggccatttcgtcctcctttttttttcttggggtattcttttcccccctttttcgcgctcgctccctccgtttccacctgagtgagtggagctgaacgcggtggagacagacaacctcgacgagcaaggtgagagcggtcggccggaggcggtgaagtgagatggctganaaagtcctaggattttttatgactgtcaagtctagtcatccattcagtcccctgccagcattgttgcccgtgaaaaacattcgttttcttctgctaccacggtgtaaaaccatatgcggctcggccagcattgttgcaagtgaaaaacattcgttttcttctgctaccacggagtgaaaccataatcttgtggactgcttggccaacggctatttttagcatatattttcagatgaatnttctctacattctttccaaatgttcccggtttttttttagcaaatccaaatgttcccaggtgcgttagaagagagagcagtggaatcagttcctcttcgatcgaacaaaattattttgaatttgtcactgcaggtggactcgatgcatattaggcccatttgctagtggcaaagttaggacgtntcactgaactggctgctcacatctaccagtgacagagttagaagggaatattcttc

SEQ ID NO: 923 - DNA, 1010 bp, Panicum virgatum
catttctcaccaccagcagctcgctctcgctctcgccgcgcctgacccacgctcgccattgattgattgatttccacccgcgcgtaggagcgagcagcggcaacaacaaccgcacagctagccgagctcgacccggctggcgtcgatggcgaaatgtagcagcaagatccgctacatcgtgtggctccggcagacgctgcggcggtggcggtcccgcgccgcggcgcgcgcggcggtggcggcggaggcggtggtcccggcggggcacgtggcggtgtccgtgggcggcgcgtcgcggcggttcgtggtgcgggcggcgcacctgaaccacccagtgttccgggagctgctccggcaggcggaggaggagtacggcttcccgtccggcgcctgcgcgggacccatcgcgctcccctgcgacgagggcctcttcgagcacgtcctccgccacctctcctccccgtccaaggcctcccggttcgtcaccctcgaggacatcaagagcggcacgctctcctgctgctgcgtcgccgccgccggcgactcgctcccgctcctccacggcatcgccgccgacaaggccgtgtggtgaacgcgctcacggagggtagccgccgcccgcgccattgcgcgtacgtgtgcgaccatttcatcttccttttcttcttcttttctttctttttgccctcgctccctccatttccatccgagaggagctgaggcgcgacgggagcaagcaagcaagcaagattgagcacggccggccggaggcggtgaagtgagatggctgagaaagtcctaggatttttagacgactgccagtctagtcatccattcattcccttgtccaatccgggaaaattttagtggtgaagatttattctttcttcttttcttttcctttccttttcctttccttttcgtctcacttaataatcctccactgtaaatacctgtactactacggttcggccagcattgcaagtgaaaaaaaaaatcattgtcttctc

SEQ ID NO: 924 - DNA, 1177 bp, Triticum aestivum
  misc_feature (17)..(17): n is a, c, g, or t
  misc_feature (66)..(66): n is a, c, g, or t
  misc_feature (934)..(934): n is a, c, g, or t
ctcctcctctccccacncaacaacagcagaccagcaggcagcacagcagcacagtccctcaactgncgatggcgaaatgcagcaagatccgcaacatcgtctggctcaggcagacgcttcggcggtggcggtcccgcgccgcggcgcgcacggcggctggcggaggcgccggcgccgtgtcggtgccggcggggcacgtggcggtgtgcgtgggcggctcgtcccggcggttcgtggtgcgcgcggcgcacctgaaccaccccgtcttccgggagctgctcaggcaggcggaggaggagtacgggttcccctccggcgcctccggcgcgtgcggccccatcgcgctcccctgcgacgagggcctcttcgagcacgtcctccgccacctctcctcctcatcgtccgccgcgcggttcttcaccctcgaggacatcaagagcggcgcctactcgtgctgctgcgcggccgccggcgacgcgctcccgctcctccgcggcatctcgtccgacaagttcgtctggtgactccaatccgagctaggccagccggctagccgcgcgcgctccacgtcattgtgctggtggtggccgtcgtgttttttgtttctttttcgttttcctctccctccctccattgtcgccgggcggagcagagccgccgggacggagcgagaggtcgtgagcggccggcaggaggcggcgaagtgagatggctgagaaacctccgggtcttgagacgcccggggtctagccatccattcactcccttgtcaaatccgggcaggaaaattacttagtagtgccgggatttattctttcttcttcttcttcttcttgattattttcttcacttactgaataattcaccctgtaaatagctagcccgtgctccggcgattcggccgacattgcaagtgaattgaagtgaaacattnctactactacctagttcttaaaaaaaaaaaaaaaagggcggccctctagaagtaccctcgagggggcaagcttacccgtaccaggtttcttgtacaaggtggccctataggagttggattataactagcccgggccgtgtttaaaacgcctgactggaaaacggctattggaattttgggaggaaccttatttggggtgtgcatatgggcaaactccccacaaattaaaccctagggaaatta

SEQ ID NO: 925 - DNA, 1929 bp, Oryza sativa
atcaaacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctaccctctcctccaccaccttcacctcctcctccatctccaccaccaccatctccatcgcctcctccaccttctcccccgccgccgtctcctccaccaccatcgccatcgccgcctccaccatctccaccgcctccatctcctcctccgccatcgccagtgtactacagctcgccgccgccgccgtactacgaggtttcaccggaggacaggtacctctcgccgccgccacctccggcgtaccacgaggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgattttcttttgcttgtactgtatgtatttttcttcttttatttttttctccttctttgaatgaacagcaggaaatctgcttttcctccc

SEQ ID NO: 926 - DNA, 964 bp, Oryza sativa
gctgatgctttttaatcctcttcttccccggcccatgcatattctctctgctttaatggtgtgaaatttcagaacaagaatctagtttccgcatacagagttccagaaatttccgactgttcatctcatcgatcatccgcgattctttttttagtttttgatggtgatcagccacaccgctagctagttgacacatgtatgcagtagcaatatttgttagctgaaaaggaagcaaggaggaaagcagcaaatcagctttgttgccaagctgcttggcagagagacaaagtaattgaccatggcaaaagatcctcatgtctccatctctctcaccggcctcgccatggtcgtcctcctcatcttcagctcctccttcctccaggccgcccaaggatcagacaagaagatggcaatgaagtacgacgtgccggtgaagaggctggtgtaccggccgtcggcgatgcaggcggcggtgatcggcacggaggcggcggcgtacgagccgttcgagctgtgcatgggctgccggtgctgcgcgtcgtcgaacgcgagcagctgcgtggacacgagatgctgctacgccatcgactgcaacatccccggcaagcccttcggcgtctgcgccttctctccccacacctgcgactgtggtgccaccaactgcaccagccaacagcagccatgaccacacacctcttgctgctgctaattcaattcgatctcttccatgatcaatatacttatgcgcctgaatcattcaactgttttctgatgcgattgcaaacgtattaagttttttcagagattcttgggacttagatatcctgacatgagcatgttgatctgaaagtttaactgcatatagaatcttcagaaagggattaattcttgatctaccagttccacaaacaatttattcgtgctttaaatctggatttgcattctctcttatcagagagtaatt

SEQ ID NO: 927 - DNA, 829 bp, Brassica rapa
gaaatggctgcttctgctgcgcccccgtgcgtccgcatctcctcttccacaccttcactgaccgctctccgccggccacgccgccggcgcgtcacctccgcccgatgctccctcgccgcagcccccggtctccgggcgccggcggagctcgtcgactccatcctctccaaggtgaagggaactgacaggggcgtgctgctgccagcggaaggccaccaggaggtggccgatgtggcgctgcaactggggaagtactgcatcgacgagcccgtcaagtccccgcttatattcggagactgggaggtggtgtattgctcggtgccgacatccccgggagggatttaccggacccctctcggccggctggtgttcaagaccgacgacatggttcaggtggtggaagcccccgacattgtcaggaacaaagtgtcattctccatctttggcctcgatggcgccgtgtctttgaaaggcaagctgaatgtattggacagtaagtggattcaggtcatatttgagcccccggaactgaaggtaggctccttgggtttccgatacggtggcgagagcgaggtgaagctggaaatcacctatgtcgacgagaagatcaggctcggaaaaggatcccgaggctcgctctttgtcttcctgagacaatgatagaagggtaggcacgtatatggtactatgccaccattgcatatttgcatgtgctcgacgccacaagggatatcagccatataggcggctgcacaactggttgcagatgtaaaattcagagataaagcccacaaagtagttctttatgatattaatttctacctgaagc

SEQ ID NO: 928 - DNA, 948 bp, Festuca arundinacea
  misc_feature (432)..(432): n is a, c, g, or t
  misc_feature (470)..(470): n is a, c, g, or t
  misc_feature (479)..(479): n is a, c, g, or t
  misc_feature (533)..(533): n is a, c, g, or t
  misc_feature (540)..(540): n is a, c, g, or t
  misc_feature (571)..(571): n is a, c, g, or t
  misc_feature (581)..(581): n is a, c, g, or t
  misc_feature (587)..(587): n is a, c, g, or t
  misc_feature (602)..(602): n is a, c, g, or t
  misc_feature (608)..(608): n is a, c, g, or t
  misc_feature (687)..(687): n is a, c, g, or t
  misc_feature (696)..(696): n is a, c, g, or t
  misc_feature (735)..(735): n is a, c, g, or t
  misc_feature (767)..(767): n is a, c, g, or t
  misc_feature (785)..(785): n is a, c, g, or t
ggcacgaggggcagaaggaaatggcggcttctgctcccccctcttgcgtccgcatctcctcctccacacctccactgaccgctctccaccggccatgccgccggcccgtcccctccgtccgatgctccctcgctgcagcccccggcgtccgggcaccggcggagctcgtggactccatcctctccaaggtcaagggaactgacaggggagtgctgctgccgaaagaaggccatgaggaggtcgcggatgtcgcgctgcagctggggaagtattgcatcgacgagcccgtcaagtccccgcttatattcggagagtgggaggtggtctactgctcggtgccgacatcacctggagggatttaccggacccccctcggccgtctggtgtttaaaaccaacgacatggttcaggtggtggaagcccctgacatantccggaacaaattgtccctctccgtctttggtctcganggtgcggtntccttgaaaggcaagctgaatgtattggacagcaagtggattcaggtaatcttngagcccncggaactgaaggtaggctccttggggtttcnatacggtggngagagngaagtcaagctgganatcacntacgtcgacgagaagatcaggctcggaaaaggatctagaggctcgcttttcgttttcctgagacagtaatagaagggtngagggcagngccctatgttaccataccaccattggacgtgcttaaggncacaaggtatatcggcacagtaactgtattcngatgtaaattcagagatncaacccttgaagtagttttcccagatatttctacctgaattgaagcagattgccctgtttgttgtgaacgaaaatgtttgcagtattcatgctgaccttgttctcggatgtacttatgataacgttgggggttttatgagcaggaacaatggtggtttgagga

SEQ ID NO: 929 - DNA, 819 bp, Leymus cinereus x Leymus triticoides
  misc_feature (784)..(785): n is a, c, g, or t
  misc_feature (787)..(788): n is a, c, g, or t
gaagaagaaaatggcagcttgtgctgcgcccccttgcgtccgcatctcctcctccacaccttcactgaccgctctccaccggccacgccgccggcgcgtctcctccgcccgatgctccctcgccgcagcccccggtctccgggcgccggcggagctcgtcgactccatcctctccaaggtgaagggaactgacaggggcgtgctgctgccggaggaaggccaccaggaggtcgccgatgtcgcgcagcagctggggaagtactgcatcgacgagcccgtcaagtccccgcttatatttggagactgggaggtggtgtattgctcggtgccgacgtcccccggagggatttaccggacccctctcggccggctggtgttcaagaccgacgacatggttcaggtggtggaagcccctgacatcgtgaggaacaaggtgtccttctccatctttggcctggatggcgccgtgtctttgaaaggcaagctgaatgtattggacagcaaatggattcaggtcatatttgagcccccggaactgaaggtaggctccttaggtttccgatacggcggcgagagtgaagttaagctggaaatcacctatgttgacgagaagatcaggctcgggaaaggatctagaggctcgcttttcgtcttcctgagacaagattagaagggtaggttgcatattttcatgtgctcgacgccacaagggatatcagccatatgggtgtctgcacaactgcttgcagatgtaaattcagagataaagcccacaaagtactanngnnttatgatattaatttctacctgaaaaaaaaa

SEQ ID NO: 930 - DNA, 1232 bp, Zea mays
acgcggtcgttctcacgttggcggctggccaccattccctgtctcgtgctcacggcgggcggcagaccgccaggcgccaccgcgccagaccagctgaccagcaggcggcagtgcaggccatcagccgtcacggctctccctcaggtcggcagtgcaggccatcagccgccaaccgatctagtagtgcagaccgccagaggccaggtgaccaggtcggcagtgcagccgtgcaggcggccagccctctccaggcgtccagctaccaccacacacacgaagagcaggcgatgaaaatgtccgcttccgttgcggccgcctcccccaccctccgcttctcctccgccactcatcctctccaccgaccgctccgccggcggctcccgtcggttcgatgctccctcgccgccgccgccggccccggtgtccgggcgccccctgagctcgtcgactccatcctctccaaggtgaagggaactgaccgaggagtgctgctgccaaaagatgggcaccaggaagtggctgaggtcgcgctgcagctggggaagtactgcatagacgaccccgtcaagtccccgcttatattcggagaatgggaggttgtgtactgctcggtgccaacctcgccgggagggctctaccggacgccccttggccgcctggtattcaaaaccgacgagatggtccaggcggtggaagcgcctgacgtggtcaggaacaaggtgtcgttctccgtctttggcctagagggcgcagtgtcattgaaaggtaagctgaatgtgctggacagtaaatggattcaggtcgtgttcgaagcaccagaactgaaggtcggctccttggggtttcagtacggtggcgagagcgaagtcaagctggagatcacctatgtcgatgagaagatcaggctagggagagggtccagaggctcgcttttcgtcttccttagacgatgatagaatggcatgcatgtgtgttgagacttcagacccacaagcaccgatgaggggtggcgctgacgcggtcgtttgtacaatactgtgttcaggacttctatacgtttatgtaaaaattctggcgtccagctgggtaattctggcgtttcagtacggtggcctgatgaatgttgttgtgtagtttgtagcatccattattagtgctgtaagatgatgttttgaattctgatacaccagtgcgagtgtgatgaaccaaattcatacgacacgtttggacca

SEQ ID NO: 931 - DNA, 890 bp, Zea mays
gcttccgttgcggccgcctcccccaccctccgcttctcctccgccactcatcctctccaccgaccgctccgccggcggctcccgtcggttcgatgctccctcgccgccgccgccggccccggtgtccgggcgccccctgagctcgtcgactccatcctctccaaggtgaagggaactgaccgagaagtgctgctgccaaaagatgggcaccaggaagtggctgaggtcgcgctgcagctggggaagtactgcatagatgaccccgtcaagtccccgcttatattcggagaatgggaggttgtgtactgctcggtgccaacctcgccgggcgggctctaccggacgccccttggccgcctggtattcaaaaccgacgagatggtccaggcggtggaagcgcctgacgtggtcaggaacaaggtgtcgttctccgtctttggcctagagggcgcagtgtcattgaaaggtaagctgaatgtgctggacagtaaatggattcaggtcgtgtttgaagcgccggaactgaaggtcggctccttggggtttcagtacggtggcgagagcgaagtcaagctggagatcacctatgtcgacgagaagatcaggctagggagagggtccagaggctcgcttttcgtcttccttagacgatgatagaatgacatgcatgtgtgttgagacttcagacccacaagcaccgatgaggggtggcgctgacgcggtcgtttgtacaatactgtgttcaggacttctatacgtttatgtaaaaattctggcgtccagctgggtaatgcagacttagcctgatgaatgttgttgcgtagtttgtagcatccattattagtgctgtaagatgatgttttgaattctgatacacacagtgcgagtgt

SEQ ID NO: 932 - DNA, 946 bp, Oryza sativa
agctatcagcttatcaccacacacagacacagaaggaaatgtcggcttctgcggcgcccacgcacatccgcttctcctccgccgcacctccatcggccgccgctctccggcggcctcgccgccggtgcgccacgcccgtccgatgctccctcgccgcagcgccgggtctccgggcgccgcctgagctcatcgactccatcctctccaaggtgaagggaactgaccgtggagttttgctgcccaaagatgggcatcaggaagttgctgatgtcgcactacagcttgccaagtactgcatagacgatcctgtcaagtctccactaatatttggagagtgggaggttgtgtactgctcagtaccgacatcaccgggagggctctaccggactcctctcggccgcctgatattcaaaaccgatgagatggctcaggtggtgcaagcgcctgatgttgtaaaaaacaaggtgtccttctctgtctttggtttcgatggtgcggtatctctgaaaggcaagctgaatgtgctggatggtaagtggattcaggtcatattcgagccaccagaagtgaaggtaggctccctggggtttcagtatggtggcgagagcgaagttaagctggagatcacctatgtcgacgagaagatcaggctgggaaaaggatcaagaggctcgctcttcgtcttcatgagacgatgatatgagggcagcaggcaatgtttgtaccatcatgtcctttgagaccacaagagggtagcaccatagcactgatgctacgacaatatgtttgtgtgtacaatactgtattctgttgtaaaattcagaggtcatgttggctagtagtgttcttcagacctccgaattagagattgtattgtcatttccaatcaaaatgacaaaatgtttgtagtttttgtgattaatgtgatggttaaattgtccagact

SEQ ID NO: 933 - DNA, 1010 bp, Sorghum bicolor
aggactagagcagacgatgaaaatgtccgcttccgctgcggccgcctcccccgccctccgcttctcctccgccactccaccactagctcctctccatcgaccgccccgccggcggctcccgaccgtccggtgctccctcgccgccgcccccggtgtccgggcgccaccggagctcgtcgactccatcctctccaaggtgaagggaactgaccgtggagtgctgctgcctcaagaaggtcaccaggaagtggctgatgtcgcgctgcagctagggaagtactgcatagacgaccccgtcaagtccccgcttatatttggagaatgggaggtcatgtactgctcggtgccaacctcgccaggagggctttaccggacgcctctgggccgcctgatattcaaaactgatgagatgattcaggtggtggaagcacctgacatagtgaggaacaaggtgtcattctccatctttggcctagagggcgcagtatcattgaaaggtaagctgaatgtgttggacagtaaatggattcaggtcatatttgaagccccggaattgaaggtaggctccttggggttccaatacggtggcgagagtgaagtcaagctggagatcacctacgtcgacgagaagatcaggctaggaaaaggatccagaggctcgctcttcgtcttccttagacgatgataagaatggcagcatgtgtgtactggcatatgctttgagttgagaccacaagcacaagggatggcactgatgtggtcgtctgtacgatattgtacgtattcagggtttttacatgtaaaattcaggagtaaatctgggctggtagctgcagatttaacctgacgaacattgttgtgtagtttgtggacggcagtccatattgcatgtagtattcattggtgttgtataagataatgttttggattctgatacaccagtttgacgaaccaaatcaacacgacacgtttggactacagagtaacagagatccaaattttgtagaacg

SEQ ID NO: 934 - DNA, 922 bp, Saccharum officinarum
  misc_feature (700)..(700): n is a, c, g, or t
  misc_feature (729)..(729): n is a, c, g, or t
  misc_feature (738)..(738): n is a, c, g, or t
  misc_feature (747)..(747): n is a, c, g, or t
  misc_feature (773)..(773): n is a, c, g, or t
  misc_feature (883)..(883): n is a, c, g, or t
atggaaatgtccgcttccccggccgcctcccctgccctccgcttcttctccgccactccaccactagctcctctccgccgaccgctccgacggcggctcccatccgttcaggtgctccctcgccgccgcccccggtgtccgggcgccaccggagctcgtcgactccatcctctccaaggtgaagggaactgaccgaggagtgctgctgcctaaagatgggcaccaggaagtggctgatgtcgcgctgcagctggggaagtactgcatagacgaacccgtcaagtccccgcttatatttggagaatgggaggttgtgtactgctcggtgccaacctcgccaggagggctttaccggacgcctctaggccgcctgatattcaaaactgatgagatgattcaggtggtggaagcacctgacatagtgaggaacaaggtgtcattctccgtctttggcctagagggtgcagtatcattgaaaggtaagctgaatgtgttggacagtaaatggattcaggtcatatttgaagccccagaactgaaggtaggctccttggggtttcaatacggtggtgagagcgaagtcaagctggagatcacctatgtcgacgagaagatcaggctaggaaagggatccagaggctcgctcttcgtcttccttagacgatgatagaatcgcagcatgtgtgtaccagcatatgcntttgagttgagaccacaagcacaaggganggcactgangtggtcgtntgtacaatattgtattcagggttttnacatgtaaaattcaggtgtcatctgggttggtagctgttcttctgcagattaaccgaacattgttgcgtagtttgtggatgacgacagtccatatgcatgtagcatccantagtgttgtataatataagatgatgctttggattctgat

SEQ ID NO: 935 - DNA, 969 bp, Panicum virgatum
gacgcgaaacacaaaggagaaacatgttcgcttccgctgcggccgtctcccccgtcctccgcctctcctccgccactcccccacttgctcctctccaccggccgttccgccggcggctcccgtccgtccggtgctccctcgccgctgcccccggtgtccgggcgcccccagagctcgtcgactccatcctctccaaggtgaaaggaactgaccgaggagtgttgctgcctaaagatgggcaccaggaagtggctgatgtggcactgcagctggggaagtactgcatagaggagcccgtcaagtccccacttatatttggagaatgggaggttgtgtattgctcggtgccaacgtctccaggagggctataccggacgcctcttggccgtctgatattcaaaactgatgagatgatccaggtggtggaagcccctgatgttgtcaggaacaaggtgtcattctccgtctttggtctcgagggtgcagtatcgttgaaaggtaagctgaatgtattggacagtaagtggattcaggtcatctttgaggccccagagttgaaggtaggctccttggggttccaatatggcggggacagcgaggtcaagctggagatcacttatgtcgacgagaagatcaggctcggcaaagggtctagaggctcgcttttcgtgttcctcagacgaggatagaacgacatgtgtgcactggggtgtgctcgagacctcaagcacaagggatggcactgatgtggtcgtctgtacaatattgtattcaggatttcacatgtaaaattcagaatccaatttgggtagcagttttcctgcatattgtaacctgaagaacgttgtctggtcgttttggacgacaagtggacaaccgaagatgcatgtagcattcattagtgttttaacttgtaagatggcgttttgtcaactaagcgatttatttggaacttggaatttttggggt

SEQ ID NO: 936 - DNA, 1090 bp, Triticum aestivum
  misc_feature (161)..(161): n is a, c, g, or t
  misc_feature (264)..(264): n is a, c, g, or t
caccgcgtttttgccctccctaaaaaaaccccgggcccattccaccctccggattctaacctagggccccgggcgggattaccatttcacccaggaaacaggtatacccattaggccattttaggtgaccatttaggaacaagtttggacaaaaaaacccngccggtaccggtcccgaatttcccgggatattgtgaacccaacgcgtccgcgaatggaggcagaggaccactgacctggactgaaagagtagaagcccacacnaactccagaagaaaatggcggcttgtgctgcgcccctttgcgtccgcatctcctgctccacaccttcgcctaccgctctccaccggccacgccgccggcgcgtcacctccgcccgatgctccctcgccgcagcccccggtctccgggcgccggcggagctcgtcgactccatcctctccaaggtgaaggggactgacaggggagtgctgctgccagaggaaggccaccaggaggtcgccgatgtcgcgcagcagctggggaagtactgcatcgacgagccagtcaagtccccgcttatattcggagactgggacgtggtgtattgctctgtgccgacgtcccccggagggatttaccggacccctctcggccggctggtgttcaagaccgacggcatggttcaggtggtggaagcccccgacatcgtcaggaacaaggtctccttctccatctttggcctcgatggcgccgtgtctttgaaaggcaagctgaatgtattggacagcaagtggattcaggtcgtatttgagcccccggaactgaaggtaggccccttgggtttccaatacggtggcgagagcgaggtcaagctggaaatcacctatgtcgacgagaagatcaggctcgggaaaggatcccggggttctcttttcgtcttcctgagacaagattagaagggcaggcacaagggatatcagcgatataggcggccgcacaactggttgcatatgtaaaattcagagataaagcccacaaagtagttttgtatgatattaatttctacctgaagcagattgccttgttgtgagcgaaaatgtttgcggta

SEQ ID NO: 937 - DNA, 757 bp, Triticum aestivum
  misc_feature (696)..(696): n is a, c, g, or t
  misc_feature (709)..(709): n is a, c, g, or t
  misc_feature (711)..(711): n is a, c, g, or t
caaactccagaagaaaatggcggcttgtgctgcgcccccttgcgtccgcatctcctgctccacaccttcaccgaccgctctccgccggccacgccgccggcgcgtcgcctccgcccgatgctccctcgccgcagcccccggtctccgggcgccgccggagctcgtcgactccatcctctccaaggtgaaggggactgaccggggcgtgctgctgccggaggaaggccaccaggaggtcgccgacgtcgcgcagcagctggggaagtactgcatcgacgagcccgtcaagtccccgcttatattcggagactgggacgtggtgtattgctcggtgccgacatcccccggagggatttaccgcacccctctcggacggctggtgttcaagaccgacgacatggttcaggtggtggaagcccccgacatcgtcaggaacaaggtctccttctccatctttggcctcgatggcgcggtgtctctgacaggcaagctgaatgtattggacagtaagtggattcaggtcatatttgagcccccggaactgaaggtaggctccttgggtttccgatatggtggcgagagtgaggtcaagctggaaatcacctatgtcgatgagaagatcaggctcgggaaaggatcccgaggctcgcttttcgtcttcctgagacaagattagaagggtaggttgcatatttngcatgtgctcgangncacaagggatatcggccatatgggcgtctacgcaactgcttgcaga

SEQ ID NO: 938 - DNA, 676 bp, Brachypodium distachyon
atatggccacgctgcagctcaaccacatcgcgcgggagaccgccgacgtgcgcggcctcgccgccttctacgaggaggtgctcggcttcgagcgcgtcccttcgcccaactactccggcttccaggtcgcctggctccgcctcccggggagccccgacgtcgcgctccacatcatagagcgtgacccggccgtcgcggtctcctcccccgccgctgcgggtacctcgccgccgccgcccgcgcagctgcccaggaggcaccacctggccttctccgtggcggactacgacggattcgtgaccgggttgaggactcgcggcacggagatgttcgagaagacgcagcccgacggccgcacgcgtcaggtcttcttcttcgaccccgacggcaatggtctagaagttacaagctcaagcaaagccgataagtaacggtggagcatgatatgcccccaacttctgcaatagctgtgtactgccctcggagaatgaaatgatgaacaccgcaaaatcttactaggatcatgctttacgcccaaataacttatcaaataaacaatgaacttagtacttgggctacatgtatatctgccctcccatgcttgcaatatggatgtatatctgtaatactgaattctgtcgtgtgtactatacatcaagttgcaatgccgtgcttc

SEQ ID NO: 939 - DNA, 1011 bp, Zea mays
tttttttcgggtgaattctagatttctagtccggggaggagcgaactgatcacacacgtgtgcagcacgctgtcgctggcctagcggccctagcaagagtcaaagacgggcatcggcagcaacagcaccacactctcaagtcccaactcccaacattacgagacgcctcgccggccgcgccgcgcccaactcctctgatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggaccccgccgcggcacccgtcgcggtggggcctggcgccgagggcgcgccgccgtcgcagctgccccggcgccaccacctcgccttctccgtcgctgactacgacgggttcgtgaccgggctgaaggcgcgcggcaccgatgtgttcgaaaagtcgcagccggatgggcgcacgcgccaggtcttcttcttcgaccctgacggcaatggcctagaggttactagcgctggtgcagggaatgagaagtgaacagagaccatgatttgcagtctacttctattttatcgtgcaatacctcagcaaaccctgcctacatgatgcgatcgaaaccggagacgttcctgggtcaagcttcgttccgtaaaataaataaatccgaagcacttcaaagctctacatactcgcccttgcttgtttgagacaagggcttgcgttcttgctgcatctcatccgagatgattgtaatccgaacaatgtgtagttaataaaaatgtcgctttgccctgaaaatgttttacgctgtaacatcgctctgtacgtgattggatttcctacatgacaactggctaatggagtctaaataatttccttgtcattcactca

SEQ ID NO: 940 - DNA, 696 bp, Pseudoroegneria spicata
cacttcctgaccgatggcgacgctgcagctcaaccacatcgcgcgggagaccgccgacgtgcgcggcctcgccgccttctacgaggaggtgctcggcttcgagcgcgtcccctcccccacctactccggcttccaggtcgcctggctccgcctgccgggctcccccgacgtcgcgctccacatcatcgagcgggacccggccgtcgccgccgccaccgccccgggggccgcgggcgccccgcccgcccagctgcccaggcggcaccacctggccttctccgtggccgacttcgacgggttcctctccgtgctcaagacccgcggcacccacctgttcgagaagacgcagcccgacggccgcacgcgccaggtcttcttcttcgaccccgacggcaatggtctagaagttacaagctcgagcccaggcgataagtaacctgctgggagcatgccgaccaaaccgtagtgatacccacctcgagactgaagacgacggaagctgcagaatctgagagaaaacatccagtgccatgtgttactcccaaataaataatgaccttactacctatatctatctgctccccatgcctgtaatatggatatgcatgtctgtggctgaagactgaacttgtgctgtgtgttaaaacatcaagttaaattagtagtacaaatgatgtgctcttgcccatcaaatca

SEQ ID NO: 941 - DNA, 1106 bp, Oryza sativa
aaacaaaactgaggttgtgtttagattaggggtgtaaagttttggcgtgtcacatcggatatacgggcacacatttgaatattaaacgtagtctaataacaaaacaaattacaaaatccgtatgtaaaccgcgagacgaatttattaagcctaattaatccgtcattagcaaatgtttactgtagcacaacatcatcaaatcatggcgtatttaggcttaaaagattcgtctcataatttacacgcaatccgtgtaattaattattttttcgtttatactctctctttcatatagatgttaatactctgtaaatatgtgacactgcgctcgaaccccctcctctcttcgagtagcgcacacgtgtgcggtgcgcggcactacacattgccgtcctctcctctcactcttcttccgcctacgccgcgctccgctctctctccctctctgctctctcgccgcgatggccacgctgcagctcaaccacgtcgcgcgggagaccgacgacgtgcgccgcctcgccgccttctacgaggaggtgctcggcttcgagcgggtcgcctccccgaactacccggccttccaggtcgcctggctccgcctcccggggacgcccggcgtcgcgctccacatcatcgagcgcgaccccgcggcggcgcccgcggccgtcgccccgggcgccgcgggcgccccgcccgcgcagctgcccaggcgccaccacctcgccttctccgtcgccgactacgacgggttcctcaccgggctgaaggcccggggcacggacgtgttcgagaagacgcagcccgacgggcgcacgcgccaggtcttcttcttcgaccccgatggcaatggcctagaagttacaagctcaggcacaggcgatatgtaattgcggagcatgatttgcttgctgtaacagtcgtgcattgggcgtgggctagcaaacatggagacgcaaactgcatgttgttaggaacatgtccatgatatccccatgaataaattcggagctttatactgaatgaactgctccatgctgtaatatagctctatatgttactggattgcactaaaatatatctccaagttaaaatgttttgcttcttaa

SEQ ID NO: 942 - DNA, 1618 bp, Sorghum bicolor
ttccccgctgcgctggccagaccgcactctcaacaagtctcgacactacgagacgcctcgctggccgcgcctccccccaaagtcctctgtcctctgttcctcttcttgcccccaccctctcctctcctccgatggcgacgctgcagctcaaccacatcgcgcgggagacctccgacgtggtccgcctcgccgccttctacgaggccgtgctggggttcgagcgcatcccttcgcccacctactcgggcttccaggtcgcttggctccgcctcccgagctcccccgacgtcgcgctccacctcatcgagcgggaccccgccgcggcacccgccgccgtggggcctggcgccgagggcgcgccgccgtcgcagctgccccggcgccaccacctcgccttctccgtcgccgactacgacgggttcgtgaccgggctgaaagcgcggggcaccgaggtgttcgagaagacgcagccagacgggcgcacgcgccaggtcttcttcttcgaccccgacggcaatggcctagaggttactagcgctggtgcaggcagtgctaagtgaacagagaccatgttttgcagtacacttctgttttatcgtgtaatacctcggcaaacactgcctgcaaaatgcgatggaaactggatatgttcttgggtcaagcttcgttccgtaaaataaataaatccgaagctctgctcacactgttgtttggttgagacaagggcctgcgttcttgctgcatctcatccaaaatgattgtaatcctaacaatgtctagttaataaagttctcgtgttgcactcaaaatgttgtaagatgtaacatcgctccgtacgtgattggatttcctgcatgacaattggcaaatgaagtctgaatacttgtcattgtcgtctcaatgtttcagtttcagaactgaagcatcattagccactgaaagtggagataattcgcagtgtgctaccaaatgttgggaaatgctcgattctgacacaagaaatttggcaatgaggcatatcatcacaatatctattctcaagaaaaagctctgtcactattactactaataatcaacaagagtggtgaacgatgtctcgggggccattattacactgccggaggtcgatgcctggtcggtccgcttgtcaccggcggggcgtcagtcgtcggcggtggcgagctggaccttgagcagctcgtcctcggggatgacgcggatggtgcagtcggagcgcgggtacgctgcgcacagcagcgcgtacccctgcgcgacgacgtcgtcgctgagcatgccgtcgctctggtccaccaccccggagaccagccgcgccgggcacgtcatgcacacgccgagcttgcagtcgtgcggcacctccaggccctcgtccagcgcgcgggacaggatcgtctcgtcctcctccacctccaccacccgcgacgcgccgtcgtgctcgatcgtcaccttgtacgcccgcggcggctgcgcggtggcgatgcgtgcccccggcggccggcggcggggcagctgggaggcggggagccggactacgaggtgagtggagtttgtcggggtggcgaggtggagcagcgaagctgaagcagcggccatggtgtgc

SEQ ID NO: 943 - DNA, 939 bp, Saccharum officinarum
  misc_feature (263)..(263): n is a, c, g, or t
  misc_feature (273)..(273): n is a, c, g, or t
  misc_feature (287)..(287): n is a, c, g, or t
  misc_feature (298)..(298): n is a, c, g, or t
  misc_feature (392)..(392): n is a, c, g, or t
  misc_feature (402)..(402): n is a, c, g, or t
  misc_feature (594)..(594): n is a, c, g, or t
  misc_feature (803)..(803): n is a, c, g, or t
  misc_feature (808)..(808): n is a, c, g, or t
  misc_feature (817)..(817): n is a, c, g, or t
gtgcaacccgctgtctctggcctgtcctcaagcaagactgcaatagtcaaagacggcagcggcaccacactcccaagtctcgacactacgagacgcctcgccggccgcgccgtcccccaactcctctgtcctctgatcctcttcttgcccccaccctctcctctcctccgatggcgacgctgcagctcaaccacatcgcgcgggagacctccgacgtggtccgcctcgccgccttctacgaggccgtgctggggttcgagcgngtcccttcgnccacctactcgggnttccaggtcgnctggctccgcctcccgagctcccccgacgtcgcgctccacctcatcgagcgggaccccgccgcggcacccgtcacggtggggcctggcgccganggcgcgccgncgtcgcagctgccccgacgccaccacctcgccttctccgtcgccgaatacgacgggttcgtgaccgggctgaaggcgcgcggcaccgaggtgttcgagaagacgcagccagacgggcgcacgcgccaggtcttcttcttcgaccccgacggcaatggcctagaggttactagcgctggtgcaggcaatgatnagtgaacagagaccatgatttgcagtctacttctgttttatcgtgcaatacctcagcaaacactgcctacaaaatgcgatggaaacaggagatgctcctggatcaagcttcgttccgtaaaataaataaatcctaagctcatcaaagctctgctcacactgttgtttggttgagacaagggcctgcgttcttgctgcatctcatccaanatgantgtaatccnaacaatgtctagttaataaagatctcgcgttgccctcaaaatgttgtaagctgtaacatctctctgtacgtgatcggatttcctgcatgacaattggcaaatgaagtctgaatactttcgtt

SEQ ID NO: 944 - DNA, 733 bp, Panicum virgatum
cgctcccaagtcccaaccccgcacacgcttctcttctccctctcctccgatggcgacgctgcagctcaaccacatcgcgcgggagacctccgacgtggcccgcctcgcggccttctacgaggccgtgctggggttcgagcgcgtgccgtccccggcctactcgggcttccaggtcgcctggctccgcctcccgggctcccccgacgtcgcgctccacctcatcgagcgggacccgaccgcggcccccgtcgcggtggggcccggcgccgagggcgcgccgccgtcgcagctgccccggcgccaccacctcgccttctccgtcgccgactacgacgggttcgtgaccgggctcaaggcgcgcgggaccgagctgttcgagaagacgcagcccgacggccgcacgcgccaggtcttcttcttcgaccccgacggcaatggcctagaagttactagctcagctgcaggcagtgataagtaagcatgatgtgctagctacttctgctttagcctgcaatgtaaatcgaagatgttaccagaccaagcttcgttgcgataaataaacccaaagcttataaagcaatgtacatttgctttcctatgttgtaacacgactctgttcgcgactggactctactgtatgacaaatgaagtttgaatgctagcttcttgtcagtttcggatccatggttgtaattccagaaaaaataataaatggctaattctgtgtttcacc

SEQ ID NO: 945 - DNA, 822 bp, Panicum virgatum
caatcacagctccactagtccactactaccagacgcttcctcgccgggccgcgccgctcccaagcccgcacgcttctcttccccctctcctccgatggcgacgctgcagctcaaccacatcgcgcgggagacctccgacgtggcccgcctcgcggccttctacgaggccgtgctggggttcgagcgcgtgccgtccccgacctactcgggcttccaggtcgcctggctccgcctcccgggctcccccgacgtcgcgctccacctcatcgagcgggacccagccgcggcccccgtcgcggtggggcccggcgccgagggcgcgccgccggcgcagctgccccggcgccaccacctggccttctccgtcgccgactacgacgggttcgtgaccgggctcaaggcgcgcgggaccgagctgttcgagaagacgcagcccgacggccgcacgcgccaggtcttcttcttcgaccccgacggcaatggcctagaagttactagctcagctgcaggcagtgatgagtaattagagagcatgatgtgctagctatttctgctttagcctgcaatgtaaactgaagatgttaccagaccaagctttgttgcgataaataaatccgaagcttacaaagcaatgtatatttgctttagtccgaagcttatgaagcaatgtatttttcctatgttgtaagttgtaacatgactctgttcccaactggactctactgtatgaaaaatgaagtttcaatgctagcttcttgtcagtttcggatcaatggttgtaattccagaaaaaataataaatggttgattctgtgtttcacc

SEQ ID NO: 946 - DNA, 740 bp, Triticum aestivum
gcccactcccactccccctccccggacggagccgatggcgacgctgcagctgaaccacatcgcgcgggagaccggcgacgtgcggggcctggccgccttctacgaggaggtgctgggcttcgagcgcgtcccggccccggcctactccggcttccaggtcgcctggctccgcctcccgggctcccccgacgtcgcgctccacatcatcgagcgcgacccggccgtcgccgtcgccgttgccccgggggccgcgcagggggtcggcacgcccgcgcagctgcccaggcggcaccacctcgccttctccgtggccgacttcgacgggttcctcaccgggctcaggacccgcggcacccagctgttcgagaagtcccagcccgacggccgcacgcgccaggtcttcttcttcgaccccgacggcaatggtctagaagttacaagctcgagcccaggcgataagtaacctgctgggagcaggaaacaccttctacttctgcgacacccatgcagtgatgcccacctcgaggctgaagatgatggaagctgcagaatctgagagaaaacatccggtgccatgcgttactcccaaataaataatgaccttggtacctatatctatctgctccccatgcctgtaatatggatatgcatgtctgagactcaagtactgaacctgtgctgtgtgttagaacatcaagttaaattagtactaccacaaatgatgtgcccttgctcatcaa

SEQ ID NO: 947 - DNA, 1078 bp, Triticum aestivum
acgggcttgtaccctaagccccaggttcgagataaccattttacccccgggagaccggttttggcccttaggcccttgttagggagccctattggaccagctttgacccacaaaggcaggttgggaaccggtcggggattccccgggaatttttgagcccacggcttcggagatgggggcccgaggacccttgaccttgggctgaaggggttaggaaaaacccactcgaagcacacgttgcccccgcacggcactttttttccccgcctttcccgggccgcgccgcccacttcccgactcccacttcccgacggagccgatggcgacgctgcagctgaaccacatcgcgcgggagaccggcgacgtgcggggcctggccgccttctacgaggaggtgctgggcttcgagcgcgtcccggcgcccgcctactccggcttccaggtcgcctggctccgcctcccgggctcccccgacgtcgcgctccacatcatcgagcgcgacccggccgccgccgccgccgctgccgccccgggggacgccacgcccgcgcagctgcccaggcggcaccacctcgccttctccgtggccgacttcgacgggttcctcaccgggctcaggacccgcggcacccagctgttcgagaagtcccagcccgacggccgcacgcgccaggtcttcttcttcgaccccgacggcaatggtctagaagtcacaagctcgagcccaggcgacaagtaacgtgccgcgagcacgaaacaccttctacttctgcgacacccatgtagtgattacccacctcgaggctgaagatgatggaagctgcatatctgagagaaaacatccagtgccatgctctactcccaaataaataatgaccttgctacctatatctatctatatgctccccatgcctgtaatctggatatgcatgtctgagactgaatctgaactcgtgctgtgtgttacaacatcaagttaaattagtacgtatcacaaatgatgtgctctcgcccatcaaatttttacgattcatctacaaaaaaaaaaacaaaaaaaaaaaacacaataactaaacag

SEQ ID NO: 948 - DNA, 1949 bp, Brachypodium distachyon
ggcctgccgatcccatggctcccgcggcggcgtcggcgcggctcctcgccctcggcgcagtcgccatcctcgccttcgccgcggggagcgcggacgccctccggtcgctcggcgtccgcgacggcgcgggggcggccgccgagggggacgcggccgtggacctcaacgccacaaacttcgacgccttcctcaaggcctcgcgggagtcgttcgcggtcgttgagttcttcgcccactggtgcccagcttgcagaaactacaagcctcattacgagaaggttgcgaaactttttaatggtccggatgctgcacaccctgggagaatactgatggccagggttgattgtgcatcaaaggtgaacgtggatctttgcagtagattttctgtcgaccattatcccttcctactttggggccccccagcaaaatttgcttctgctaagtgggaccggaagcaagagaaaagtgaaataaaattgattgatgatggaagaacagcagaacgtttacttaagtggataaataagcaactggaaagctcgttcactttggatgacaaaaagtatgagaatgaaagtacgcttccaaagaatgcttcagatcctgcacaggttgttcaagcaatttacgatgttgaggaagcaacagctcatgcattacagataatcctggagcacaagatgatcaaatcagagacccgtgattcacttgtaaggtttttacaaattttggttgctcatcatccatcgaagaggtgtagaagaggatctgctgagctacttattaactttgatgatcactggccttcaaacctctcactaagttcgccagagagttctaaattgttggaaaatgttgcagcagagaaccacaagatctgtggaaaggaagtgccacgtggttactggatgttctgccgtggaagtaaaagtgaaacaagaggatttagctgtggtctatgggttttgctgcattcactgactgtccgaatcggtgatggagaaagccaatcaacctttacatcaatatgtgatttcatacacaatttcttcatctgtgaggaatgcagtaggcacttctatgaaatgtgttcaagcgtatcagttcccttcaagtctgcccgtgatctcagtctctggctatggagtacacataacaaagttaatgcgaggttgatgaaagaagaacatgatttaggaactggcgatccatcatttcctaaggtcatctggcctccaaagccactctgcccgtcttgctatcgttcttctagcaagactggtgatggagctgtgcaggttgactggaacgaagatgaaatatttccgttcttggttaactactatgggaaaacactcgtgtcatcctacaaagagacctacatggagtctcttcaagagaagaagcaagtagggctagtttctgacgattccccctccttgagtgctgcaagggtcccaataggagctgccctgggcgttgccattgccagctgtacatttggggcgctggcttgcttctggagagctcagcagaagaacagaaagcaaagaaagaactggaactgaaaaatagccttccagttgcccaccctgcacttcaccagaggtggcatccatgaatgtatatttcctggactgcttaaaatcttgtgatgtgaatcttgttgcaccttgtcataggttcaaagtgtagctctgtttaccgtacagtaattgtgatctgattcgttgatatggatgagatgttacagcccatttgatcagtgaaattttgaattcagtgcataaccaaatgttctatatctatgtgtcccaaatacagtgagccaaaaggctaaatgtactttgcattcaggattttcgaattgctggtgatggatgcatttttctttgcatcaaatataaatttcacaaatattgatccgttatgtacaggatgctcactcc

SEQ ID NO: 949 - DNA, 1493 bp, Sorghum bicolor
cgtatcagtaaaccatctgctttgtcaagcttaatagtggccagaggttgcaaaaagagcgatcagtcacgagttactagtaagcagaggctgcaggctgtactgcgtgatccattgcattgcgagttggagaagcggcgatggcggagcggcggagcaatggcggcttcgcgtcccaaagcagccatttggcggcgatgatgagaggaagctacgcgccccagagcctctggcgcccgtcgtcgacgtcgatgccgatgccggtcggtggtgcagcggttgtggcctcggcgcccgccgagaagaacaagaagagcttcgccgccgacttcctgctgggcggggtgtcgtcgtcggtgtccaagacggtggcggcgccgatcgagcgcgtgaagatgctgctgcagaaccaggacgagctgatccgcaccggcaggctgtcggagccgtacaggggcatcggcgactgcttcggccgcaccgtccgggacgagggcgtcctgtcgctgtggcgcggcaacaccaccaacgtcatccgctacttccccacgcaggcgctcaacttcgcgttcaaggactacttcaagtccctcttcaacttcaaccgggacagggacgggtactggcggtggttcgccgggaacatcgtctcggggagcgccgccggggccacgtcgctgctcttcgtctactccctcgactacgccaggacgcgtctcaccaacgactacaaggcggcggcggccatgggcaagggcggcgagaggcagttcacggggctcgtcgacgtctaccggaagacgctccggtccgatggcgtcgccgggctgtaccgagggttcaacgtctcggtggtcgggatcgtcgtctaccggggcctctacttcggcatgtacgactccttcaagccggtgctgctcacggggaagctgcaggacaacttcttcgcgagcttggcgctcggctggatgatcaccaatggcgccaacctcgcctcgtacccgctcgacactgtccggagaaggatgatgatgacctcgggggaggccgtcaagtacaagagctccatggacgccttcgcccagatcgtcaggaacgagggacccaggtcgctcttcaaaggcgccggcgccaacgtcctacgcgccatcgccggcgctggcgcgcttgccggctacgaccagctgcagctcatcttcttcggcaagaagtacggctcaggtggcgcctaaacgctaaacagggagggatttcagtaaaactctattattagatggatgatgacgaaaagggcatttgattcctaaaatgtcgttctttttacagattcagatatttgtacagctctaaattcacaataagcatcattcagaatgcttccatttgttctttctgattgatttcttaaaatctgtttgtaagcttgcagtgatgtaataagtactgtcagaaaataaataaagagggaactcaagttgcctgcaagtgttcac

SEQ ID NO: 950 - DNA, 1205 bp, Triticum aestivum
ctgccgtctcccctcctctctccttcttcctctccaagtttagctcctcttacatatagacctccgtccgtcggcgataccacggcaaggttgttacagtgaccaagaacagaggctacagagctccctcgatggtgcggacgacggtgcaggatctggcggcggccgtcgaggagccgccacggcagtacgtggtgcgcacgagcgagaccgaaaaccacctgctggccgctgacgagatgccggatcccatccctctcatcgaccttggccggctcactaggccggccgccgacgaggcccacaagctccgggaggccctacagacctggggcctcttcctggtcaccaaccatggaattgaggagtctcttatggatgccatgatgagcgcgtcgagggacttcttccggcagccgcctgaagaaaagaacaaatgtagcaacttgatagatgatggcggcaggcacttggaggtggaaggctatggaaatgacaaagtggtaaccccccaggatcagggcctcagctggaacgaccggttgcatttgagagtggagccggaagatgagaggaattttgccaagtggcccacccacccggaatctttcagggatgtgctacttgagtacgcaacaagaaccaagagaataagagatcttatcttgcgatcaatagccaagatcctggaccttgatgaggattacttcgtcaaccaaatatcaaacaaggctcgtgggtttgctaggttcaactactaccccccatgtccgagacctgacctagttttgggcatgaggcctcactctgatgttggtctccttaccatcctttctgtcgaccacgacgtcggtggcttgcaagttcagagagatgggaaatggtataatgttccagccaagccttatactttggtgattaacttagctgactgcatggagataatgtgcaacggaatcttcatgagcccagttcatagggtggtgacgaatgccaagaaggagagactttcactgggtgtgttttatgttgtggatggcgagatggtgctggagcctgcgcctggtttgctggatgacgagcgaccaccaagatatgggaaattcaaggccaatgatttcggtttttctttcgactgaatgttttcgtcaagggaagagattcatcgagaccctgaaaatacaagttcaacatattaactagtt

SEQ ID NO: 951 - DNA, 1273 bp, Triticum aestivum
gtacgcaagaagcagagctccctcggccaccgtcgatggtgcggacgacggtgcaagagctggcggcggccgtcgaggagccgccgcgacagtacgtggtggcgcacgagcaagaccaggacctgctggccgctgatgagatgccggagcccatccttctcatcgatcttagccggctgactacggccgacgccgccgacgaggccgacaagctccgggcggctctccagacctggggcctcttcctggtgaccaaccatggaatcgaggagtctctcatggatgccatgatgagtgcgtcgagggaattcttccggcaaccgtccggagagaagcagaaatgcagcaacctgatagacgacggcggcaagcactctgaggtggaagggtatggaaatgacaaggtggtaaaccaggatgagagcctcagctggaacgaccggctgcatttgagagtggagccagaagatgagaggaatttcaccaagtggcccactcacccggaatctttcagggatgtgctacttgagtacgcatcaagaaccaagaggataagagacgtggtctttcgaacaatagccaagctcctggaccttgatgaggattacttcctcaaccaaatgtcaaacaaggatcccgggtttgctaggttcaactactaccctccgtgtccgcgacctgacctggtattaggcatgaggcctcactctgatgctggtctccttaccatcctttttgtcgaccgcgacgtcggtggcttgcaagttgagagagatgggaaatggtacaatgttccggccaagccttattcgttggtgatcaacttggctgactgcatggagataatgtgcaacggaatctttaggagcccggttcacagggtggtgacgaatgccgagaaagagaggctttcactggccgtgttttatgctgtggatggagaaacggtgctggagccagcgcctggtttgctggatgacgagcgaccgccaagatatgggaaattcaaggccaaggatttcggtctttctttcgactgaacataacatttcagccaagggaagagattcatcgagaccctgaaaatacaagctcggcggtcttaattagtttatttacggatttgtagcggtgatttaatacctatggagtataaataaagagatggtctctcttctgtgagtggggattttatgtacgtataatataatcgcctttctttcttataagcaactcgcgtattcaacacttaactaatagccagttcggtgca

SEQ ID NO: 952 - DNA, 1186 bp, Triticum aestivum
tacgcaagaaacagagctccctccaccaccgtcgatggtgcggacgacggtgcaggagctggcggcggccgtggaggagccgccgcgacagtacgtggtggcgcacgagcaagatcaaggcctgctggccgctgatgagatgccggagcccatccctctcatcgatcttagccggctgactacggccgccgccgccgacgaggccgacaagctccgggcggctctacagacctggggcctcttcatggtgaccaaccatggaatcgaggagtctctcatggatgccatgatgagcgcgtcgagggaattcttccggcaaccgtccgaagagaagcagaaatgcagcaacttgatagacggcggcggcaagcactctgaggtggaaggctatggaaatgacgaggtggtaaaccaggccgagggcctcagctggaacgaccggctgcatctgagggtggagccagaagatgagaggaatttcaccaagtggcccgctcacccgaaatctttcagggatgtgcttcttgagtacgcatcaagaaccaagagaataagagacctcgtctttcgatcgatcgccaagctcctggaccttgatgaggattacttcctcaaccaaatatcaagcaaggatcccgggtttgctaggttcaactactaccctccgtgtccgagacctgacctagtactgggcatgaggcctcactctgatgctggtctccttaccatcctttttgtcgaccacgacgtcggtggcttgcaagttgagagagatgggagatggtacaatgttccggccaagccttactcgttggtgatcaacttggctgactgcatggagataatgtgcaacgggatcttcaggagcccggtccacagggtggtgacgaacgccgagagagagaggctttcactggccgtgttttatgctgtggatggagagacggtgctggagccagcgcctggtttgctggatgacgagcgaccggcaagatatgggaaattcaaggccaaggatttcggtctttctttcgactgaacataacatttcagccaagggaagagattcatggagaccctgaaaatacaagctcggcggtctcaattagtttatctacggatttgtagcagtgatttattacctgtggagaataaataaagagatggtttctcttgtgtgagtggg

SEQ ID NO: 953 - DNA, 845 bp, Oryza sativa
tgagctcattgtgacacccaggaacacatcatcatcatcatcatgtctccgatgccgtcgctgctactcgtgttcctggtcgcctcgtcggcggctggtgttgcggccggcggcggcggcggggagctgaagcacatccacctgtacatgcacgagacgttctcggggccgaacgccaccgagggcggcgtcgtggcgtcgccgttcaacacgacgttcgggcaggtggccgtgttcgacaacgagctccgcaccggcgaggacagggcagcgtcgccgctggtggggaggtaccagggattcatcgtcggcacggggcggagctcgccggggtacctgacgtcggccaccgtcgcgttcaccgccggcgagctcaacgggagcacgctgtcgctggagggccccttcttcggcttcgccggcacggcggagcgcagcatcgtgggcggcaccggcaagctgaggctggcgcgagggtactacctcctcaagctcatcggcaagacctcgccggagacggccgtctccgagatcgacttcttcgtcctcatgtacagctccacccactagctatgtataagcaagaagcgtgtaaacactagtgtaacactgtaccagcgaggcaccgttcttttctgatacagattctatcctgatttatgttagcacgttttttaaatagttaaatagtgtatagagaagttgctctaaaatatcaatcatttttttaagtttatagtaattactaaaatcagttattcaagttctaatgtgttttctcatttgacgtgtccttgcttagtctttacggaattactaaatagctgtcgaatcattactactca

SEQ ID NO: 954 - DNA, 1395 bp, Brachypodium distachyon
agtcccccatcggctcgattcccccaacccaacaaccaccatcctcaagccggccggccggccggcgccgcgagcagtacgaaatagcgggggattcccatggcgtcgaagcagatggaggagatccagcggaagctggccctgctcgcctacccgcgcgccaaagcccccgcgcagtccctcctcttcgccggcgtcgagcgctaccgcctcctcgaatggctcttcttccggctcctgggcgacagatcgccattcacgcagcagaactggcagggggatagcctcgaccgcgacgaggagaacagtaggatccaacacctggccgagattgcgaatttcctgggtatcacgccttcagtggacactgaggcgattcagggtagaggcagctatgatgagcgggtggaactcctccgtctaattgttgacttggtggaagctagctgctatgccgataatccagaatggagtgttgatgagcagttggcaaaggacgtacagcttgtagattcaattgcagagaaacaggcccaaattttttcagaggagtgcaagctttttcctgcagatgtccaaatacaatcgatttaccccctgcctgatatagcagaactggagttgaagctctctgagtataccaaaaagatgtcaaatttgcagcaaatggttcaggagctggcatctaagtatgactacaatccgaatgaagactatgctgaaacagagctgaagttgcgggaatatttgcaatcatttcttgaaacagttaaatcattcaatatgatatatactaaggaaattcatccctggacccacatgatggaggtgccacagttgcatgggtttggtccagctgctaatcgcttgctagaggcatacaacacactgttaaagttcctcggaaatttgaggagcctgcgagattcatattctgcgatggctgcggggtcactttcaaactcaaatgagccttcgtctgtcacaaaaattatttcagactgtgaatctgcgctgacattcttaaataacagcctcgccatcctttcaacttctgtggcacgagagcagggtgaaacactgtgattttacggtcctctctgataccaagactggacaccgtggcacgtgtgtatgcttgtagttgttcggctgtttgcctttcggttttggttgactcgcctttgttccaattgtcggaatgttattgtatttgtgtgtgctggttgatgtgtgggcacttgtaagcttttgctgatcatatatcttctaattctgaaactatagatccttctttagacacactgattaattgcattgctgcattcctgctaaaattgcatgtaacagtttgtgggttgtgtgtctttgcacctaacttatgcgttccgtcac

SEQ ID NO: 955 - DNA, 1338 bp, Zea mays
aaacgcatgcgagtatgcgacgaccctttcgtcgaattttgaaagggatcggtaggaaaattaaaatttggggaactatcaaacacatctcgttaccatctagctcgttggtcagtcgccgtcagcccaatacccaccatccccaccaacggccggccgccgcggcggagcggagcagagagcaaccatggcgtcgaagcagatggaggagatccagcggaagctatccctgctggagtacccgcgggcgaacgcccccgcgcaatccctcctcttcgccggcgtcgagcgctaccgcctcctcgagtggctcttcttccggctcctaggcgacagatcgcccttcacgcagcagaactggcaaggggatagcctggaccgcgacgaggagaacaacaggatccaacacctggcggagatagccaacttcttgggcatcacaccttcggcggacaccgaggcgattcagggtcgaggtagctatgaggagcgggtggaactgctccatcttattgttgacctagtggaagctagttgctacgctgacaatccagaatggagtgttgataagcaattggagaaggatgtgcaactagtagattcaattgctgagaaacaagcccaaattttttcagaggagtgcaagcttttccctgcggatgttcaaatacaatcaatttaccccttgcctgatattgctgaactagagttaaagctctcggagtataccaaaaagatgtctaatctgcagcaaatggttcaggagttagcatcgaagtatgattataatccaaatgaagactatgcggagacagagttgaagttgagggaatacttgcaatcatttttggaaacggttaaatccttcaacacaatatatactaaggaaatccatccttggacccacatgatggaagtgccacaattgcatggcttcggtccagctgctaatcgcctcttggaggcatataatacccttttaaagttcttgggaaatctgaggagcctccgagattcatacactgcaatggctgctggttcactgtcggcttctaatgagccttcatctgtgaccaagattatttcagactgcgaatctgcactcaccttcttgaatcacagcctttccatcctttcaacttccgtggcacgtgagcaggggggaacgctatgattttacagtatttggatagtaagatatagtcagtgaacttatgtatgtaagcttctattaattcaattgtttgcttcctataaaaaatcagttgtttgcattttaatttcagctagtgcatgtactccctttgatccaaattataaattgttttgatattttcc

SEQ ID NO: 956 - DNA, 1358 bp, Sorghum bicolor
cgacaaccctttcgtcgaattttgaaagggatcgggaggaaaattaaaattcgggggaattatcgaacatctcgctcgttggtgagtcgccgtctgcccacatacccaccatccccaccaacggccggccgcggcggcggagcggagcggagcgagcagccatggcgtcgaagcagatggaggagatccagcggaagctgtccctgctggagtacccgcgggcgaacgcccccgcgcaatccctcctcttcgccggcgtcgagcgctaccggctcctcgagtggctcttcttccggctcctaggcgacagatcgcccttcacgcagcagaactggcagggggatagcctggaccgcgacgaggagaacaacaggatccaacacctggcggagatagctaacttcctgggcatcacaccttcggtggacaccgaggcgattcagggtcgaggtagctatgaggagcgggtggaacttctccatcttattgtcgacctagtggaagctagttgctacgctgacaatccagagtggagtgttgataagcaattggagaaggatgtgcaactcgtagattcaattgctgagaaacaagcccaaattttttcggaggagtgcaaacttttccctgcagatgttcaaatacaatcaatttaccccttgcctgatattgctgaattagagttaaagctctcggagtataccaaaaagatgtccaatctgcagcaaatggttcaggaattagcatcgaagtatgattataatccaaatgaagactatgctgagacagaattgaagttgagggaacacttgaaatcatttttggaaacggttaaatccttcaacacaatatatactaaggaaatccatccatggacccacatgatggaagtgccacaattgcatggcttcggtccagctgctaaccgcctcctggaggcatacaatacccttttaaagttcctgggaaacctgaggagcctccgagattcatacactgcaatggctgctggttcactgtcggcttctaatgagccttcatctgtgaccaagattatttcagactgtgaatctgcgttaaccttcttgaatcacagtctttccatcctttcaacttccgtggcacgtgagcagggggaaacactatgattttacggtatttgcataccaagatatagtctcggggaacttatgtatgtaagcttgtagtgattcagttgtttgctttctttttaaaaaaatcagttgtttgcattttagtttcagctgatgcatgtactctcttcattccaaattataaatcgttttaccttttctagatatatttgtttaactatacatctataggctatgtctaga

SEQ ID NO: 957 - DNA, 1453 bp, Saccharum officinarum
  misc_feature (997)..(997): n is a, c, g, or t
  misc_feature (1098)..(1098): n is a, c, g, or t
aaacaatctcgctcgttggtgagtcgccgtctgcccaataccccaccatccccaccaacggccggccgccgcggcggagcggagcagagcagagcgagcagccatggcgtcgaagcagatggaggagatccagcggaagctgtccctgctggagtacccgcgggcgaacgcccccgcgcaatccctcctcttcgccggcgtcgagcgctaccgcctcctagagtggctcttcttccggctcctaggcgacagatcgcccttcacgcagcagaactggcagggggatagcctggaccgcgacgaggagaacaacaggatccaacacctggcggagatagctaacttcctgggcatcacaccttcggtggacaccgaggcgattcaaggtcgaggtagctatgaggagcgtgtggaactgctccatcttattgtcgacctagtggaagctagttgctacgctgacaatccagagtggagtgttgataagcaattggagaaggatgtgcaactcgtagattcgattgctgagaaacaagcccaaattttttcggaggagtgcaaacttttccctgcagatgtccaaatacaatcaatttaccccttgcctgatatcgctgaattagagttaaagctctcggagtataccaaaaagatgtccaatctgcagcaaatggttcaggaattagcatcgaagtatgattataatccaaatgaagactatgccgagacagagttgaagttgagggaacacttgaaatcatttttggaaacggttaaatccttcaacacaatatatactaaggaaatccatccttggacccacatgatggaagtgccacaattgcatggcttcggtccagctgctaaccgcctcttggaagcatacaatacccttttaaagttcctgggaaatctgaggagtctccgagattcatacactgcaatggctgctggttcactgtcggcttctaatgagccttcatctgtgaccaagatnatttcagactgcgaatctgcactgaccttcttgaatcacagcctttccatcctttccacttctgtggcacgtgagcagggggaaacactatgagttagtanttggataccaagatatagtttcgactttcgaggaatttatgtatgtaaccttgcagtgattcagttgtttgcttcctattaaaaaaattgtcatttgcattttagtttcagctgatgcatacaccctccattccaaattataaagagttctgccttttctagatacattgtttttactatgcatctataggctatgtctagatacataataaaagttatttatctagaaaaaacaaaactgacttatagtttgaaatggagggagtagtaaagcttttgacctcttgcgagtctagtttgtaacacttactaaacatcatccttgataagttgtatgtagagttcttttcgagtt

SEQ ID NO: 958 - DNA, 1479 bp, Panicum virgatum
aaaaaaattggggaattaaaatctcggtaccatctcgctcgttggtcagtcgccgtctgctcgatccctaccatccccaccagcagcaccggccggccgccgcggtgagcggagagaagcagccatggcctccaagcagatggaggagatccagcggaagctgtccctgctcgccaacccgcgggccaatgcccccgcgcagtccctcctcttcgccggcgtcgagcgctaccgcctcctcgagtggttgttcttccggctcctaggcgacagatcgccgttcacgcagcagaactggcagggggatagcttggaccgcgatgaggagaacaacagaatccaacacctggcggagatagctaacttcctgggcatcacaccttcagtggacaccgaagcgattcagggtagaggcagctatgaggagcgggtggaactgctccgtctcattgtcgatctagtggaagctagttgctatgccgacaatccagaatggagtgttgatgagcaattggcgaaggatgtgcaactcgtagactcaattgctgagaaacaagcccaaattttttcagaggagtgcaagctttttcctgcagatgttcaaatacaatcaatataccctttacccgatattgcagaactagagttgaagctctctgagtatacaaaaaagatgtccaatttgcagcagatggttcaggaattggcatcaaagtatgattacaacccaaatgaagactatgccgagacagagttgaagttgagggaacatttgcaatcatttttggaaacggttaaatccttcaatacgatatatactaaggaaattcatccttggacccacatgatggaggtgccacaactgcatggctttggtccagccgctaatcgcctgttagaggcatataacacccttttaaagttcttaggaaatctgaggagtctgcgagattcatatactgcaatggctgctgggtcactgtcggcgtcaaatgagccttcatcagtcgccaaaattatttcagactgtgaatctgcactaacattcttgaatcacagcctttccatcctttcaacttccctggcacgggagcaaggggaaacactatgattctacagcaccggtggtatatcaggatgcagttccagggaacctatcgaagcctgtagtgattcatttgcttttagttttaggtgaggcatgtagtaaaggttttgtgccatttgttggtgtgctcctgtagtttctgccattttaggtgaggctgtagtttgtaactcaagagattgaaatcacttacttaaaattatatctagagttcttttggaagtttaactgaacttgtatatgtatgcccttttatccttgagaagttctctcttattgatcagatcttctgtattttaaaacgattattccttcggacactatatttcttgtgaaattgactttgttgaggacttgaggtacattcaaaa

SEQ ID NO: 959 - DNA, 1339 bp, Triticum aestivum
ctgcaggagccggccggccgccgcgagcgggggactgattcccctcccccatggcgtcgaagcagatggaggagatccagcggaagctggcgctgctggcctacccgcgcgccagcgcgcccgcgcagtccctccttcttcgccggcgtcgagcgctaccgcctcctcgagtggctcttcttccggctgctgggcgacagatcgccgttcacccagcagaactggcaggtggacagcctcgaccgcgacgaggagaacagcaggatccagcacttggcggagatcgcgaatttcctcggtatcacgccttcggtcgacactgaggcgattcagggcagaggcagctacgacgagcgggtggagttcctccgtctaattgttgacttggtggaagctagctgctatgccgacaatccagagtggagtgttgatgagcagttggcaaaggatgtacaacttgtagattccattgctgagaaacaggcgcaaattttttcggaggagtgcaagctttttcctgcagatgttcaaatacaatcgatttatcccctgcctgatatagcagaactagagttgaagctctctgagtataccaaaaagatgtcaaatctgcaacagatggtgcaggagctagcctcaaagtatgactataatccgaatgaagactatgccgagacagagttgaagttgagggaacatttgcaatcttttctcgaaacagtaaaatccttcaatatgatatacactaaggaaattcatccttggacccacatgatggaggtgccacagttgcatgggtttggtccagctgctaaccgcttgttagaggcttataacacacttctaaagttccttggaaatctgaggagcctgtgagattcatatacagcaatggcagctgggtcactttcaaattcaagcgagccctcatccgtcacaaaaatcatttcagactgtgaatccgcgctcacgttcttaaacaacagccttgccatcctttcaacttccgtggcacgggagcagggtgaaacactctgattgtatggccatcttataccaagattcaactctgctacacgtgtgtaagcttgtagtgtttcagttgtttgccttttggtttcagttgaggcgcggagtaaagcttgtgttcccattgggtcgtgtatttgtgtgtggttgtttgattcttttgcagttgtaacttgtgacgttcaatgaacagttcttataaatttgatagcatagcactagtgaaatgtgtttctacattcatagcgaaactgattgtgatggcttatggattatgtctctgcgcctcattggtgcattcatcgactgc

SEQ ID NO: 960 - DNA, 1596 bp, Brachypodium distachyon
caatggcggcgtggtgggaggagatcgtggcggcggtatcgacgtccgggccgggagggagcagcggcaccgtggtgtccatctgcgtcttcacggcggtgctgtgcctctgcctcgtcgccggccacctcctcgaggagaacaaatgggtcaacgagtccatcaccgcgctaatcatcggttgcattgttggggctttcatatttctgctgagcaaaggcaggaactcgcacatcctgcggtttgacgagcagctcttcttcatctacgttcttccgcctataatcttcaacgctgggttccaggtgaagaagaagcagttcttccataatttcctcaccattatgtcatttggggtagtcggggttttcatctcggttgcaattgtttccgcaggttgccattggctctttccaaaagttggttttgggaaacttgacgcagtggattatctagcactgggaaccatattttcttcaacagacactgtgtgcactctgcaggtcataagtcaagatgagacacccaggttgtacagcttggtatttggtgaaggagtcgtcaatgatgctacatcagtggtcctattcaatgctataaagaacctggatatcaataggctcaaacgcggggtggttttaaaagttatcgcagatttcctatatctgtttgcaactagtaccatcctcggagctacaattgggctagccactgcttatgttctcaaagcgctgtattttggtaggcactcaactgatcgggaagtagccctaatggctctcatggcttatttatcatacatgcttgcagagttgctaagtctgagtgggattttgactgtgttcttttgcggcatcgtcatgtcccattacgcatggcacaacgtaacggaaagctcccgaatcacgacaaggcacatttttgcaacattatcattcatcgctgagacatttatcttcctttatgttggaatggatgcccttgatattgataagtggaagacatcacaggcaagcttcaagacatcaattggcatctttggtatcatcatttcacttgttttgctgggacgggccgcatttgtttttcctctatcaattctgtcaaatttcatgagtgggaattcggaaaaggcaccgatcacattcaagcatcaggttgtgatttggtgggctgggctcatgaggggcgccgtttcaattgcgctggcgtacaatcagttcaccttttcaggtgtaacactcgacccagttcatgcagccgtcatcaccactacaattgttgtagtatttttcaccactctggtgtttggtttcttgacgaggcctctgataagcgcaatgctcccacaacagcgacaccgggaggggacaggaggccacatcacgagcagcaactccccaaaggatgagtttattctgccgtttctttcagatgaaaacgctccagggagtgaaagtggcatcaaccaagccaagagaagcatatcgatgttgctagagagacccgtccacatggtacatatccactggaggaagttcgatgacaagttcatgagaccaatattcggtggaccgctgtcgtactgacagctct

SEQ ID NO: 961 - DNA, 591 bp, Pennisetum glaucum
acattcatcttcttatgttggtatggatgcccttgacattgataaatggaagacatcgaaggcaagcttcaagacatccatcagtctcttggtatcatcatcctgctcgtgttactgggacgagccgcatttgttttccctatatccatttgtcaaataacatgagtggaagttctgagagaacaccaatcacattcaagcatcaggttgtcatttggtgggctgggctcatgagaggcgctgtttcaattgcactagcatataatcagttcacgttttcgggagtaacatcagatccagttcatgcaaccatcatcaccagcacaatcattgtagtatttttcaccaccctggtgtttggcttcctgactaggcctctcataagtaccatgctgccgcaccactcaaggacgctgtcaagaggccatagcacaggcagtaactccccgaaggatgacttcaccctgccattcttctcaactgatgaagacgcgtctggcacgcggtatcgtcttggagcaagccaagagaagcatatctatactgctggagagacctgtccacacggttcacatctactggaggaagttc

SEQ ID NO: 962 - DNA, 1745 bp, Sorghum bicolor
atggcggcggcgttgtgggagacgctgctggcggcatcggcggcggatgggaccggtgggagcagcaccacggtggtgtccatctgcgtgttcacggcggtgctgtgcctgtgcctcgtcgccggccacctcctcgaggagaacaagtgggtcaacgagtccatcaccgccctcatcatcgggtgcatcgtaggagccatcatatttctgctcaccgaagggaagcactcgcacatcctgaggttcgacgagcagctcttctttatctacgtgcttccaccgataatcttcaatgccgggtttcaggtcaagaagaagcagttcttccacaacttcatgaccatcatgtccttcggcgtgttcggcgttttcatttcaggtgcaatagtttcggcaggctgctattggctcttcccgaaagtcggatttggaaaacttgatgcggtagattatttagcactgggagcaatattttcttcgacagataccgtgtgcacattgcaggtcataaaccaagacgagacaccaaggctgtacagcttggtgtttggagaaggagttgtcaacgatgcaacagcagttgttcttttcaatgctatcaagaatctcgatatcagtcagctcaaaggtggggttgtgctaaaactgatagctgacttcctctatctcttcgcaaccagcacgatcatcggaatctcaatcggtctagcgactgcatatgttctcaaagctctgtattttggtaggcattcgactgatcgagaggttgccttgatggctctcatggcttatttatcatatatgctggcagagttgctagagctgagtggaattttgaccgtgttcttttgcgggattgtcatgtcccactatgcatggcacaacgtgacagagagctcaagaatcacaacaaagcatatatttgcaacattgtctttcattgctgagacgttcatctttctttatgttggtatggatgctcttgacgttgataagtggaagacatcaaaggaaagctttaagacatccatcggcatctttggcatcgtcgtattactcatattactgggacgagtggcatttgtttttcctgtgtccattttgtcaaatatcctgagtggaagttctgagaggaccccaatcacattcaagcaccaggtggttatttggtgggctgggctcatgagaggcgccgtttcgattgcactagcatacaatcagttcacattttcaggtgtaacatcggatccagttcatgccaccatcatcaccagcacaatcattgttgtatttttcaccactctggtgtttggcttcctgaccaggcctctcattagtgccatgctcccgcatcagtcgagggcgctgtccagaggccatagcaccggcagcaactccccaaaggatgacgacttggccctgccgtttctctcgtctgacgaaggcgcgtctggcagcggtattgtcttggagcaggccaaaaggagcttatctatgatgctggagaggcctgtccacacggttcacgtctactggaggaagttcgatgataggttcatgaggccaatctttggtggaccgcagtcatactgactgcatttgcagatttcagaagccaggtgccctgtagcatagaacagccactctgtttggcaggttggctttgtggtgataagagttagttcctctgaattctgttcgcatatagttctctgaggccactgtaaagttgataacggtgaaca

SEQ ID NO: 963 - DNA, 2028 bp, Panicum virgatum
gcgcagagggcatggccgagacgcagggagatagaatcgatgtcggcggcggcgtggtgggaggcgctggcggcggtgggcgggacggcggggagcagcaccacggtggtgtccatctgcgtgttcacggcggtgctgtgcctgtgcctcgtcgccggccacctcctcgaggagaacaagtgggtcaacgagtccatcaccgcgctcatcatcgggtgcctcattggagcgatcatatttctgctcaccaaagggaagcaatcgcacatcctgaggttcgatgagcagctcttcttcatctacgtgcttccacccataatcttcaatgccgggtttcaggtcaagaagaagcagttcttccacaacttcatgaccatcatgtctttcggggtattcggtgttttcatttcggttgcaatagtttccgcaggctgctactggctcttcccgaaagttggatttggagaacttgacgcatcagattatctagctttgggagccatattctcttcaacagataccgtgtgcacattgcaggtcataaaccaagatgagacaccaaggttgtacagcctggtgtttggagaaggagtcgtcaatgatgcaacagcagttgttcttttcaatgctataaagaatctcaatatcagtcagctcaaaggcagggttgtgctaaaagtcatatctgattttctctatctgttcgcaaccagcactatccttggaatctcaatcggtctatcgactgcttatattctcaaagctctgtatttgggtaggcattcaactgaccgagaggtagcactgatggctctcatggcttatttatcatatatgctggcagagttgctagacctgagtgggattttgactgtgttcttttgcggcattgtcatgtcccattatgcatggcacaatgtgacagagaactcaagaatcacaacaaagcatatatttgaaacattatcattcatcgctgagacattcatctttctttatgttggtatggatgcccttgacatagataagtggaagacatcaaaggcaagttttaagacatccatcagtatctttggtatcatcatcctgtttgtgttacttggacgggctgcatttgttttccctatatccattttgtcaaataacatgagtggaagttctgagagaacgccaatcacgttcaagcaccaggttgtcatttggtgggctgggctcatgagaggcgctgtttcgattgcactagcatataatcagttcacgttttcaggggtaacatcagatccagttcatgccaccatcatcaccagcacaatcattgtagtatttttcaccactctggtatttggcttcctgactaggcctctcataagtgccatgctcccgcgtcactcgagggcgctgcccagaggccatagcactggcagtaactccccaaaggatgacttcaccctgccatttttctcaactgatgaggacgcatctggcagtggtatcgtcttggagcaagccaagagaagcatatctatgctgctggagaggcctgtccacacggtccacatctactggaggaagttcgatgacaagttcatgaggccaatcttcggtggaccgcagtcacactgactgcgcatgaagcagagccagatgctgccatatacatctggggttctgaaatcaagcgcagataaagaaggtgcgtctatggtggcgattccctgtttagtttcacaatgccaaatgcagaaggcaaagcttttggctcgcagccctgagactgaacctgaaatagaaatgtctggcattaggaagctgtcatataaaacagctactgtgtttggcaggctgactctgctgaaaatagtttctctgaattttgcctgcctagtttgctcatggcactgtaaagttttatgacagaatggttccgagcaacttaagtgccctctttattcggaatcaacaaaccgtcttgttttcagattagagctataaacatctatcagaacctgtaaaaacaaataaaacagc

SEQ ID NO: 964 - DNA, 825 bp, Panicum virgatum
tcctcatattacttatattactgggacgagtggcatttgttttccctatttccattttgtcaaataccatgagtggaagttctgagaggaccccaatcacattcaagcaccaggtcgttatttggtgggctggggcgctgggctcatgagaggcgctgtttcgattgcactagcatacaatcagttcacattttcaggtgtaacatcagatccagttcatgccaccatcatcactagcacaatcatcgttgtgtttttcaccactctggtgttcggcttcctaaccaggcctctcattagtgctattctcccgagtccgtcgagtgcgctgtccagaggccatagcacaggcagcaactccccaaaggatgacttcgtcctgccctttctctcgtctgatgaaggcgcgtcaggcagcagcattgtcttggagcaggccaagaggagcttatctatgatgctggagaggcctgtccacacggttcacatctactggaggaagttcgatgacaggttcatgaggccaatctttggtggaccgcagtcatactaactacatatgcacaacggagccggcatggcacgccatgccactggcatatgcagacttcagaagccaagcttatagttatagcttgctgactgagaggctttgagttttcaggaagctgtagcatagaacagccactctgtttggcaggctggctttgtcctgataagagttagtagttcctctgaattctgtccgcggagttcgctgatgcctctgtaaagttgataacagtgaacactttgcagacaacttgagttccctctttatttatt

SEQ ID NO: 965 - DNA, 1983 bp, Triticum aestivum
cagactacagaggcagcgaagaagagggcggacaaggcggcggcggtgatctgaagccaaatcgaagcgagctctgcatatgcgcccggcacatggcggcttcctcgctgtgggacgagctggtggtggcggcgtcgacgggggggagcagcggcaccgtggtgtccatttgcgtgttcacggcggtgctctgcctctgcctcgtcgccggccacctcctcgaggagaacaaatgggtcaacgagtccatcaccgcgctcatcatcgggtgcattgttggggctctcatctttctgctgagcaagggcaggaactcgcacatcctgaggttcgatgagcagctcttcttcatctacgttcttccgccgataatcttcaacgctgggttccaggtcaagaagaagcagttcttccataatttcctcaccatcatgtcctttggggtattcggggttttcatctcggtcgcaatagtttccgcaggtttctactggctactcccaaaagttggttttggcaaacttgacgcggtggattatctagcactgggagtcatattttcttcgacagatactgtgtgcacgttgcaggtcataagccaagatgaaacaccgaggttgtacagcttggtcttcggagaaggagttgtcaatgatgcaacatctgtggtcctattcaatgctataaagaatatggatatcaccaagatcaaaagcagggcggtgctaaaagttatcggagatttcctctatctttttgcaactagtactatccttggcgccacaatcggactgttcactgcttatgttctcaaagcgctgtattttggcaggcactcgactgaccgggaggtcgctttaatggctctcatggcttatttatcgtatatgttagcagagttgttaagtctgagtgggattttgactgttttcttttgcggcatcgtcatgtcccactacgcatggcataatgtaacagagagctcccgaatcacgacaaggcacatatttgcgacgctatcattcatcgctgagacctttatctttctttatgttggaatggatgcccttgacatggataaatggaagacaacacaggcaagcttcaagacctcaattggtatttttggtgtcatcatttcactcattttgctgggacgggccgcgtttgttttccctctttcgatcctttcaaattttatgagtgggaattctgaaaaagcaccaatcacattcaagcaccaggtcgtgatttggtgggccgggctcatgagaggcgccgtttcaattgcgctagcatacaatcagttcacattttcaggtgtaacacaggatccagtccatgcaaccatcatcaccagtacaattgtcgtagtatttttcacaaccctggtgtttggcttcttgacaaggccaatgataagcgccatgctcccgcagcatcggcaccgggagccgacgggaggccgcagcacgggaagcaactcgccgaaggacgagttcatcctgccgtttctcggcgacgaagacgcgtcggggagtggaagcggcttcgtccaagccaagagaagcatatcaatgatgctggagagacccatccacacggtgcacatctactggaggaagttcgacgacaggttcatgagaccaatcttcggtggaccacgatcttactgactggaataattctgtgcaagagaagaggtggaataattggcgctcttacgactggaggagtataatcgagttcggcgacggtaattcagtgtaacaatatctctgaattttgtgtctttggtttgtaacatgaacagtgttactaccttactagcagtgtatagtttgtaacatgaacagtgtcgagcaaattcagtttgctctttatttagtgtatttgtagtattacaaattctggaagtataaacggaagcaaacacgctgaaactcaactggagtgcagtgctccaggagaccaaaaaaaaaa

SEQ ID NO: 966 - DNA, 1150 bp, Musa acuminata
  misc_feature (888)..(888): n is a, c, g, or t
  misc_feature (896)..(896): n is a, c, g, or t
  misc_feature (915)..(915): n is a, c, g, or t
  misc_feature (938)..(938): n is a, c, g, or t
  misc_feature (949)..(949): n is a, c, g, or t
  misc_feature (955)..(955): n is a, c, g, or t
  misc_feature (1015)..(1016): n is a, c, g, or t
gggggagaagggaggggaagggaagagcagaaatggtgaacaccttcttcgtgttctgcgcctgcatcgaccaggcgagcatcggcgtggtggagcagtgggggcgcttcctcagcctcgccggccctggccttcacttcttcaaccccttcgccggagagtgccttgccggcgttctctccacccgcgtctcctcgctcgacgtccgcgtggagaccaagaccaaggataatgtttttgtgcaactggtttgttcgattcagtatcgtgtcgttaaagaaaatgctgatgatgctttctatgagttgcaaaatccacaagagcagatccaagcttatgtttttgatgtggtccgagcccatgttccaagaatgactcttgatgagctctttgagcaaaaaggtgatgtggcaaaagcagtccttgaggagctagaaaaggtgatgggtgggtacggttataacattgagcagatactcatggttgatattataccagatgcctcggtgcgtagagcaatgaacgagataaatgctgcccagaggcttcagcttgctagtgtctacaaaggagaagctgaaaaggtcctgatggtgaagaaagccgaagcagaggcagaggccaaatatctttcgggtgttgggatagcaaagcagcgccaggctataactgatggactaagggataacatcttgaacttctctaacacagtgtctggcacttctgctaaagaggtgatggatctaataatggtcacacagtactttgacaccatcaaagagcttggaaactcatcaaagaacacgaccgtgttcattcctcatggccccggccatgtgagagatgtaactgatcagatacgtaatggagtgatggaagcatcgagcnatctggtnggaaactgatctctttccngtgtttcattctctgagtgtcangactctctgcnagtcanacaagcgtgtctctgttttcatcatcaatgtttgggtttcataaatttggtggtgtcatnntgtaaataaataataatgtggccatagttaaacaacttttctatttacttttaagagtcagtcactagtacttgtatcattacctgtggtctttgagcatgaaacttcaataacaggatttgtttctggacttc

SEQ ID NO: 967 - DNA, 1320 bp, Brachypodium distachyon
ggggttagttagaaggcaaagaagaaaaggtaaacggcagacccagcctgccagccagccagccagaacgcgcccgcggaacaagaacaaaaatcccccacgccgcgcagccgaattcgccgtcggaatcgaatccgtcgatcaaggtagccgcgggcggaaggaaggaaggaaggggatcggtcgagatggtgagcgccttcttcgtcttctgcgggtgcgtggagcaggcgaacgtagcggtggtggagaagtggggccgcttcctgcgcctcgccgagcccgggctccacttcttcaacccattcgccggcgagttcgtcgccgggacgctctccacccgcgtccagtccctcgacgtccgcgtcgagaccaagaccaaggataatgtatttgtccagctgatctgtacaattcagtacagagttgttaaggaaaatgctgatgatgcattctacgagttgcagaatccccaacagcaaattcaatcctatgtctttgacgtggttcgagccattgttccaagaatggagctcgacagtctttttgagcagaagaatgaggtagccaaatctgtacttgaggagcttggaaaggtaatgtcagattatggttacagcattgagcacattctgatggttgacatcatccctgatgctgctgtgcgcagagcaatgaacgacataaatgcagcccaaaggcttcagcttgcaagcgtctacaagggagaagcagagaagattcttatggtgaagaaagcagaaggggaagcagatgcgaaatacctctcgggtgtcggcatcgccaaacagcggcaggcgatcactgatggcctcagagagaacatcctcaacttctcgcacacggtgtcgggcaccagcgcgaaggaggtcatggacctgatcatggtcacgcagtactttgacacaatcaaggaactcggggacaactcgaagaacacgacggtgttcttgcctcacggcccgggccacgtcagggacatcagcgaccagatccggaacggcgtgatggaggcgtcgagcagcaatgtttgagaaactggctgtttgccgtgtgtgtggggtttatttcgttctctgctgtgagatggggagaggctgcttatgttagactagtagacttattatcattagttcataataaattaataacgggtgctaggacttggagttgtacacgttcatggaagattgttgagttttgatatatataatcatacgggtaaagcatttttgtgttaaaatttgcagcggatttacttggtttatatatgatatgctatggaagcacatatatata

SEQ ID NO: 968 - DNA, 1202 bp, Leymus cinereus x Leymus triticoides
  misc_feature (44)..(44): n is a, c, g, or t
  misc_feature (48)..(48): n is a, c, g, or t
  misc_feature (56)..(56): n is a, c, g, or t
  misc_feature (60)..(60): n is a, c, g, or t
  misc_feature (66)..(66): n is a, c, g, or t
  misc_feature (68)..(69): n is a, c, g, or t
  misc_feature (749)..(749): n is a, c, g, or t
  misc_feature (755)..(755): n is a, c, g, or t
  misc_feature (764)..(764): n is a, c, g, or t
  misc_feature (768)..(768): n is a, c, g, or t
  misc_feature (771)..(771): n is a, c, g, or t
  misc_feature (1179)..(1179): n is a, c, g, or t
  misc_feature (1183)..(1184): n is a, c, g, or t
gggggaaaaggtaaacgccgcgcaccgcaatcggaaatcccccncgcngcacgccncgcngccgantnnatcgaccgaccggcggaccgatccagccggccggccgacggagggaagcggagatggtgagcgccttcttcctcttctgcgggtgcgtggagcaggccaacgtggcggtggtggagaagtggggccgcttcctccgcctcgccgagccgggcctccacttcttcaacccctgcgccggcgagctcgtcgccgggaccctctccacccgcgtccagtcgctcgacgtcaaggtcgagaccaagaccaaggataatgtctttgttcaactgatatgtacaattcaataccgggttgttaaggagaatgcagatgatgcattctacgagttgcagaatccccaacagcaaattcagtcctacgtctttgatgtggttcgagccatagttccaagaatggagctggacagtctttttgagcaaaaaaatgatgtcgcaaaggatgtacttgaggagcttgaaaaggtgatgtcagattatggttacagcattgagcacattctcatggttgacatcatccctgatgctgctgtccgcagagcaatgaacgacataaatgcagcccaacggctccagctcgcgagcgtctacaaaggagaagcggagaagatccatctggtgaagaaggcggaaggggaggccgaggcgaagtacctgtcgggcgtcggcatcgccaagcagcgncaggcnatcacgganggcntgngggagaacatcctcaacttctcgcactcggtgtcgggcacgagcgccaaggaggtgatggacctgatcatggtgacccagtacttcgacaccatcaaggagctcggggacaactcgaagaccaccacggtgttcatcccccacggcccgggccacgtcaaggacatcggcgaccagatccgcaacggcatgatggaggcgtcgagcagcggcctgtaggccgtggccgtctgccgtgtatggtttggctggatgggttttctgcgtgaggcggggagagtcgatctgtttatatatattagaattatagtagactgcttatttgttatttttagtgtgtaataatacgggcgcagggacttggttgtgcatgaagattgtcgaattttggtgtattaaataatcgtanaagnnaaacattttgtgttagaa

SEQ ID NO: 969 - DNA, 1240 bp, Zea mays
cccccccccccagttgctccttccaccgttccacgcgtccacggtccacccacacgcaaggtcgcaggtcgcaacccgcgggcggagggtcaggcacaggaccgttgcgttgctgccgccgccggcacgagatcgaggagggatcccccgctctcacgccgctccaggtcgagggccgagcgagatggtgaacaccttcttcctcttctgcgggtgcgtggaccaggccagcgtggcggtggtggagaagtggggccgcttcctccgcctcgccgacccgggcctccacttcttcaaccccctcgccggggagtgcgtcgcgggctccctcaccacacgcgtccagtccctcgacgtccgcgtcgagaccaagaccaaggataatgtcttcgtccaactgatctgcacaatccagtaccgtgttgtcaaggaaaatgcagatgatgctttctatgagttgcagaatccccagcagcaaatccaggcctacgtctttgatgttgttcgggccatagtgccgagaatgaatctggacgatctctttgagcagaagaacgatgtggccaaagctgtattggaggagcttgaaaaggtgatggcagattatggttacagcattgagcacattctcatggttgatatcatccctgacgctgctgttcgtaaggcaatgaacgacataaatgcagcccaaaggcttcaactggcaagtgtttacaagggagaagcagagaagatccttatggtgaagaaagcggaggcagaagcagaggcgaaatatctttctggtgtcggtatcgctaaacagcggcaggcgataaccgacggccttagagagaacatcctgaacttctcacactcggtgtcgggcaccagcgcgaaggaggtcatggacctgatcatggtcacgcagtacttcgacaccatcaaggagctcggggacggctccaagaacaccacgatcttcataccccacggaccaggccacgtgaaggacatcagcgagcagatccgcgacggcatgatgcaggcctcaagcagcaacgtgtaaatcaccgactctctgcacgattggagacggctcggctcaggatgaggcctggagtaccatgttcatagtgttaggttgttgttagtggtaaataatgagtgctggggcttttggcgagtcttgagttacatgcggttgtacaactagtgtggtttgttttatatataaaaatgtatatttacatggttc

SEQ ID NO: 970 - DNA, 1320 bp, Cucumis melo
  misc_feature (849)..(849): n is a, c, g, or t
agcgatcgtaatctatcgtgccggagtcagcgggttttcaagtctacggaagtcagcggcgaggttttgcggagaaggcggagagagtttccgatggggaatacgaattgtgtgttgtttgggtgcgtggagcaatcaagtgttggggtggtggaaagatggggaaggtttgaaaaattggctcagcctgggctccatttcttcaacctattcgctggcgagtgcctcgccggtaccctctccaccagaatttcttccctcgatgttcgcattgagaccaagaccaaggacaatgtctttgtgcaactgctgtgttctattcagtaccgagtcgtcaaagaaaatgctgatgatgcattttatgagttgcaaaatcctcaagaacaaattcaagcttacgtgtttgatgtggttcgtgctgttgttccaaaaatgaatttggatgaactatttgaacaaaagggtgaagttgctaaagctgtatccgaggaacttgagaaggtgatgggagattatggatacagtatagagcacattctaatggtcgatataataccagatgcttctgtgcgcagggcaatgaatgaaattaatgcagctcaaaggcttcaacttgctagtgtgtacaaaggcgaagcagagaaggtgctcctagtaaaaaaggcagaagccgaagccgaagcaaaatacctgggcggtgttggtgtggctagacagaggcaagcgatcacagatggtttgagagaaaacatcttgaacttctctcataaggtggaaggcacttcagccaaagaggtcatggatctgattttaatcactcaatattttgacaccatcaaagaccttggnaattcctcaaagaacacaactgtattcatacctcacgggccaggccatgttagagatatcagtggccaaatacgcaacggcatgatggaggctgctgcgagcgcccaggccagggtcacaaatgatgaggtgaacattgatttacttcaatgattcatcagacaccatgtatatgtgcttcttcttctccacaactttgaaaaaaattgttctttatatgtgacgagggtgtataaaaatataacgatgtgcaaagtcgatatacttgttttggtttgtgcatagagggttcaataagctggaaaaatgtatctcctgatatagagattttttatcactacttgatatccctatttacaaattaaaatgttctgtaattgtcttgtatttcttcgcaccattatgcctgagacaagagtttcatggccatggccatggccatggatttgataaataaaatttttgtattgc

SEQ ID NO: 971 - DNA, 1081 bp, Pennisetum glaucum
gggcgcttcgtccgcctcgccgagccgggcctccacttcttcaacatcttcgccggggagtacatcgcgggtacactcaccacccgcgtccagtccctcgacgtccgcgtcgagaccaagaccaaggataatgtcttcgtccagctgatttgcacaatccaataccgtgttgtcaagcaaaatgctgacgatgcattctatgagttgcagaatccccaacagcaaattcaggcctacgtctttgatgtgttcgggccatagttccaagaatgaatctggacgatcttttcgagcaaaagaatgatgtggcaaaagctgtacttgaggagcttgaaaaggtgatggcagattatggttacagcattgagcacatcctcatggttgatatcatccctgacgcttctgtgcgcaaagcaatgaatgatataaacgcagcccaaaggcaacagctggcaagcgtctacaaaggtgaagcagagaagattcttctggtgaagaaggctgaagcagaggcagaggcgaaatatctctctggtgtcggcatcgccaagcagcggcaagctataaccgacggcctcagggagaacatcctgaacttctcgcactcggtgtcgggcaccagcgccaaggaagtcatggacctgatcatggtcacgcagtactttgacaccatcaaggagctcggggacgggtcgaagaacaccacggtgttcatcccccatgggccgggccacgtgaaggacatcagcgagcagatccgggacggcatgatgcaagcctcaagcagcagcgtgtaaaatctctgttggcatgtgtgcacacgaacgcttcagctcgggatgagtctcgggctaatctgttaatattattattaggtcattcgtgcttagtggtgaataatgagtgcttggcatctggtcctgaaactagtgtggacggatctttgtatgacataagttttgcatgtcctatttagcctaagtctagacaatgtacagtgatctgcttgagtgcatgatgtatgtgggtgtggaactgtggattcttctctgcacataatataagtgaagtgaagcatttc

SEQ ID NO: 972 - DNA, 1183 bp, Pseudoroegneria spicata
  misc_feature (33)..(33): n is a, c, g, or t
ccgcacgccgaatccgtcgccggaatccatcgntcgaccggcggaccgatccagccggcaggccggcgagagcagggggaagcggcggagatggtgagcgccttcttcctcttctgcgggtgcgtggagcaggccaacgtggcggtggtcgagaagtggggccgcttcctccgcctcgccgagccgggcctccacttcttcaacccctgcgccggcgagctcgtcgccgggaccctctccacccgcgtccagtcgctcgacgtcaaggtcgagaccaagaccaaggataatgtgtttgttcagctgatctgtacaattcaataccggattgttaaggagaatgcagatgatgcattctacgagttgcagaatccccaacagcaaattcagtcctacgtctttgatgtggttcgagccatagttccaagaatggagctggacagtctttttgagcaaaagaatgatgtcgcaaaggctgtacttgaggagcttgaaaaggtgatgtcagattatggttacagcattgagcacattctcatggttgacatcatccctgatgctgctgtccgcagagcaatgaacgacataaatgcagcccaacggctccagctcgcgagcgtctacaagggagaagcggagaagatccatctggtgaagaaggcggaaggggaggccgaggccaagtacctgtcaggcgtcggcatcgccaagcagcggcaggccatcacggacggcctgcgggagaacatcctcaacttctcgcactcagtgtcgggcacaagcgccaaggaggtgatggaccttatcatggtcacccagtacttcgacaccatcaaggagctcggggacaactcgaagaccaccacggtgttcatcccccacggcccgggccacgtcaaggacatcggcgaccagatccgcaccggcatgatggaggcgtcgagcagcggcctgtaggccgtggtcgtctgccacgtgtatggtttggctggatgggttttctgcgtgaggcggggagagtcgatctgtttatatatattgttagaattatagtagactacttatttatttgtttttagtgtgtaataatacgggcgcagggacttggttgtgcatgaagattgtggaattttggtacgtattatataatcgtaaaaagtgaaacattttgtgttagaatcta

SEQ ID NO: 973 - DNA, 1290 bp, Oryza sativa
atcatcgtgttcgtttcctcgtcaaaagggcaaaaagaacacgaagaagaggggcgtccaaatccgccgccgaattccccacccgtcgcgtccaaaatccaaatccgccgccgcgatcgaggccgacgaggagaggttgaggttgaggtgagagccatggtgagcgccttcttcctgctgtgcgggtgcgtggaccaggcgagcgtcgcggtggtggagaagtggggccgcttcctccgcctcgccgagccgggcctccacttcttcaacccgttcgccggcgagttcgtcgccgggacgctctccacccgcgtccagtcgctcgacgtccgcgtcgagaccaagaccaaggataatgtctttgttcagcttatctgcacaatccaatatcgggttgttaaggaacatgctgatgatgcattctatgagttgcagaatccccaacagcaaattcaggcctacgtctttgatgtggtccgagctatagttccgagaatgaatcttgatgatctttttgagcaaaagaatgatgtggcgaaagctgtacttcaggagctagaaaaggtgatgggagattatggttacagcattgagcacattctcatggttgacatcatccctgatgctgctgtacgcagagcaatgaatgaaataaatgcagcacaaaggcttcagcttgcaagtgtctacaaaggagaggcggagaagattcttctggtgaagaaagcagaagcagaggcagaggcaaaacacctttccggtgtcggcattgctagacagcggcaggcgataactgatggcctgagagagaacatcctgaacttctcgcactcggtttcaggcacctcagcaaaagaagtcatggatctcatcatggtcacgcagtacttcgacaccatcaaagaacttggggatggctcgaagaacaccacggtgttcatacctcatggcccaggccatgtcagggatatcagcgagcaaatccggaatggtatgatggaagcgtcctgcagcaacgtgtaaatcggtatcgaatgcggaaccaaggttgggggtggttcagatgggaggtcctgtttatagtgaatagtacgaatgaatgctagtagcatgtgttgtttgcacgcgcgccctggagttgtatgcagtggtagatagagttcgagttttggcataataatattgtctgaattttatgtaaaagaaaatcacatgtcttccttttgtgagttaaaagttgcaccgatttatgcatggcaatatctcaactgcaaaaaactggtgagttac

SEQ ID NO: 974 - DNA, 1394 bp, Sorghum bicolor
aacaaaccgtttttcctgtttccacgcgtccacccacacgcaaggtcgcgtcgtcgtgaacccgcgggcggagaagaagggggacacgcaggcaggcacagccaccgctgccggcggcgcgagatcgaggaaggaggggatcccacgctcccctgccgcgccgctcgaggtcgagtgccgagcgagatggtgaacgccttcttcctcttttgcggctgcgtggaccaggccagcgtggcggtggtggagaagtggggccgcttcctccgcctcgccgacccgggcctccacttcttcaaccccttcgccggggagtgcgtcgcgggcgccctcaccacccgcgtccagtccctcgacgtccgcgtcgagaccaagaccaaggataatgtctttgtccagctgatctgcacaattcagtaccgtgttgtcaaggaaaatgcagatgatgcattctatgagttgcagaatccccaacaacaaattcaggcctacgtctttgatgttgtccgggccatagtgccaagaatgaatctggatgatctctttgagcagaagaatgatgtggccaaagctgtactggaggagcttgaaaaggtgatggcagcttatggttacagtattgagcacattctcatggtcgatatcatccctgacgctgctgttcgcaaagcaatgaacgaaataaatgcagcccaaaggctccagctggcaagtgtttacaaaggagaagcagagaagattcttatggtgaagaaagcggaggcagaagccgaggcgaaatacctttctggtgtcggtatcgccaaacagcggcaggcgataactgatggcctcagagagaacatcctgaacttctcacactcggtgtcaggcaccagcgcgaaggaagtcatggacctgatcatggtcacgcagtacttcgacaccatcaaggagctcggtgatggctccaagaacaccacgatcttcataccccatggaccgggccacgtgaaggacatcagcgagcagatccgcgatggcatgatgcaagcctcaagtagcaatgtgtaaatcacctatagtcctacacgtggattggaggcgtttcagctcgggatgaggtctcgagtaccatgttcatagtattagattgttattagtggtaaataatgagtgctggggctttcggcaagtctggagttgtttgcggccttaaaactagtgaggttgaattttctgtaaaaaatgtgttagcccgaatgctcgaccttacacgttctttccagatacaagtcatagcgagcagagtttaatatatagtgatatctttgtgctggaaattatttacgtggttctacacttgtacttctgtagttttgcatgcttgttgctgtcagaggcacataaacaga

SEQ ID NO: 975 - DNA, 1157 bp, Glycine max
caaaagggtaattggttgtaatagcaaaaagcaaaggaaggatggggaacacgttctgcttgttctgtggttgcgttgctcaatccagcgtcggcgtcgtcgaacagtggggtcgcttccaccgcctcgcccaacccggcttccactttttcaaccctctcgccggcgaatgcctctccggtatcctctccaccaggatctcctccctcgatgtccgcatcgaaaccaaaaccaaggacaatgtgtttgtgcagttgctgtgttcgattcaataccgagtgattaaggaaaacgctgatgatgctttctatgagttgcaaaaccctcaggagcagatccaggcttatgtttttgatgtgactcgtgctattgttccgagaatgaacttggacgagctgtttgagcagaagggtgaggttgccaaagctgtcttggaggaacttgaaaaggtgatgggagaatatggatatagtatagagcacatactcatggttgatattatacctgatcctgctgtgcgtaaggcaatgaatgagatcaatgcagctcaaaggatgcaacttgctagtcagtacaaaggagaagctgaaaagattttgctagttaaaaaagcagaggccgaagctgaagccaagtatttgggtggggttggtgtagcaaggcagcgacaagctatcacagatggtttgagagagaacatcctcaatttctctcacaaggtagaaggcactaacgctaaggaggtgatggatcttatcatgattactcagtactttgacacaatcaaagaccttgggaattcatcaaagaataccactgtttttataccccatggacctggccacgttagggatattggtgagcagatacgcaatggactgatggaagcagccagtgctcaagtaaatgtggaggagtgattttgtaatattgccttagaaagtatatctctctctgtcacacacacacacacaatgatattctagttttattacttgtgtatgtaatatgtttctgctaaattttgtggaagaaaagttttgttcagttggaagttgtaatataagatgtttttcagtcgtattaaataatctttctagtcatgctatatgtcagaaattcaaaagatgatatgcaatttgctttataggaagagg

SEQ ID NO: 976 - DNA, 1298 bp, Saccharum officinarum
  misc_feature (75)..(75): n is a, c, g, or t
  misc_feature (361)..(361): n is a, c, g, or t
ggacacgaaggcagaggcaggcacaggagtacaggaccgaccggtgccgcccccgccggcgcgagatcgaggaangagggatccacgctcctgccacgccgctcgaggtcgagggccgagcgagatggtgaacgccttcttcctcttctgcgggtgcgtggaccaggccagcgtggcggtggtggagaagtggggccgcttcctccgcctcgccgacccgggcctccacttcttcaaccccttcgccggggagtgcgttgcgggcgccctcaccacccgcgtccagtccctcgacgtccgcgtcgagaccaagaccaaggataacgtctttgtccagctgatctgcacaattcaataccgngttgtcaaggaaaatgcagatgatgcattctatgagttgcagaatccccaacagcaaattcaggcctacgtctttgatgttgttcgggccatagtgccaagaatgaatctggacgatctctttgagcagaagaatgatgtggccaaagctgtactggaggagcttgaaaaggtgatggcagcttatggttacagcattgagcacattctcatggtcgatatcatccctgacgctgctgttcgcaaagcaatgaacgaaataaatgcagcccaaaggctccagctggcaagtgtttacaaaggagaagcagagaagattcttatggtgaagaaagcggaggcagaagccgaggcgaaatatctttccggtgtcggtatcgccaaacagcggcaggcgataactgacggcctcagagagaacatcctgaacttctcacactcagtgtcaggcaccagcgctaaggaagtcatggacctgatcatggtcacgcagtactttgacaccatcaaggagctcggcgatggctctaagaacaccacgatcttcataccccacggcccgggccacgtgaaggacatcagcgagcagatccgggacggcatgatgcaagcctcaagtagcaatgtgtaaatcacctacaatcctacacggttggaggcgtttcagctcgggatgaggtctcgagtaccatgttcatagtgatagattgttattagtggtaaataatgagtgttggggctttcggcgagtttggagttgtttgtggccttaaaactagtgtggttgaattttctgtaacaaaatgtgttagcccgaatgctcgaccttacacgttctttccagatacaagtcatagtgaccagagtttaatatatagtgatatctttgagttggaaaaaaaaaactataataaagtaatactaccaaaagataaaag

SEQ ID NO: 977 - DNA, 1405 bp, Panicum virgatum
gaccgtccaagcccatcgttcgacttggaggctcgcaagcggagaacagaggggacacgcaggcgagggcggtgccgccggcgcgagatcgagagatcccaatatcccatcccccgccgacgcgacgctgttcgagggccgagcggaattcgtcgccgccggagccggagccgagggagcccgagatggtgaactcgttcttcgtgttctgcgggtgcgtggaccaggccagcgtggcggtggtggagaagtgggggcgcttcgtccgcctcgccgagccgggcctccacttcttcaaccccttcgccggggagtgcgtcgcggggtccctcaccacccgcgtccagtccctcgacgtccgcgtcgagaccaagaccaaggataatgtcttcgtccagctgatttgcaccattcaatatcgtgttgtcaaggaaaatgctgatgatgcattctatgagttgcagaatccccaacagcaaattcaggcttacgtctttgatgttgttcgggccatagttccaagaatgaatctggatgatcttttcgagcaaaagaatgatgtggcgaaatctgtactggaggagcttgaaaaggtgatggcagattatggttacagcattgagcacattctcatgattgatatcattcctgacgctgctgtgcgcaaagcaatgaatgagataaatgcagcccaaaggcttcagctggcaagcgtctacaaaggagaagcagagaaggttctcttggtgaagaaggcggaagcagaagcagaggcaaaatatctctccggtgtcggcattgccaagcagcggcaagctataaccgacggcctcagggagaacatcctgaacttctcgcactcggtgtcgggcaccagcgccaaagaagtcatggacctgatcatggtcacacagtactttgacaccatcaaggagctcggggacggctcgaagaacaccacggtgttcatcccccacggcccgggccacgtgaaagacatcagcgagcagatccgggacggcatgatgcaggcctcgagcagcaacgtgtagaccactcgttgacgtgggcacacacggctggggacgcctcagctcgggctgagcctcaggctaatctgtttatagtattagatcgttagtggtaaataacgagtgctaggactttcggcttgtcacctggagttgtatgcggtcctgaaactagtgtggatgaattttcgtatgagataatgtccaggccgtacgtgtttttgcatgttctttctagctatgacaagttatatactgatctggccttttagacaatgtatagcgcttcagttgatacgtgggtgtggatttttgcctgtgcagaatacttgtgaattgaagcattatatggttggaaaatctttacatggccc

SEQ ID NO: 978 - DNA, 1240 bp, Triticum aestivum
  misc_feature (205)..(205): n is a, c, g, or t
cccacgcgtccgagaaaaggggagaaaagtaagcgccgcgcaccgcaatcggaacggaaatcccccgcgccgcacgccgaatccgtcgccggaatccatcgaccgatccggccggccggccgacgggagaagggaagcagcggagatggtgagcgccttcttcctcttctgcgggtgcgtggagcaggccaacgtggcggtggtngagaagtggggccgcttcctccgcctcgccgagccgggcctccacttcttcaaccccttcgccggcgagctcgtcgccgggaccctctccacccgcgtccagtcgctcgacgtcaaggtcgagaccaagaccaaggataatgtgtttgttcagctgatctgtacaattcaataccgggttgttaaggagaatgcagatgatgcgttctacgagttgcagaatccccaacagcaaattcagtcctacgtctttgatgtggttcgagccatagttccaagaatggagctggacagtctttttgagcaaaagaatgatgttgcaaaggctgtacttgaggagcttgaaaaggtgatgtcagattacggttacagcattgagcacattctcatggttgacatcatccctgatgctgctgtccgcagagcaatgaacgacataaatgcagcccaacggctccagcttgcgagtgtctacaaaggagaagcggagaagatccatctggtgaagaaggcggaaggggaggccgaggctaagtacctgtcaggcgtcggcatcgccaagcagcggcaggctatcacggacggcctgcgggagaacatcctcaacttctcgcactcggtgtcgggcacgagcgccaaggaggtgatggacctgatcatggtcacccagtactttgacaccatcaaggagctcggggacaactcgaagaccaccacggtgttcatcccccacggcccgggccacgtcaaggacatcggcgaccagatccgcacaggcatgatggaagcgtcgagcagcggcctgtaagccatggccgtctgtccgccatgtgatgatggtttggctggatgggttttctgcgtgaggctgggagagtcgatctgtttatatatattgttagaattatagtagactacgtacttatttatttgtttttagtgtgtaataatacaggcgcagggacttggttgtgcatgaagattgtagagttctggtattatataatcataaaatgggaaacattttgtgttaaaa

SEQ ID NO: 979 - DNA, 1206 bp, Triticum aestivum
  misc_feature (1191)..(1191): n is a, c, g, or t
aaggggagaaaagtaagcgccgcgcaccgcaatcggaacggaaatcccccgaatccgtcgccggaatccatccatcgagcgatccatccggccggacggcgaggcgggagcaggaggggagcggcggagatggtgagcgccttcttcctcttctgcgggtgcgtggagcaggccaacgtggcggtggtcgagaagtggggccgcttcctccgcctcgccgagccgggcctccacttcttcaaccccttcgccggcgagctcgtcgccgggaccctctccacccgcgtccagtcgctcgacgtcaaggtcgagaccaagaccaaggataatgtgtttgttcagctgatctgtacaattcaataccgggttgttaaggagaatgcagacgatgcattctacgagttgcagaatccccaacagcaaattcagtcctacgtctttgatgtggttcgagccatagttccaagaatggagctggacagtctttttgagcaaaagaatgatgttgcaaaggctgtacttgaggagcttgaaaaggtgatgtcagattatggttacagcattgagcacattctcatggttgacatcatccctgatgctgctgtccgcagagccatgaacgacataaatgcagcccaacggctccagcttgcgagtgtctacaaaggagaagcggagaagatccatctggtgaagaaggcggaaggggaggccgaggctaagtacctgtcaggcgtcggcatcgccaagcagcggcaggctatcacggacggcctgcgggagaacatcctcaacttctcgcactcggtgtcgggcacgagcgccaaggaggtgatggacctgatcatggtcacccagtacttcgacaccatcaaggagctcggggacaattcgaagaccaccacggtgttcatcccccacggcccgggccacgtcaaggacatcggcgaccagatccgcaccggcatgatggaggcgtcgagcagcggcctgtaggccgtgtggttcgatgggttttctgcgtgaggctgggagaaccgatctgtttataatatattagaattatagtagactgcttatttgtttgtttttagtgtgtaataatacggacgcagggacttggttgtgcatgaagattgttggattttggtcttatattataatcgtaaaaagtgaaacattttgtttganaatttaaaaaaaaaa

SEQ ID NO: 980 - DNA, 900 bp, Brachypodium distachyon
tccaccacgcccacgatgtgcaccttggagcagcggggccgcgtcttcgtgctcaccctcaccggcgacggcgagcaccgcctgggccacgccctcatttcctcgatccgctccgcgctcgcctccgccgccgccgcggcggcggcccaggcggggcccggggcctgcctcgtcaccgtcggcgagggccgcttcttctccaacggcctcgacatcggctgggcggggacctcccgcgcgcggctcggggagctcgtcgccgcgctccgccccgtggccgccgacctcctcgcgctgcccatgcccaccgtcgccgccctcacgggccacgcctccgccgccgggttcctcctcgcgctctgccacgactaccgcctcatgcgcgccgaccgcggcgtgctctacatgagcgaggtcgacatcggcctcccgctcccgccctacttcatggccgtgctccgcgccaagatcaccgccgcgcaagcgctccgcgacgtcgtgctccggggcaggaagctcagggcccccgacgccaaggagatgggcatcgtcgacgccgtctgccccggcgcccccgagacggcggccgaggccctcaagctcgccgagcagctcgccgccaggaagtgggacggcgccgtgtacgcgtccataaggatctccatgtaccctgacgcctgcagatccgttggaattgtcgaggagagcgacgaggagaaggccaggaccttcgcttcttccaaactctgacgagacgagagggtttctatggagtcgggggtatcttttcgcattttgcatatgtacattgatcagccattgctctgtacgaagcacccaacatatatttatgcagaccttgtactgttcttgccttggatgtgggaaataaatattctg

SEQ ID NO: 981 - DNA, 816 bp, Lolium multiflorum
gggcaggtacacttcgtctcttccgcacaccaacccaactccacacacaacccaaggccgcacgccgccgccgcccacgatgtgcacgctggagcagcacggccgcgtcttcgtgctcaccctcacgggcgacggcgagcaccggctgggccacgcgctgatcgcctcgatccgcgccgcgctcgcctccgtcgccgcgcaggcggcccaatccggcccgggggcggccctggtgaccgtcgcggagggccgcttcttctccaacgggctggacatcgggtgggcgggcacctcccgcgccaggctcggggaactcgtggccgcgctgcgccccgtggccgccgacctgctggccctgcccatgcccaccgtcgccgccgtcacgggccacgcctccgcgggcggcttcctcctcgcgctctgccacgactaccgcgtcatgcgcgccgaccgcggcgtgctctacatgagcgaggtcgacatcggcctgcccctcccgccctacttcgtcgcgctcttccgcgccaaggtcaccgccgcgcacgcgctccgcgacgtcctgctccgcggcaggaagctccgggcgcccgaggccaaggcgatgggcatcgtcgacgtcgtctgccccggcgcgccagagacggcagctgaggcgctcaggctcgccgaggagctcgccgccaggaagtgggacggcgccgtctacgcctccatcagggtctcatgttcccgatgcgtgcagtaaggttggaattgtaaaagaaagcgatgagaacaaggccaggagctcgcttccaagctctgatcatcagagat

SEQ ID NO: 982 - DNA, 1090 bp, Zea mays
cactacgaagtacgaccaatctggccgccttgtgagttgcgagttgcgacttctagcatatcatcggcatcgcctgctctgctggtgaagagcgaaggccgaaggggccaagaccacacgccttccaaggtccacacctaccccaagagccgcccgccccatcagccgccacgatgtgcaccctggagcagcgcggccgcgtcttcgtcctcacccttaccggcgacggcgagcaccgcctgggccacgccctcatctcctcgctccgatccgccgtcgcctccgcggcggctggtgcggccaaggcggggcccggggccgcgctcgtcaccgtcggcgagggccgcttcttctccaacggcctcgacatcgggtgggcgggaacctcccgcgcgcgcctaggcgagctcgtcgacgcgctccgcccgctcgttgccgacctcctcgcgctccccatgcccaccgtcgccgccgtcaccggccacgcctccgcgggcgggtgcctcctcgcgctctgccacgactaccgcatcatgcgcggggaccgcggagtgctctacatgagcgaggtcgacatcggcctccccctcccgccctacttcatggccgtgctccgcgccaagatcaccgccgccaacgcgctccgcgacgtcgtgctcaggggcaagaaggtcagggccgcggagggcaaggatatgggcatagtggatgccgtctacccctctgcgctcgagacggcggaccaggccttcaagtttgccgagcagctcgcggcgaggaagtgggacggaggcgtctacgcgtccataaggatgtccatgtaccctgaggcctgcaggtcagttggaatcgtcgaggagagcgatgaggagaagcggaagcacttcgcttctaagctctaacttcgtgattggctgatgagagggtttctgtggaagcatggaggaacctacacattctgtatctgtacatcgtccaaccattggcgctgtcgctacgtgtgaagtacacaccgtgtacttgtgcagaccttgtaatttttacttgcctggtagcgggaaataaatcgaagctcctctcaccctttctt

SEQ ID NO: 983 - DNA, 1168 bp, Pseudoroegneria spicata
  misc_feature (6)..(6): n is a, c, g, or t
  misc_feature (820)..(820): n is a, c, g, or t
  misc_feature (1130)..(1130): n is a, c, g, or t
cccaancaagctccaccacgcccctgccccgcagccggccggcgacgatgtgcaccctggagcagcgcggccgggtcttcgtcctcaccctcacgggcgacggcgagcaccggctcggccacccgctcatcgcctccatccgctccgcgctggccgaggtcctcgccgcggcccaggcccagccccagggcccgggggcggccctggtcaccgtcgccgagggccgcttcttctccaacgggctcgacatcgggtgggcgggcacctcccgcgcgcgcctcggggagctcgtcgacgcgctccgccccgtcgccgccgacctgctggcgctccccatgcccaccgtcgccgccgtcacgggccacgcctcggcggggggcttcctgctcgcgctctgccacgactaccgcgtcatgcgcgccgaccgcggcgtgctctacatgagcgaggtcgacatcggcctccccctcccgccctacttcgtgcacgtgctccgcgccaagatctcccaggcgcaggccctccgggacgtcgtgctgcgcgggaagaagctccgggcgcccgaggcgaaggagatgggcgtcgtcgacgtcgtctgccccggcgcgcccgagaccgccgccgaggccctcaagctcgccgagcagctcgcggcgaggaagtgggacggcgccgtgtacgcgtccatcaggatgtccatgttccccgatgcgtgcagggccgttgggattgccgtggagagcgacgaggagaagagcaggcacttcgcttccagactctgatcagcagagatgggagtgtctatggagcctgaaatctntcttggtattcttcacctgtacgttgatcagccatcgatgctatgcatgaaacacgcagtacatacttctgcagatgttgtatttctcttgctttgggagtgtgaaataaacagaatgcttgtgtgtgattgttggattgattatttcgctgttgcctgagtgcattatgttcttttgatatctgtgtattggaaccataagagcatgtttaggtaggaggacatgaattcgtgtcggtttagcttaagcgagctaccacatccaaatgctcctaaggtttatccacattgcaatgggttataaatgttntaatgttaatatattgtgtaaataaatgttaaaaaaaa

SEQ ID NO: 984 - DNA, 1132 bp, Oryza sativa
aaatttgtttgttatactttgttttgacacaaccgagttctccccatcctgcaagcaatcgctcgccggctttatctccgtctccaatctccttctacgaccagacgcgaacggcgaaccgcaaccacctctgctgctacgctagccaccaccaccaaccacgatgtgcacgctggagcagcgcggccgcgtgttcgtgctcacgctcaccggcgacggcgagcaccgcctcggccactccctcatcggctccatccgcgccgccgtctcatccgtcgcggcggcggcggcggcggccgggccgggcgcggcgctggtcaccgtggcggaggggcggttcttctccaacggactcgacatcggccctggcgggatccccccctcgcgggtcggggagctcgtcgtggcgctccgccccctcgccgccgatctcctcgcgctccccatgcccaccgtcgccgccgtcacgggccacgcctccgcgggcgggttcctcctcacgctctgccacgactaccgcctcatgcgcgccgaccgcggcgtgctctacatgagcgagatcgacatcggcctcccgctcccgccctacttcgtggccatcctccgcgccaagatcaccgccgcgcacgccctccgcgacgtcaccctccgcggcaggaagctcaaggccgcggaggccaaggagatgggaatcgtcgacgtggtttgccccaccgccgctgaaacggcggccgaggccgtcaagctcgccgagcagttggcggcgcggaagtggaacgggaacgtgtactcgtccattagaatatccatgttccctgaggcttgcaggtccgtcggaattgtcgaggagagcgatgaggagaagaggaatcactttgcttctaagctatgaggatgtgaaagggattctgtggaagtggaccattgagctcttctcaacattatgtgtacattggctagccaagtagccatggatgctttgtatgaaggaccaaataatccagtatatataatttctggaaagcttgtaaactgttgctctatctgcaagtggggaatatattccagttcctttgcaccaccttgagtccttgattaaagaattaatgaaaattctcactgcggaattacc

SEQ ID NO: 985 - DNA, 1121 bp, Sorghum bicolor
cgcagttcatcggtttggccgcgggccggccaaaaaatcgagcgctcctgctctgctgctgaggagcgaagagccgaagaccacacacgccttcccacgctccgcacctaccgcgagggccgcccccaatccccatccgccggcacgatgtgcaccctggagcagcgcggccgcgtattcgtcctcaccctcaccggcgacggcgagcaccggctgggccacgccctcatctcctcgctccgctccgccgtcgcctccgccgcggagggcgcggccaaggcggggcccgggtgcgcgctcgtgaccgtcggcgagggccgcttcttctccaacggcctcgacatcgggtgggcgggcacttcccgcgcgcgcctcggcgagctcgtcgccgcgctccgcctgctcgccgccgacctcctcgcgctgcccatgcccaccgtcgccgccgtcacgggccacgcctccgcgggcgggtgcctcctcgcgctctgccacgactaccgcatcatgcgcggcgaccgcggggtgctctacatgagcgaggtcgacatcggcctcccgctcccgccctacttcgtggccgtgctccgcgccaagatcacctccgccaacgcgctccgtgacgtcgcgctgaggggcaagaaggtcagggccgccgagggcaaggagatgggcatcgtggatgccgtctacccttctgcggacgagacggcggccgaggccttcaagtttgccgagcagctcgcggccaggaagtgggatgggggcgtctacgcgtccataaggatgtccatgtaccctgaggcctgcaggtctgttggaattgtcgaggagagcgatgaggagaagcggaagcacttcgcttccaagctctgatgtcgtgattcgagagagggtttctgtggaagcatggaggaaccttcacattctgtatttctacgtcgtccaaccattgacgctgtcgctatgtatgaagtacgcaccgtgtacttgtacaaaccttgtaacttgcctggtagtgggaaataaattgaagctcctctccccaccttgcttgaagaatttcaatgtgcctgctagactctataattattccaataatattattgatgtgtgttcat

SEQ ID NO: 986 - DNA, 1088 bp, Panicum virgatum
ccgcgagagggcgtgttccccccaatctgccggcagcgatgtgcaccctggagcagcgcggccgcgtgttcgtcctcaccctcacaggcgacggcgagcaccgcctgggccacgccctcatctcctccctccgctccgccgtcgcctccgccgcggaggccgcggcccgggcggggccgggggccgcgctcgtcaccgtcggcgagggccgcttcttctccaacgggctcgacatcgggtgggcgggcacctcccgcgcgcgcctcggggagctcgtcgacgcgctccgcccgctcgccgccgacctcctcgcgctccgcatgcccaccgtcgccgccgtcacgggccacgcctccgccggcgggttcctcctcgcgctctgccacgactaccgcctcatgcgcgccgaccgcggcgtgctctacatgagcgaggtcgacatcggcctgcccctcccgccctacttcatggccgtgctccgcgccaagatcaccgccgccaacgcgctccgcgacgtcgtgctccggggcaggaagctcagggccgcggagggcagggagatgggcgtcgtcgacgccgtctacccctccgcggccgagacggctgccgaggccttcaagtttgccgagcagctcgcggcgaggaagtgggacggtgccgtgtacgcgtccataagaatgtccatgtaccctgaggcctgcaggtcagttggaattgtagaggagagtgacgaggtgaagaggaagcacttcgcttccaagctctgaagccgtgattgtgattcgagtgagggtttctgtggtggagatcccttcacgttctgtattggtacgtcggctcagccagccattgacactatcgatgaatcagacaatatgtacatgttcaaaccttgtgattgtgagttgcttgcttgaaggtggggactaaattcatgtttctctccccaccttgctggaaaatttttaatgtgcctgctagactctatagaattccaataagatcaccgataggtgttcatatgttgtggtcgagctcgcgttatttcgtattcctgggatattggaagtttgaaactttcacgttgc

SEQ ID NO: 987 - DNA, 1018 bp, Triticum aestivum
  misc_feature (828)..(828): n is a, c, g, or t
ccacgcccccgcccgccccgcagccggccggcgacgatgtgcaccctggagcggcgcggccgggtcttcgtcctcaccctgacgggcgaggaccagcaccggctgggccacccgctcatcgccgccatccgctccgcgctggccgaggtcctggccgcggcccaggcccagccgcagggcccgggggcggccctggtgacggtcgccgagggccgcttcttctccaacgggctcgacatcgggtgggcgggcacctcccgcgcgcggctcggggagctcgtcgacgcgctccgccccgtcgccgccgacctgctggccctccccatgcccaccgtcgccgccgtcacgggccacgcctccgccgccggcttcctcctcgcgctctgccacgactaccgcgtcatgcgcgccgaccgcggcgtgctctacatgagcgaggtcgacatcggcctccccctcccgccctacttcgtgcacgtgctccgcgccaagatctcccaggcgcaggccctgcgggacgtggtgctgcgcgggaagaagctccgggcgcccgaggccagggagatgggcgtcgtcgacgtcgtctgccccggcgcccccgagaccgccgccgaggccctcaagctcgccgagcagctcgccgccaggaagtgggacggcgccgtgtacgcgtcgattaggatgtccatgttccccgatgcgtgcagggccgtcgggatcgccgtggagagcgacgaggagaagagcaggcacttcgcctccaggctctgatcaggacacagattggagagtgtctatgtaacctgaaatctctcttggtattctgcncctgtacattgatcagccatcggtgctctgtatgaagcaagcagtacatacttctgcagacgttgtatctccttgctttgggagcatgaaataaacagaacgcttgtgtacgactgttggacatattgttttgttgttgctgcagtgagattctcgtttacagaattgacatatgacacctgaatgcatt

SEQ ID NO: 988 - DNA, 1024 bp, Triticum aestivum
  misc_feature (9)..(9): n is a, c, g, or t
  misc_feature (15)..(15): n is a, c, g, or t
  misc_feature (971)..(971): n is a, c, g, or t
  misc_feature (999)..(999): n is a, c, g, or t
  misc_feature (1004)..(1004): n is a, c, g, or t
  misc_feature (1014)..(1014): n is a, c, g, or t
tgctcgggnttacgncgacccacgcgtccgcctcctccgagggcccaacccaagtccaccacgcccccgccccgcagccggccggcgacgatgtgcaccctggagcagcacggccgcgtcttcgtgctcaccctcacgggcgaggaccagcaccggctcggccacccgctcatcgccgccatccgcgccgcgctggcctcggtcctcgcggcggcccaggcccagccgcagggcccgggggcggccctggtgaccgtcgccgagggccgcttcttctccaacggcctcgacatcgggtgggcgggcacctcccgcgcgcggctcggggagctcgtcgacgcgctccgccccgtcgccgccgacctgctcgcgctccccatgcccaccgtcgccgccgtcacgggccacgcctccgccgccggcttcctcctcgcgctctgccacgactaccgcctcatgcgcgccgaccgcggcgtgctctacatgagcgaggtcgacatcggcctccccctcccgccctacttcgtccacgtgctccgcgccaagatctcccaggcgcacgcgctacgggacgtcgtgctgaggggcaggaagctccgggcgcccgaggccagggagatgggcgtcgtcgacgtcgtctgccccggcgcgcccgagaccgccgccgaggccctcaagctcgccgagcagctcgccgccaggaagtgggacggcgccgtgtacgcgtcgatcaggatgtccatgttccccgatgcgtgcagggccgtcgggatcgccgtggagagcgacgaggagaagagcaggcacttcgcctccaggctctgatcaggtgtctatggagcctgaaatctctcttggtattcttcacctgtacattgatcagctatcgatgctctgcatgaaacacgcagtacatacttctgcagacatcgtatttctcttgctttgagattgaaataaatagaatgctngtgtgtgattgtcggattggttacttcnctgtngctgcagtgncattctcatt

SEQ ID NO: 989 - DNA, 920 bp, Brachypodium distachyon
ttctttccctaaacccagaacccgaaaatggcgcagtgtctccgcggcaagggcggcgccgccgccgtcgaggaggcgctccgcaaggcggtcccctggcggcgcgcggcctcggcgtcgtaccaccacacgatccaggcggtgccgcgcgagacgaccggcccgcgcgcggcggcgcgcgagcgccgcaacggccatgtgccggccgtgctgctcacgctagctggcgccgggcccggcgaaggggtcgcccaccggaagctcctgaccaccgacaggaagcagctcagtgagatgctgaagcagtcgccctacttcctctccaccccggtccgtctccaggtccgcgctggcgagcgatccaccgccgtcgtgcactctggcaccgtcctcccaatcaaggtgcatacagatgaatcaacagggaatatattgaacttggtgatggtgcaagcagatgagggaacaatgatcaaggtgaatttgcctgtggtgttcaaaggagaggatgtctgccctggattaaagaaaggtgggtttttgcagaaaataaggaccagcttggtgtatctctgcccagctgagcacatacctccgaaaattgaggtggacctgacaaatcttgacattggagatagagtattaatgaatgacatccccgtccatccatcgctcaagttactgagtagaaacgagacaatgcctgtgtgcaagctcttggcctcaaagccagtggagtaggaaccaatgcgaatgtttagagttgatgatgatgtacctaccttaggtggcacagctgcctaagaatttcattcctctcattttgctagtgaatgaacagggtgaaaaccaatcccatgagtaaccttggctgtaacgtcataaaataatatatcttggctttctcgcttcagtgacat

SEQ ID NO: 990 - DNA, 1224 bp, Zea mays
aattgccatttccaatccctccaggctccagccaaagcccagcacgaccaaaacccagaacctgagaatggcgcagttccttcgcggcaaggccgccgccgccgccggggcggcggtgctgcgcgcgtcgtctccggcgccatggcggcggacggcctccgcgtcgtaccaccacacgatccaggctgtaccgcgggagacagccggcccgcgcgccgcggcacgcgagcgccgccacggccgcgtcccggcggtcctgctcacgctcgcgggcgccgcgccagggaacggaattgcccaccggcacctccttaccgccgacaggaggcagctcgcggagatgctcaagcagtcgccctacttcctctccacccccgtccgcctccaggtccgcgcgggcgagcgatccaacgccatcctccacgccggcaccgtcctccccatcaaggtgcatagagatgaaaattctgggaatatactgaatttggtaatggtgaaggcagatgaaggaacaatgctgaaggtggatttgcctgtagagttcaagggaaaggatgcttgccctgggttgaagaaaggaggctttttgcagaaaataaggaccagcctggtgtatctctgcccagctgagcacatccctccaaaaattgaggtggacctgacaaatcttgatgtcggagatagggtattgatgcatgacattcccgtccatccatcgctcaagttgctgagtaaaaacgagaccatgcccgtctgcaagatcttggcctcaaagccagacgagtaggaggcgctgcaaatacttcagagctgataacattgtacctttaggtggtacagccctccagcagctccgtccctagttcttggcttgctttttggtcatctgccccctaggtttcaatgtgatagtggattcagacaagctatgggcttcaagtaaagatacgaaggaacaaaatgaagaaatatcactggagagacattgtctgtaccaaccgctatagaataacatcctttctcattcagtttgggttcagggacacatgacatgtaagacgactatcctttgctgtggcctgggtgaattcattctctaagctactcttgcagcggctcacaattcatcgtcctgactgcatgcattgtactgtcatgattctacgtattgaatgttgtattcatgcaaacgatccggtagatgagtgttgccctgtacgggca

SEQ ID NO: 991 - DNA, 983 bp, Zea mays
ccctaaacccagaacccgaagaatggcgcagtgtctccggggcaagggcggcgccgccgccgtcggggaggcgctccgcaaggcggccccgtggcagcgggcggcctcggcgtcgtaccaccacacgatccaggcggtgccgcgggagacggccggcccgcgcgcggcggcgcgcgagcgccgcaacggcaacgttccggccgtgctgctcaccctggccggcgccgggcccggagaaggggtcgcccaccggaagctcctcaccaccgacaagaagcagctcgcggagatgctgaagcagtcgccgtacttcctctccaccccggtccgcctccaggtccgcgccggcgagcggtccaccgccgtcgtgcactcgggcaccgtactcccaatcaaggtgcagacagatgaatccacagggaatatattgaacttggtgatggtggaagcagatgaaggaacaatgctgaaggtgaatttgcccgtagtgttcaaaggggaggatgtctgccctgggttaaagaaaggtggcttcttgcagaaaatcaggaccagcttggtgtatctctgcccggcggagcacatccctccaaaaatcgaggtggacctgacaaatgttgacattggggatagagtgttaatgcaggacatccctgtccatccatcgctcaagttactgagtaaaaacgagacgatgcccgtctgcaaggtcctgtcctccaagccagccgagtaggaaccccgtgcgaccacctagagctggagacacctgcctaccataggtggtacgtcggcctaagaatttaatccctctatgtgcttgcttttggtatctacttgctaggctccattttgctcatagtagattcaaacaagtttattgtgttcaagatacgcgcgaagaggctgaaaaacagtccccatgatcaataggggctgtaatttgatgaaataatatctctgcttttaaaagggtcagcgac

SEQ ID NO: 992 - DNA, 947 bp, Pseudoroegneria spicata
acccagaacccgaagaatggcgcagtgtctccggggcaagggcggcgccgccgccgtcggggaggcgctccgcaaggcggccccgtggcggcgggcggcctcggcgtcgtaccaccacacgatccaggcggtgccgcgtgagacggccggcccgcgcgcggcggcgcgcgagcgccgcaacggcaacgtcccggccgtgctgctctccctcgccggctccggacccggagaaggggtcgcccaccggaagctcctcaccaccgacaagaagcagctcgcggagatgctgaagcagtcgccgtacttcctctccaccccggtccgcctccaggtccgcgccggcgagcgatccaccgccgtcgtgcactctggcaccgtacttccaatcaaggtgcagacagaggaatcaacagggaatatattgaacttggtgatggtggaagcagatgaaggaacaatgctgaaggtgaatttgcccgtagtgttcaagggggaggatgtctgccctgggttaaagaaaggtggcttcttgcagaaaatcaggaccagcttggtgtatctctgcccggccgagcacatccctccaaaaatcgaggtggacctgacaaatgttgacattggggatagagtgttaatgcaggacatccctgtccatccgtcgctcaaattactgagtaaaaacgagacgatgcccgtctgcaaggtcctgtcctccaagccagccgagtaggaaccccgtgcgaccatctagagttggagacacctacctaccaaaggtggtacgtcggcctaagaatttattccccctgtgcttgctaggctccagtttgctgatagtagattcaaacaagtttattgtgttcaagatatgcgtgaacaggccgaagaagagtcccaaacgatcaatctcggctgtaatgtcgtgaaataatatctttgttttctca

SEQ ID NO: 993 - DNA, 1053 bp, Oryza sativa
ccaagcccaactctcttcgtccccctaaacccccacacatggcgctttgcctccgccgcgccgccgccgccgccgtcggagaggcgctccgccgcggcgcttcgacggcgccgtggaggcgggcggcctcggcgtcgtaccaccacacgatccaggcgttgccgcgggagacggccggcccgcgcgcggcggcgcgggagcgccgcagcggccgcgtcccggccgtgctactcgccctcgccggcgccggccccggggagggggtggcccaccggaagctcctcaccgccgacaggaagcagctcggggagattctgaagcagtccccctacttcctctccacccccgtccgcctccaggtccgcgccggcgagcgatccaccgccgtcgtgcactccggcactgtcctccctatcaaggtgcatagagacgaaacaacaggaaatatattgaacttggtgctggtggaggcagatgaaggaacaatgctgaaggtgaacttgcctgtagagttcaagggggaggacgtctgccctgggttgaagaaagaaaataaggaccagcttggtgtatctctgccctgctgagcacatccctccaaaaattgaggtggacctggcaaatcttgacattggagatagggtatcaatgaatgacatccccgtccatccgtcgttgaggttactgagtaaaaacgagaccatgcctgtctgcaagatcttggcctcgaaaccagttgagtagaggaatccatgcaaatttttggagcttggtgacaatgtacccgagttggtacagcagcccagtaacttcatctccctatgtgcttgcatttggtagctgtttgccaagtcccaatgtggtaataggttcaaacaagttatcatgttcaggaccaatcttggctgtaatgtcacaaaataacaccagctttctcagtttaacatacacaagacattttgtcgattcttggttgtggcctgggtgtattgacacgccgagctgataatgtcgaactttaaacataccatgccccattcttattgttaacca

SEQ ID NO: 994 - DNA, 1153 bp, Sorghum bicolor
cgtaaacccagaacctgaggaagtgagaatggcgcagtttctccgcggcaaggccaccgccgccgccgccgccaccgccgccagggaggcggcgccgtggcggcggacggcctcggcgtcgtaccaccacacgatccaggctgtaccgcgggagacggccggcccgcgcgccgcggcgcgcgagcgccgccacggccgcgtcccggcggtcctgctcacgctcgcgggcgccgcgcccgggaacggaatcgcccaccggcagctcctcaccgccgacaggaggcagctcgcggagatgctcaagcagtcgccctacttcctctccacccccgtccgcctccaggtccgcgccggcgagcgatccaacgccatcgtccacgccggtaccgtcctccccatcaaggtgcatagagatgaaacttctgggaatatattgaacttagtaatggtgaaggcagatgaaggaacaatgctgaaggtggatttacctgtagagttcaagggggaggatacttgccctgggttgaagaaaggaggctttttgcagaaaataaggaccagcctggtgtatctctgcccagctgagcacatacctccaaaaattgaggtggacctaacaaatcttgatgtcggagatagggtattaatgcatgacattccggtccatccatcgctcaagttgctgagtaaaaacgagaccatgcccatctgcaagatcttggcctcaaagccaattgagccagtcgagtagccagcactgcaaatatttcagagttgataacattgtacctttgggtggtactgccctccagcatctccatctcttggcttgtttttttgttatccgttccctaggtttcaatatgatagtgtattcagacaagctacgagcttcaagtaaagatatatgaaggaacaaaatgaagaacaatcactggagaaaccttgtctgtaccaatcactatagaataacatcctttctcttttgagtgttcgggttcagggacacatgacatgtaagaagacattgtgcactatccttttgctgtgtggcctggccgcctgggtgaattgattctctgggcttggtgttgttttgaaactgtaagctggctactcttgcaatggctcacgattcatcgttctgactgca

SEQ ID NO: 995 - DNA, 1045 bp, Panicum virgatum
acccagaacccgacaatggcgcagtgtctccgcggcagggccgccgccgccgccgggatgccggcgccgtggcggcgggcggcctcggcgtcgtaccaccacacgatccaggccgtgccgcgggagacgtcggggccgcgcgccgcggcgcgggagcgccgccacggccgcgtccccgcggtcctgctcgcgctcgcgggcgccgcgcccgggaacggggtcgcgcaccggaagctcctcaccgccgacaggaggcaggtcgcggagatgctaaagcagtcaccctacttcctctccacccccgtccgcctccaggtccgcgcgggcgagcggtccaacgccgtcgtgcactccggcaccgtgctccctatcaagatgcatagagatgaaacaaccgggaatatattgaacttggtaatggtgcaggcagacgagggaacaatgttgaaggtgaatttgcctgttgagttcaagggggaggctgcttgccctggtttgaagaaaggaggctttttgcagaaaataaggaccagcctggtgtatctctgcccggctgagcacatccctccaaaaattgaggtggacctgacatatctcgatgtcggagatagggtattaatgcatgacattcccgtccatccatcgctcaagttgctgagtaaaaatgagacgatgccggtatgcaagatcttggcctcaaagccagtcgagtcggaaacaatgcatgatctcaagagttgataacattatacctgatgtggtacaaccatccagcagttccacctcttgctctcagcttgccctttttgttacttgtttgctctatttcaatgtggtagtagattgaaacgagttatcatcttcaaaatacaaatgaatgagccaagcacagaacaatcacaagagaaaccttgtgtgcatcgatgactgcaaaataacatcctttatctgagttccgagttcagggacatatacatgtagacattctggattgttgtttgctgtggcttggttgaattgaggacctgtgcatgatgtttctttg

SEQ ID NO: 996 - DNA, 951 bp, Triticum aestivum
  misc_feature (318)..(318): n is a, c, g, or t
tcggcacgaggcagaacccaaagaatggcgcagtgtctccggggcaagggcggcgccgccgccgtcggggaggcgctccgcaaggcggccccgtggcggcgggaggcctcggcgtcctaccaccacacgatccaggcggtgccgcgggagacggccggaccccgcgcggcggcgcgcgagcgtcgcaacggcaatgtcccggccgtgctgctcaccctggccggcgccggacccggagaaggggtcgcccaccggaagctcctcaccaccgacaagaagcagctcgcggagatgctgaagcagtcgccgtacttcctntccaccccggtccgcctccaggtccgcgccggcgagcggtccaccgccgtcgtgcactcgggcaccgtactcccaatcaaggtgcagacagatgaatccacagggaatatattgaacttggtgatggtggaagcagatgaaggaacaatgctgaaggtgaatttgcccgtagtgttcaaaggggaggatgtctgccctgggttaaagaaaggtggcttcttgcagaaaatcaggaccagcttggtgtatctctgcccggccgagcacatccctccaaaaatcgaggtggacctgacaaatgttgacattggggatagagtgttaatgcaagatatccatgtccatccatcgctcaagttactgagtaaaaacgagacgatgcccgtctgcaaggtcctgtcctccaagccagccgagtaggaaggccgtgcagccgtctagagctggagacacctacctaccataggtggtacgtcggcctaagaatttaatccctctgtgtgcttgcttttggtatctacttgctaggctccattttgctcatagtagattcaaacaagtttattgtgttcaagatacgatcaatctttgctgtaatgtcaagaaataatatcttggttttcaaaaaaaaaa

SEQ ID NO: 997 - DNA, 560 bp, arabidopsis lyrata
ctatagcaaaattatactaataacaagagaaatggagggtctaattccgttagtatacaaagccgtcatgcaaatccgttacggtaacgagtcgcagcaactttcttcatcttactacgttcgtcttccgggcgattcgggtcggttcggaagatccgatttcgatgtatcgggtctcggatcttcttccaatacggcgtcatcgtcgacgaccactactacgtttgctgtttacacgggagtccaatcacccgtttctcgtcaggttgtcacgtgattcacacgcgcttcacaaggaacctgaagatgcgtgtgagggaagggttcgtgacttttgttttgtgtgtttagtttttctttatgcgttaggcttggaccggtttaataaacctgatgtaataattcggtttgggagattgattttctctaagcgtaggctttcgcccaaaagggtggtctcgtggcatttgatttgtgtgtttctgttaattgtataaaatttatataaatatttagtttactctgaacaattatgtgaaatgattgttaattttcttcat

SEQ ID NO: 998 - DNA, 1968 bp, arabidopsis lyrata
caagctaaagcaatgagattcatgaatcgtcttagaaatcggagcatcgaccacgttgttcccaatcgccgtaccgagtcggctcaggacctctaggtcctccgatctcaccagtatctttgttcacaaactctccacctccttctccttcttcttccccttcttcttccttctgcagattctgttgaagattctgatctggcttcacgttctggttcagatcctgattcggagacggggatggagcctgcggcggaggaggagtaccggagcttaaaaaccgtgacactggctggagcaatctagaggaggcggatccgcttggtgcgatcaaacggacgatgttgttcgtcgccattgttagatgtgtcggcctaatcagaagaacaaccttcgcaatttgtgagatagtatagggttcgttagtcgttttggttgagccataatttgacaacaagcccagtaggatctaggcccaacatttgacatgtttataaaaaaaataagagaattagagagtaaatttggcccagtataattatgtttaacaagcccatcaggagctaggcctaacatgtttataaaacaaataggagagaattagagggtaaagttgacgtgggctgatttcgaacccgtaacctttttatatattagacctcattaccaaaaagcgattcgattatctcataatgggtctgttgcttttgtgccacatcaacggttgtgagtggttggttggtcactaaagaaaagtcacaagctgttattatagtattggatattcgctatttatttcgtctaccacgagaaaaacaagtcgtaattcttctatcttgatatcttcaccgccttcgccgatctctcaatctccgatcaaccatgagcaacggtccaggactcttcaccgatatcggcaagaaagccaaagatctgttgacgagagactacaattctgatcagaagttcagtatctccacttacagtgcctccggcgtggcccttacgtctactgctctgaagaaaggaggagttcatgctgctgatgttgccacccaatacaagtacaagaatgctttgtttgatgtcaaaattgacactgattctagtgttttgacaacagtcacactcaccgagatcctcccatcaacaaaagccattgcctccttcaaagtccccgattacaattccgcgaagcttgaggtccaatacttccacgaccatgcaacagttaccgctgctgcagctttgaaacaaaacccgctaattgacataacagctacccttggttcgccagtcatctcatttggtgctgaagccggatatgacacaacctccaaaactttcaccaagtacaatgctgggatcagtgtgacaaaacctgacgcttgcctttccataatattgggagacaaaggagactcactcaaagcatcgtaccttcatcactttgatgaatttaagagaaccgcagcagttggtgaggtttacaggaaattctcgacaaatgaaaacacgataacggttggtggattgtatgcaattgatcattcgacttcagtgaaagctaagctgaacaaccatggcacacttggtgctcttctccagcacgaggtcctgcccagatcactagtgactgtttccagtgagattgacaccaaggctttagaaaagcatccaaggtttggtctctctcttgctctcaaaccttgagaacacacacacacacactcacatcagacctgcttgagtgttccttcttttctcgtatgctctcattgttgatttcttctacggctggacccgagagtttgcgttttttccccctttttttcttcacgtttagttggaatcaataaatagttccgcagtgaaattgacggataattcttttttggatatgttttggttttttgacctttctttttttattaagcaccattcttgaatacactcaattgatttttt

SEQ ID NO: 999 - DNA, 639 bp, Brassica napus
gtcgatatcactcgacacaaataacaaacaatggcgacgaacaaaatcgtccgtctgatcgcaccaagccgatccgcctcctctagattcctggagcctgtatcacgctttctaagctccggcactcctcctccgcagcccccgcagtcaccatcaccatctccgaatgaggatcaggttgtgaagccagatcagaaacttcaagagaatctgcagatgcccaaggaagaggaagatgaagaagaaggaggaggtggagagtttttcaacaaagataccggtgagatcggagggcctagaggtcctgagccgacacggtacggcgattgggaacaacgtggtcgatgctccgacttctgattgacacgtgatgatcccaagtaaatctcggtcctcgttcatcatttttattcacttttataagtttttatgtattcgcaaataatggagaacattaaggagaaaaattaaggacaagttggaactatgatttgtctggattccttgtgtgcttatgaaatgtttagttatttgaatacataaagtgactttgcttatgttgtaaaattttgattttattagcttgaatcaagaactgtgtcagaagataaaagatgagaagagtactctattataaag

SEQ ID NO: 1000 - DNA, 640 bp, Brassica napus
gatatcagtcgatacaaagtaacaaacaatggcgacgaacaaaatcgtccgtctgatcgcaccaagccgatccgcctcctctagattcatggagcctgtatcacgctttctaagctccggtactcctccgccgcagtcaccatcaccgtctccgaatgaggatcaggttgtgaagccagatcagaagcttcaagagaatctgcagatgcccaaggaagaggaagatgaagaagaaggaggaggaggaggaggtggagagtttttcaacaaagatacgggtgagatcggagggcctagaggtcctgagccgactcgttacggcgattgggaacaacgtggtcgatgctccgacttctgattgagacgtgatgatcccaagtaaatctcggtccttgttcatcattttgattccacaggaattaaattcactttctataagttgtttatgtattcgcaaataatggaagaacacagaagaaaaattaaggagaagctggaactatgatttgtctggattccttgtgttgcttatgttgaatgtttagttatttgaatacataaagtgaatttccttgtgtgcttatgttgtaaaatttcgattttggatcatttcgaaaaaaaatgtaaattaggttgggtt

SEQ ID NO: 1001 - DNA, 527 bp, Raphanus sativus
gagtcgagacagtttaacaatggcgacaaacaaaatcgtccgtctgatcgcaccgagccgatccgcctcctctcgattcctggagcctgtatcccgatttttaagctccggtactcctcctcctccgccgcagtcaccatccccgtctccgaatcgggatcaggttgtgaagccagatcagaaacttcaagagaagcgcaaggaagaggaagaggaggaagaataaggaggaggtggagagtttgttaacgaagatacgggtgagataggagggcctagaggtcctgagcccactcggtacggcgattgggaacaacgtggtcgatgctccgacttttaagacgtgatcccaagtaaacctggctaccttattagagtctccttgttcatcattttgattccaaaggaaataagttcactttttataagttttttttttatgtattcgcaaataattgagacagttggaattgtgtatgtctggattcgttctgttgcttatgaatgttttagctatttgattacgt

SEQ ID NO: 1002 - DNA, 521 bp, Raphanus sativus
  misc_feature (102)..(102): n is a, c, g, or t
ggggagtcgagacaatttaacaatggcgacaaacaaaatcgtccgtctgatcgcaccgagccgatccgcctcctctcgattcctggagcctgtatcccgatntctaagctccggtactcctcctcctccgccgcagtcaccatccccgtctccgaatcaggatcaggttgtgaagccagatcagaaacttcaagagaataccaaggaagaggaagaggaagaggaagaagaaggaggaggtggagagtttgttaacgaagatacgggtgagataggaggtcctagaggtcctgagcccactcggtacggcgattgggaacaacgtggtcgatgctccgacttctaagacgtgatcccaagtaattctggctaccttttccaaggaaagaaattcacttttttataagtttttatgtattcgcaaataatggagacagttggaattgtgatatgtcttggattcgttgtgttgattatgaatgttttagctatttgattacgtgaagttttattttgtaaga

SEQ ID NO: 1003 - DNA, 1029 bp, Brachypodium distachyon
gactactactcctcccgtcgtgctctgctcctcctccgttccgcgccggccgcctctaaaccctaaccctagggtcagggggttccgagagagagagagggtttggagctacggcggcggcggccatggcggcaaggaaggagctctcgagcactctcaggaacctcaagtttatgcagcgcgcggcggtcgcgcagaagatcgaggacaaaaccgaggtggatgttgaggtggaggcggaggtgctgacgccggcggcgaacggagggtttggctcatcggctcgagtcgccaggaagtgtgtagttgtcatggagggtaatccacacccaggagctgtgaagggtcgaatgtcattccaaaatttcaatccatctattgataaactaaatgaagaggcaagtggacaccaaacgcaatcagcttcacctagtaattctcaagaagacggtgcaaatcccagcagaacagatgatgtatcagcatcaagatttagaggcttcaatgtcgatagttcagaaagcatatctctgaatgaccttaagagaaaagagcccgagcttgagatggaaacaccacgatctcaaaagctgcccaagaccactggccagaatgtcgatggtgaatcgtcttcccaaagcaatggccgtgggtcccgcaagtcgaacaaacacgagaagcttgattggaatcttctcagacgtcggaagtcaaaatgagcttcaagttagcgttagccaagactcgctcctgtactccatcttgtactctgtatctgaccagcttttgtgcgctgtctcctaaattattatctacagtagcaggtagcctggttaatcctgcagtgctatagctgttgttaacttcatgagaagcgtagtgccgcatagcatattttagttggggagattctatgttggacaatttctctctcggttttgatgttggtttacacctttactttgctgtaagatgtaagactctgtaacacagccgtgtgtattacagttttgggaatgtgtttctggt

SEQ ID NO: 1004 - DNA, 963 bp, Triticum aestivum
  misc_feature (363)..(364): n is a, c, g, or t
  misc_feature (513)..(513): n is a, c, g, or t
  misc_feature (676)..(676): n is a, c, g, or t
  misc_feature (699)..(699): n is a, c, g, or t
  misc_feature (720)..(720): n is a, c, g, or t
  misc_feature (753)..(753): n is a, c, g, or t
  misc_feature (786)..(786): n is a, c, g, or t
  misc_feature (810)..(810): n is a, c, g, or t
  misc_feature (855)..(855): n is a, c, g, or t
  misc_feature (873)..(873): n is a, c, g, or t
  misc_feature (876)..(876): n is a, c, g, or t
aaaccctaaccctagattggattacggggggctgggagagggagagggtcggagcggcggcggcggcgagatgtcggcgaagaaggggctctcgagcacgctgcggaacctcaagtttatgcagcgggcggcggtggcgcagaagattgaggacaaggccgatgtggaggtggaggagccggcggccgaggtggtgatgacgccggcggccaacggtggaggggtcggctcgtcggtccaggtcgccaggaagtgtgtagttgtcatggagggtaatccgcttccaggagctgtaaagggtcgaatgtcattccaaaatttcaatccatccattgataaactaaatgacgaggcaagtggtcnnccaacacaatcagcttcacctagtaattctcaacaagacagtgcaaataccagcagagtggatgatatatcagcatcaagatttagaagcttcaatgttgatagttcagaaagcatatctctgaatgagttgaagagaaaagagcctgngctggagatggaaacaccaccatcgcgtaagctgccaaagacgactggccagaacgtggatggccagccgtcttcgcagagcaatggtcgtgggtctggcaagtcgaacaagcatgaaaagcttgactttaatcttctcagaaaacggaaatcaaaatgaggnccaggttagcattagccaagacnagctctgtgtactccatatgncaccatttgtactctgtatctgatcagccttgngcgttgttcactgaattatttctgtagtagcangtagccaggttaaacctgcagtgntatatctgttattaacttgagaagcctactgggtaacatggtatnttacattgggcgcttttnttntgtttttgatggtgctgtactccattatcacttgtaagatgtaagattttacagcagctgtgagaatttaaagttttggggtaaaac

SEQ ID NO: 1005 - DNA, 1072 bp, Triticum aestivum
  misc_feature (18)..(18): n is a, c, g, or t
ttcggcacgaggctgttntccggtgttcctcccgcgagacgagacggccgcctctaaaccctaaccctagattggattatcggggctgcgagagggagagggtcggagcggcggcggcggcgagatgtcggcgaagaaggggctctcgagcacgctgcggaacctcaagtttatgcagcgggcggcggtggcgcagaagattgaggacaaggccgatgtggaggtggaggaggcggcggccgaggtggtgatgacgccggcggccaacggagggggtgtcggctcgtcggtccaggtcgccaggaagtgtgtagttgtcatggagggtaatccgcttccaggagctgtaaagggtcgaatgtcattccaaaatttcaatccatccattgataaactaaatgacgaggcaagtggtcgcccaacacaatcagcttcacctagtaattctcaacaagacagtgcaaataccagcagagtggatgatatatcagcatcaagatttagaagcttcaatgttgatagttcagaaagcatatctctgaacgagttgaagagaaaagagcctgagctggagatggaaacaccaccatcgcgcaagctcccaaagacggccggccagagcgtggacggccagccgtcttcgcagagcaatggtcgtgggtctggcaagtcgaacaagcatgaaaagcttgacttcaatcttctcagaaaacggaaatcaaaatgaggtccgggttagcatcagccaaggctagctccgtgtactcttgtgtcgccatttctaccctgtacctgatcagcctttgtgcgttgttccctgaattatttatgccgtagcaggtagccaggtaaaaccggcagtggtatatctgttgttaacttagttggaaggtttactactgctttacatatcttattagttggggaggttctgtgttcttcaacacttttctctcttgtttcactgcattgctattacttcctgtaagatgtagtaagattctgcaacaccagcgagaatttcaaagtcataggaatgctttttgatcaggcgtgctcattaaaaaaaaaa

SEQ ID NO: 1006 - DNA, 620 bp, Secale cereale
gtaaaccacacacacacacagacacgaacgcattttcattgctgaagctagcagcgcgcgcaccgagccgccggcgacgacgacgatggcggcgaccgaggcccagctgctgcagccgcgcgccctggcggccctcctcgtcgtgctggtgctgatcacgctgggcggcgcggccgaggcgcagcagggcacctgcggcgcgcagctgagccagctggccccgtgcgcgcggtacagcgtgccgccgctgcctgggcaggcgctcccgacgcccgggccggagtgctgctccgcgctggggtccgtgtcccgcgactgcgcctgcggcgccatcgacatcatcaacagcctccccgccaagtgcggcctcccgcgcgtctcctgccagtgatcgctacctggctccatgcaagaagaggaagaactgaagaagacgatgatgaataagagctcgctcgatggtcggagcaaccatcttgagtagtcgtagtgcatagtagctgtccggttcgtctggactctagatcgaaatcctgtgatcattagaggctcttatgtctgttctctggtgaacgtcaccagattaataataatggaaccaatttgcactttaaaaaaaa

SEQ ID NO: 1007 - DNA, 516 bp, Triticum aestivum
agctagcagcgcgcgcaccgagccggcgactacgacgacgatggcggtgaccacggcccagctgccgcagccgcgcgccctggcggccctcctcgtcctggtgctgctcatcacgctgggcggcgcggcggaggcgcagccgccgctcggcacctgcggcgcgcagctgagccagctggccccgtgcgcgcggtacagcgtgccgccgctgccggggcaggcgctcccgacgcccgggccggagtgctgctccgcgctgggctccgtgtcccgcgactgcgcctgcggcgccatcgacatcatcaacagcctccccgccaagtgcggcctcccgcgcgtctcctgccagtgatcgctcgctgcctggctccatgcaagaagaggaggaactgaagaagacgacgatgaataagagatcgatggtcggagcaaccatcttgagtagtagtagcagtgcctagtagctgtcctgtccgtctagatcgatcccctgtgatcattacaggctctcgtgtc

SEQ ID NO: 1008 - DNA, 637 bp, Triticum aestivum
  misc_feature (14)..(14): n is a, c, g, or t
ccacgcgtccgcgncgcaaatcacacacacacacgaacgcattttcattcatttctcaagccagcagcagcgcgcgcaccgagccggcgacgacgatgatggcggtgaccacggcccagctgccgcaaccgcgcgccctggcggccctcctcgtcctggtgctgatcacgctgggcggcgcggccgaggcacagccgccgctcggcacctgcggcgcgcagctgagccagctggccccgtgcgcgcgctacagcgtgccgccgctgccggggcaggcgctcccggcgcccgggccggagtgctgctccgcgctggggtccgtgtcccgcgactgcgcctgcggcgccatcgacatcatcaacagcctccccgccaagtgcggcctcccgcgcgtctcctgccagtgatcgctcgctacctggctccatgcaagaagaggaagaactgaagaagacgatgatgaataagaagctcgatggccagagcaaccatctttagtagtagtagcagtgcctagtagctgtccggttcgtctagatctatctcccgtgatcattacaggctctcgtgtccgttgttggcctctgttgaaggtcagattaataataatggaaccaatttgcaccggcggtcaaaa

SEQ ID NO: 1009 - DNA, 810 bp, Triticum aestivum
gctgtcctttgtctctcttcttcagaggcttgaggatggtttgccttgtgcattgcactgcatagggctgtaaaacttggaaggtttctgaggcaagcagcagcagcagctatggagcctgccagtgctagcttggtctccctgagggcatccaccgccacgagccgcagctgtttctcatgtcagcagcgagcgacgcccaggaccaggatgcttccggccatggcgtccaagtctggggcgaaactggtggcttcaggctgcaagacatgcagggggaagggtgcagtggaatgcgaaggctgcaaggggactggcaggaacaagaagaacggcaacatctttgagagatggaagtgcttcgactgccaggggtttgggatgaggaagtgccccacctgcggcaagggaggcctcacgccggagcagagaggagaacgatagaagaaacatcaagcatccatccatccatggcagatgcactctccaatgtcttatttatcatgctcaactttgctcgaattctgacaactatctagaagtaagtatcaaccagaattgccaaacaaaatgaaaaccgaatatggtgatacacatatttggtctgagaaccagcagtataatgccaagcagaatgttgtgaggaaatcaactggtttctgcgcgtattgactggtctggaggcttttgaatctatatgttgtaagtattttttttgttcttttgaatatattcagtttgtcgtaagtattatttaaaaaactaagtgcctctcttgggcgatgggtggcactcatctgaaaaaaaaaa

SEQ ID NO: 1010 - DNA, 756 bp, Triticum aestivum
ctttgtctctcttcttcagaggcttgaggatggtttgccttgtgcattaccctgcatagggctgtaaacttggaaggcttctgagcaagcagcagcagcagcagcagccatggagcctgctagtgctagcttggtctccctgagggcatccgccgccacgagccacagctgcttctcgtgtcggcagcgagcgacgcccaagaccaggatgcttccggccatggcgtccaagtccggggcgaaactggtggcttcaggctgcaagacatgcagggggaagggtgcagtggaatgcgaaggctgcaaggggactggcaggaacaagaagaacggcaacatcttcgagagatggaagtgcttcgactgccaggggtttgggatgaggaagtgccccacctgcggcaagggaggcctcacgccggagcagagaggagaaagatagaagaagcataagcatccatccatccatggcagctgcaggcagatgcactctccaatgtcatatttatcatgctcaactttgctcgaattctgactactatctagaagtaagtatcaaccagaatcgccaaataaaatgtcgaaaaccgaatatggtggtacacataatcggtttgagaaccggcagtataatgccaagcagaatgttgtgaggaaatcaaactggtttctgcgcgtattgacttgcttggatgcttttgaatctgtatgctgtaagtatttttttattttttgaatatattcagtttgtcgtaa

SEQ ID NO: 1011 - DNA, 650 bp, Triticum aestivum
aaaacttggaaggtttctgaggcaagcagcagcagcagccatggagcccgccagtgctagcttggtctccctgagggcatccaccgccacgagccgcagctgcttctcatgtcggcagcgagcgacgcccaggaccaggatgcttccggccatggcgtccaagtctggggcgaaactggtggcttcaggctgcaagacatgcagggggaagggtgcagtggaatgcgaaggctgcaaggggactggcaggaacaagaagaatggcaacatcttcgagagatggaagtgcttcgactgccaggggtttgggatgaggaagtgccccacctgcggcaagggaggcctcacgccggagcagagaggagaaagatagaagaaacagccaagcatccatccatccatggcagctgcaggcagatgcactctccaatgtcatatttatcatgctcaactttgctcgaattctgactactatctagaagtaagtatcaaccagaatcgccaaacaaaatgtcgaaaaccgaatatggtgctacacataatcggtttgagaaccagcagtatgctgccaaacagaatgttgtgaggaaatcaactggtttctgcgctattgactagtttggatgcttttgaatctatatgttgtaagt

SEQ ID NO: 1012 - DNA, 647 bp, Triticum aestivum
ggtttgccttgtgcattgcactgcatagggctgtaaaacttggaaggtttctgaggcaagcagcagcagcagccatggagcctgccggtgctagcttggtctccctgagggcatccaccgccacgagccgcagctgcttctcatgtcgacagcaagggacgcccaagaccaggatgcttccggccatggcgtccaagtccggggcgaaactggtggcttcaggctgcaagacatgcagggggaagggtgcagtggaatgcgaaggctgcaaggggacaggcaggaacaagaagaacggcaacatcttcgagagatggaagtgcttcgactgccaggggtttgggatgaggaagtgccccacctgcggcaagggaggcctcacgccggagcagagaggagaaagatagaagaaacagccaagcatccatccatccatggcagatgcactctccagtgtcatatttatcatgctcaactttgatcgaactctgactactatctagaagtaagtatcacccagaatcgccaagcaaaatgtcgaaaaccgaatatggtgatacacataattggtttgagaactggcagtataatgccaagcagaatgttgtgaggaaatcaactggtttctgcgcgtattgactggtttg

SEQ ID NO: 1013 - DNA, 645 bp, Triticum aestivum
agcagcagcagcagccatggagcctgccagtgctagcttggtctccctgagggcatccgccgccacgaaccacagctgcttctcatgttggcagggagcgacaccaaagaccaggatgcttccggccatggcatccaggtctggggcgaaactggtggcttcaggctgcaagacatgcagggggaagggtgcagtggaatgcgaaggctgcaaggggactggcaggaacaagaagaacggcaacatcttcgagagatggaagtgcttcgactgccaggggtttgggatgaggaagtgccccacctgcggcaagggaggcctcacgccggagcagagaggagaaagataaaagaggcatcaagcatccagctgcaggcagatgcactctccaatgtcatatttatcatgctcaactttgctcgaattctgactactatctagaagtaagtatcaaccagaatcgccaaataaaatgtcgaaaaccgaatatggtggtacacataatcggtttgagaaccggcagtataatgccaagcagaatgttgtgaggaaatcaaactggtttccgtgcgtattgactggtttggatgcttttgaatctgtatgctgtaagtattttttttgaatatattcagtttgtcgtaa

SEQ ID NO: 1014 - DNA, 1372 bp, Brachypodium distachyon
gatggtttgccgatgcccggagcttgttgacttgtctggtcccccggcgccgcgagcgaatcgatccggctacggattgttccccactccctcgcctatccgcccgacgcatcacgccggctggccggccggcgggcagggcgaccccgatgagctctcccccgcagtcgcgtcaggctcccacttaccagttgttgcttctcctgctgctcttcttctcgccaatcgcatcggctggacaaccaaaaggtgtatgtgtttcacctggtgggcggttccctgctttctcatctgaaggcaagcctccaggaagagcagcaaaggggcgcagagatctagcactatgtaggctattccgtcagaacacatgttgcgatgtgacacagacatttcctgccctgctttcagtgagaaagctctcctcaactggcgaaggcagcggagaatgccttcatttatgggaattgctcgagtgctcagtatgtgatccgtgggtgggtgtcaggcctggacctcctgttatatgtgcatcattctgtgacatggtttttgaagcttgttcagaggcatacttctctgttgatacgaaaacacaggccttatctccctgtggtttgggtgacatcctttgtggcaaagcacataaatgggtttctaatggcacagaactatgtcgccttgctggtttcgctgtgcaagtatctgaggccagccctactgaagttgatgaaactttctgctatggtgggaaagcaagtttggattccatctctgatacatggacgtcttcgaaagaccgcccaacattacgtggtgtgacctcttgggatcttgaagattttcagagatgggcgacacaaatgcctgtaggtgaaagaatttcgtgggcaattggaggaatggttcttacagcaggcctttttatcagcaaaagagagggctacagccgtcgtcggaaacaagcttctgtcgctgagactgtgagaagaagatggaatcaggagctaacctgcagccagctgaagcgaagctaggaagacacatgtagcattactaatagataatctcttggatttgtacttctgcgctctgtggttaattctgatcaactatgaaaaggatagattgtagaccatgccctctattctcgaaggatagattgtagatcatgctctctattcttgttcttaatacacgcagtcaatggtacagccttttgccatcattgtgtgagttgagattcgtttggaatgcaatctctagttttgctcgagttgtatatactactatagaatatttgggaaagatttcttcagaggttattctgcggtcactttctcctgccattaatatctgattggtatgattgctg

SEQ ID NO: 1015 - DNA, 1322 bp, Triticum aestivum
  misc_feature (12)..(12): n is a, c, g, or t
  misc_feature (80)..(80): n is a, c, g, or t
  misc_feature (141)..(141): n is a, c, g, or t
  misc_feature (154)..(154): n is a, c, g, or t
  misc_feature (177)..(177): n is a, c, g, or t
  misc_feature (206)..(206): n is a, c, g, or t
  misc_feature (224)..(224): n is a, c, g, or t
  misc_feature (231)..(231): n is a, c, g, or t
  misc_feature (739)..(739): n is a, c, g, or t
  misc_feature (779)..(779): n is a, c, g, or t
  misc_feature (830)..(830): n is a, c, g, or t
  misc_feature (834)..(834): n is a, c, g, or t
  misc_feature (858)..(858): n is a, c, g, or t
  misc_feature (1184)..(1184): n is a, c, g, or t
  misc_feature (1232)..(1232): n is a, c, g, or t
  misc_feature (1249)..(1249): n is a, c, g, or t
  misc_feature (1262)..(1262): n is a, c, g, or t
  misc_feature (1265)..(1265): n is a, c, g, or t
  misc_feature (1271)..(1271): n is a, c, g, or t
  misc_feature (1274)..(1274): n is a, c, g, or t
  misc_feature (1285)..(1285): n is a, c, g, or t
cggatcgatccnaccacgaattgattcccctccctggtcgcctatccgctcgacggatcacgccggctggccgcccgccngcccgccgccgcgagaccctgccggtgggcaggttgactccgatgagccctcctccgccgncgcgtccgactcncacttacatcctcctcctgctgntcttcttctcgctaaccgcgtcggctgcncaaccaaaaggggtagtntttcacntggtggacggtccctgctttctcatctgaaggcaagcctcctggaaaagcagcaaaggggcgcagagacctagcactatgtaggatattccgccagaacacatgttgtgacgtgacacagacatttcctgccctgctttcagtgcgaaagctctcgtcaactggtgaaggcagtggagaatgccttcatttgtgggagttgctcgagtgctcagtctgtgatccacgggtgggtgtcaggcctggacctcctgttatatgtgcatcattctgtgacatggttttcgaagcttgttcggaggcatacttctccattgatacaaaaacacaggccttatctccttgtggtttaggtgacatcctttgtggcaaagcacataagtgggtttctaacggcacagagctatgtcgccttgctggtttctctgtgcaagtttctgatgccagtcctagtgaagttgtcgaaaccttctgctatggcgggaaagcaagtttggattccatctctnatacatggacgtcttcaaaagatcgtccagtattacatgntatggcctcctgggatcttgaagattttcagagatgggcaaaagaaatgcntgtnggtgaaagaatttcgtgggcagtnggaggaatggttcttacagcaggccttatttttatcagcaaaagagagggctacagccgtcgtcgtaagcaagcttctgtcgctcaaactgtaagaaaaaaatggaatcgggagctaacccgcagcaactgaagcgatgctaggaagacataggcacctgtagcattactaatagatgatctcttggatttgtatttttgccgctctgtggttatattctgatcaactatgaaagattggttgttagactgtgtcctccctatcctggtgcgttggtacaaccaccttttctcaatgttgtgtgaaagaaaagctgaagaggtctntgaattgttgtcgagattctttcttaatgcagttttttactttggctngagtatctgtatatacngtcagagtattcnganatgaantcngcagaggtatncctcaagcgtctttactgacgcttaactattttgtgc

SEQ ID NO: 1016 - DNA, 1484 bp, Triticum aestivum
acgcgtccgaaaaaagacacaacagatcgattgagcggacgcaatagcggcagagaggaaaccctaaggaagaaaccctggtcgattgagcggcgcgccggagatggagctcatcgacagcgggttggcgctgatggagatctccatgggcgagtccagtacaaagacgaggatgaagagcattagagaggcggagcaaaccaatctgaggcgcatcagagagttgcaggagaggatccggaggaggcaggagcaacttgttcgcgatccacagccacctcttcgctacgagtttgagaaggctcctacagatgagcaggaggctgaggactaccgtcaaatgagggagatgtgctttcgccttaatttcggttcaatcgacggggaaacttctcttggtcccatttgctgtacaaccggaaccaacccagcagatgctcttccggagagctgcatgcagatcttctccatcaaagtcactgacctaaacaatgatctcagcttgccactggaggttcatggctttgttgctgccagggactcggtagatcgtaaacgcaactatctcttcagatgcaccagggataactgccaaaccctcactccgaaggatccattcttgcacttaacaggcccctctcgagcggttctgttaattgaccttgttgcgattgaagttcagctaaaagtaaagggcaaaaaggagtctgaagatgaagtgttagctttcaaatgtttttatttccatgaaaggtatcatttagaagatgggatccgttttcgcatccccagcaagcgctgcatgcttgagtttgctttggcagtgctgcctatgtcagttgaggccattgtgggcatccgagttgttgatgggtcatggcctgatcattgtccggggttggttgtttgcagtaccaacagtgtaaaagaagggaaagtggtgctgcttgattttcaaaatggagagttgcctaccaagtcagatggtgtggttgagcttgcaaggcgtgttgtttctgttgattacccagagggaaaacttactgtttctgtggaggcctcgcggggtcgattttctgcacgaggtacagtcgactttgggatgaaagtgccaaggggaagtgctgctcgcacgtgtgatctggttttctgcaaaatgctagttacagttgcttggtcccttgtttcttgctatcgggtttaaaatccaagcttatctgtttggccatccttacccgtggtttgcccagctaagccgtttgaactatttatgtatctatattgtcatgccttggtacctccctacctgttgtacttgattcatcatgtttgctccgatgtggtattacttaggctgctcaggtaatgagcatattagttgttgctactaaactttctcactccgctgtaatgttatatattgtctctggaagtttaagcttattggtaatgttgctgctacattgttatgtagcatcctccag

SEQ ID NO: 1017 - DNA, 1191 bp, Sorghum bicolor
ctcgcgctcgctattgggccccagtccgatcgggtcggtgcctacccactcccgctggccgccgcgcccagggcccaggcgaggcgatgcgcgtcgcggaccacggaaccaagcagaccgaccgagtcaatcaatccggcgagttgtgcgtgtgcggcgcggggtgtgtgtgtgcgcgcgtgaggcatggcgaccacgcgcgaccgtggcgccggcggcggatcggcgtcgagggtcggcgacggggacgtcgacctgggcgagggctgggactggggcgccatcccgcggctcctctcctccgcctgcctcttcctctgctccggagcagaggctgttttggttgctgcgataagactgtaaaacaactgggtgaactgtccagaaacctaatcacccatgaccaaataaccattggagagccatattggagcacaaccaccatcgaggttgaaccagcagatctcaggggtgtttctccaatgagtacatctaactgggcctttgatcagcatggaactggtagcagtcataaccttcctggacttggtaataatggactcatcctgtgggaacagactaggcaggagtggactgaaattagaagtctacggccgaaggtgaagcaggttcgcgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatgggataacatatctgggataacacatagttgttcctcaagagaggggaaaaaagaatgacatagggtgtgtaggcttgagatgaggtggcctgtcatacttgtttttgtcaatggaggcctgttgtacttgcagaataccgagcttgtaatgctagagaagtcctgatactgatagtggctttgttgaatttgtcaaagaaagttgtgagaggttgagttgtgacaaaaagtgcgatttgtatttgattaagaaggctttaacagttaacacgatggcagttgcgtgttggttcgagatggttggattattctaaggagcgaggagtcatgtaagtgtccagttcgtggtgaatgcaacctttgactgatccagttccggactgttaaaattcgttcgttctgtaa

SEQ ID NO: 1018 - DNA, 890 bp, Saccharum officinarum
  misc_feature (172)..(172): n is a, c, g, or t
  misc_feature (772)..(772): n is a, c, g, or t
  misc_feature (789)..(790): n is a, c, g, or t
  misc_feature (803)..(803): n is a, c, g, or t
  misc_feature (812)..(812): n is a, c, g, or t
  misc_feature (830)..(830): n is a, c, g, or t
  misc_feature (835)..(835): n is a, c, g, or t
  misc_feature (837)..(837): n is a, c, g, or t
  misc_feature (853)..(853): n is a, c, g, or t
gcgaccacgcgcgaccgtggcgccggcggcggatcggcgtcgagggtcggcgatggggacgtcgacctgggcgagggctgggactggggcgccatcccgcggctcctctcctccgcctgcctcttcctctgctccggagcagaggctgttttggttgctgcgataagactgnaaagcaactgggtgaactgtccaggaacttaatcacccatgaccaaataaccataggagagccattttggagcacaaccaccatcgaggttgaaccagcagatctcaggggtgtttcttcaatcagtacatctaactgggcctttgaacagcatggaactggtagcagtcataaccttcctggacttgataataatggactcgttctgtgggaacagactaggcaggagtggactgaaattagaagtctacggccgaaggtgaagcaggttcgcgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatcatgggataacatatctgggataacacggttgttcctcaagagaggggaaaaaaagaatgacataggggtgtaggcttgagatgaggtgatgagttggcctgtcatacttgtttttgtcaatggaggcctgttgtacttgcagaatacagagcttgtaatgctagtgaagtcctgntactgatagtggctttnntgaatttgcaaanaaaggtgtntgaggttgagtgtgacanaaagngngatatgtattgttaanaaggctttaacagttaacaagatggctggtgcgggtt

SEQ ID NO: 1019 - DNA, 1027 bp, Panicum virgatum
  misc_feature (794)..(794): n is a, c, g, or t
  misc_feature (886)..(886): n is a, c, g, or t
  misc_feature (939)..(939): n is a, c, g, or t
gtcctctccgccccccaatccgatcgggccggtggctgccccactgcaccgaaccacggaaccaggccgaccgaccgagccaatcgatccggcgagtgaagtgggcgcggcgctgcgcggggcgggcggcatggcgaccacgcgcggcggcggcggatcggcgtcgagggtgggcgacggggacgtcgacctgggcgagggctggaactggggcgccatcccccggctcatctcctccgcctgcctcttcctctgctccggaggctgttttggatgctgtgataaggctgtaaagcaactgggtgaactgtccaggaacttgattacacatgaccaaattcccattggagagacattttggagtacaaccaccatcgaggtcgaaccagcagatctcaggggtatttctccagtcaatgcatccaactgggcctttgatcagcatggaactggaagcagccataaccttcctgaacttggtaataatggactcgttctttgggaacagaccaggcaggagtggactgaaattagaagtctacgaccgaaggtgaagcaggttcgcgaaccagtattgagttggaatgcagcatatgagagtctgcttggatcaaataagccatttccgcaaccaattcctcttcacgagatggtcgattttcttgtggacatctgggagcaagaggggctgtatgactagcacaaatgctttcatagggataacatgtagttgttcctcaagaaaggataaagaatgacataggtttaggcttgagatgaggtaacaatggttnggcctgtcatacatgtttttttgttcatggaggcctgttgtacttgctgaacacagtactgctgtggtaactggccaacttgtaatgttagntaagtcctgatagtcgctttgttgaatttgtcaaagaaagcgagaaagaaagntgtgtggtattgagttgtggacaaaaagtgtgatttgtattgattaagaaagcattaacaccgatgctgtcggttagacggttggatt

SEQ ID NO: 1020 - DNA, 1451 bp, Hordeum vulgare
tttgcgcttggggcaatgacgcagctagtgaggttataccgaggcgcgtcaattgctggttgaaaactatttccaaaccccctctttggccctcatgggccactgagaatttctgaaagggctccccctccttcgggagagggtaaagccctacaaagccacacgcctagccttagctagctagcttactccacactccacacccaccgcatcgcaccaacaatggcgatggcgagcagcaggggcggcgccggcgcactggttctggccttcgtgaccgtcgcagtgctggtctcccccgcgctgtccgcccctctggacggagccggcttccactcggcaacgtgcccgcagctggagagcatcgtgctgtcctccgtgcaggcggcgctccagcgcgacgtggcgctcgccgccggcctcctccgcatcttcttccacgactgcttcccgcagggctgcgacgcgtccgtgtacctcaagggcagaggcacggagcagactatgggacccaacaccacgctgcagccgcgcgcgctgcagctcgtcgaagacatccgcgccaaggtgcacgccgcgtgcggccccaccgtgtcctgcgccgacatctccgccctcgccacccgcgacgccgtcgtgctctccggcgggcccaactacaccgtgccccagggccagttcgacagcctcgccccagcgtccgagaacgtcgtcgacggcctgccgtcgccggccaccgacagcgtcaccatcctcgcgcgcgccttcagagccaagggcctccgcgacctcgccgacctcgtggcgctctcgggcgcgcacaccgtcgggaggaccggctgcccgttcttcgccgaccgggctcagcgcatggacgacgccttctcccggaggctggcggccaactgcagcgcggccccgaaccggctgcagaatctggacgtggtgactcccgacctgttcgacaacggttactacaaggcgctggtgaacagccagggcgtgttcacctccgacatggcgctcatcaaggaccgcaccacggcgcccatcgtgaggcagttcgcgcgcagcaaggacgccttcttcgcgcagttcgccaaatccatggccaagctcgccaccgcgccccggcccggcggcaacgtcggtgagatccgtcgcagctgcttcagccgcaacgcccggcgcgccatcgacaccgtcgtcgacgccagtgctggtgacgaggagggcttcgcggcctccgcttgatgtcagtttgcagttactaatccgtgtggtgtgtttgtgtttgtgtttgtgtgcgcgcgcgcgtcagttgatcccagagcgcgccttgtgttctgctgcttccttggttcgttcgtgcagtataataagcaaaaagacttttcaaaaatttgaacacagtatatatacaaaccctcgtatatactccctccgttcct

SEQ ID NO: 1021 - DNA, 1199 bp, Pseudoroegneria spicata
cgactaccgtgcagccgcagtgcactggttctcgccttcgtggccgtcgccgtgctggtctccccggccctgtccgcccctctggacggcgccggcttccactcggcgacatgcccgcagctggagagcatcgtgctgtcctccgtgcaggcggcgctccagcgcgaggtggcactcgccgccggcctcctccgcatcttcttccacgactgcttcccgcagggctgcgacgcgtccgtgtacctcaagggcagcggcaccgagcaggccatggggcccaacaccacgctgcagccgcgggcgctgcagctcgtggaggacatccgcgccaaggtgcacgccgcgtgcggcgccaccgtgtcctgcgccgacatctcggcgctcgccacccgcgacgccgtggtgctctccggcgggcccaactacaccgtgccccagggccagttcgacagcctcgcaccggcgtctcagaacgccgtcaacgccctcccgtcgccggccaccgccagcgtgtccgccctcgcgcgcgccttcagcgccaagggcctccgcgacctggccgacctcgtggcgctctccggcgcccacaccgtcgggaggacgggctgcccgttcttcgccgacagggcccagcgcatggacgacaccttctcccgcaggctggcggccaactgcagcgcggccccgagccggctgcagaacctggacgtggtgacccccgacctgttcgacaacgggtactacaaggcgctggtgaacagcgagggcgtgttcacctccgacatggctctcatcaaggaccgcaccacggcacccatcgtcaggcagttcgcgcagagcaaggacgccttcttcacgcagttcgccaagtccatggctaagctcgccaccgcgcccaggcccggcgggaacgtgggcgagatccgccgcagctgcttcagccgcaacccccggcgcgccatcgacaccgtcgtcgaggccggtgaagaggagggattcgccgcctctgcttgatgccgatccgttgattagcttgtgtgcgtttgcaagccgtgcgctagtagcatgcacgtgcatggctccgtgtatgtcagctgtttatttctgctcgtgtgtgtgtgtgtgtgtgtgtgttcctgctttgctctgtagtgtaataagagacttcatcagtgagtcactgagtacttgcttgctca

SEQ ID NO: 1022 - DNA, 1308 bp, Triticum aestivum
cgcctagccttagctagctagcttactccacactgtgtccacacccaccgcacttcaccaactatggcgatggcgagcagcagcaacggtgccggcacggtggttctggccttcgtgaccgtcgccgtgctggtctccccggccctgtccgcccctctggacggagccggcttccactcggcgacgtgcccgcagctggagagcatcgtgctgtcctccgtgcaggcggcgctccagcgcgaggtggcgctcgccgccggcctcctccgcatcttcttccacgactgcttcccgcagggctgcgacgcgtccgtgtacctcaagggcagcggcacggagcaggccatggtgcccaacgccacgctgcagccgcgggcgctgcagctggtcgaggacatccgcgccaaggtgcacgcggcgtgcggcgccaccgtgtcctgcgcagacatctcggcgctcgccacccgcgacgccgtcgtgctctccggcgggcccaactacaccgtgccccagggccagttcgacagcctcgccccggcgtcagagaacgccgtcaacgccctcccgtcgccggccacctccagcgtctccgccctcgcgcgcgccttcagcgccaagggcctccgcgacctggccgacctggtggcgctctccggcgcccacaccgtcggcaggacgggctgccagttcttccgcgaccgggctcagcgcatggacgacgccttctcccggaggctggcggccaactgtagcgcggccccgagccggctgcagaacctggacgtggtgacgccggatctgttcgacaacggctactacaaggcgctggtgaacagccagggcgtgttcacctccgacatggcgctcatcaaggaccgcaccacggcacccatcgtcaggcagttcgcgcagagcaaggacgctttcttcgcgcagttcgccaagtccatggccaagctcgccgccgcgccgaggcccggcgggaacgtgggcgagatccgccgcagctgcttcagccccaacgccccgcgcgccatcgacaccgtcgtcgacgccggtgacgaggagggattcgctgcttctgtctgatccgtcgattagtgtgtgtgcgtttgctggccgtccgctagatagcatgcacgtgcatggcttcgtgtatctcagctgttaatctctgctcgcgtgtgttgttgctgctttggctctgtagtgtgtaataagagacttcatcagtagtcgctcagtcactgagtgcttgcttgctcaaggtcaacatttcaatgaaatttcactcgacttgtgccgaaa

SEQ ID NO: 1023 - DNA, 1330 bp, Triticum aestivum
  misc_feature (642)..(642): n is a, c, g, or t
  misc_feature (705)..(705): n is a, c, g, or t
  misc_feature (744)..(744): n is a, c, g, or t
  misc_feature (747)..(747): n is a, c, g, or t
  misc_feature (882)..(882): n is a, c, g, or t
  misc_feature (1249)..(1249): n is a, c, g, or t
cgcctagccttagctagctagcttactccacagtgtgtccacacccaccgcaccgcaccaactatggcgatggcgagcagcagcggcggcgccggcgcactggttctggccttcgttaccgtcgccgttctgctctcccccgcactgtccgcccctctggacggcgccggcttccactcggcgacgtgcccgcagctggagagcatcgtgctgtcctccgtgcaggcggcgctccaacgcgaggtggcgctcgccgcccgcctcctccgcatcttcttccacgactgcttcccgcagggctgcgacgcgtccgtgtacctgaagggcagcggcacggagcaggccatggggcccaacaccacgctgcagccgcgcgcgctgcagctcgtggaggacatccgcgccaaggtgcacgcggcgtgcggcgccaccgtgtcctgcgccgacatctcggcgctcgctacccgcgacgccgtcgtgctctccggcgggcccaactacaccgtgccccagggccagttcgacagtctcgccccggcgtcacagaacgccgtcaacgccctcccgtcgccggccacctccagcgtttccgccctcgcgcgcgccttcagcgccaagggcctccgcgacctggccgacctngtggcgctctccggcgcgcacaccgtcgggaggacgggctgcccgttcttccgcgaccgggcncagcgcatggacgacgccttctcccggaggctggcggcnaantgcagcgcggccccgacccggctgcagaacctggacgtggtgacgccggacctgttcgacaacggctactacaaggcgctggtgaacagccagggcgtgttcacctccgacatggcgctcatcaaggaccgcacnacggcgcccatcgtgaggcagttcgcgcagagcaaggacgccttcttcgcgcagttcgccaagtccatggccaagctcgccaccgcgccgaggcccggcgggaacgtcggcgagatccgccgcagctgcttcagccccaacgcccggcgcgccatcgacaccgtcgtcgacgccggcgaggaggagggattcgcggcttctgcctgatgtggatcgactgattagcgtgtgtacgtttgctgctagtcgtgcgctagatagcatgcacgtgcatggcttcgtgtatgtcagctgttaatttctgctcccgtgtgtgtgtgcctgctttggctctatagtctgtagtgtaataagagacttcatcagngagtcactgagtgcttgcttgctcaaggttcaacatttcaatgaaattcacccggcgggtaccgaaatatttgtaaccttg

SEQ ID NO: 1024 - DNA, 1218 bp, Triticum aestivum
  misc_feature (664)..(665): n is a, c, g, or t
agcttactccacagtccacgcccaccgcaccgcaccaactatggcgatggcgagcagcagcggcggcgcaggcgcactggttctggccttcgttaccgtcgccgttctgctctccccggccctgtccgcacctctggacggcgccggcttccactcggcgacgtgcccgcagctggagagcatcgtgctgtcctccgtccaggcggcgctccagcgtgaggtggcgctcgccgccggcctcctccgcatcttcttccacgactgcttcccgcagggctgcgacgcgtccgtgtacctcaagggcagcggcacggagcaggccatggggcccaacaccacgctgcagccgcgggcgctgcagctcgtggaggacatccgcgccaaggtgcacgccgcgtgcggcgccaccgtgtcctgcgccgacatctcggcgctcgccacccgcgacgccgtcgtgctctcaggcgggcccaactacaccgtgccgcagggccagttcgacagcctcgcccctgcgtcggcgaacgtcgtcgacggtctcccgtcgccgcgcaccgccagcgtgtccaccctcgcgcgcgccttcagcgccaagggcctccgcgacctggccgacctcgtggcgctctccggcgcgcacaccgtcgggaggaccggctgcccnntcttctcagacagggcccagcgcatggacgacgccttctcccggaggctggcggccaactgcagcgccccctcgccccggccacagaacctggacgtggtgacccccgacctgttcgacaacgggtactacaaggcgctggtgaacagccagggcgtgttcacctccgacatggcgctcatcaaggaccgcaccacggcacccatcgtcaggcagttcgcgcagagcaaggacgccttcttcgcgcagttcgccaagtccatggccaagctggccaccgcgcccaggcccggcggcaacgtcggcgagatccgccgcagctgcttcagccgcaacgcccggcgcgccatcgacaccgtcgtcgacgccggtgacgaggagggattcacggcttctgcctgatgtcgatcgaatgattagctgttagtttctgctcgcgtgtgtacgtgtgttgctgctttggctctgtagtgtgtaataagagacttcatcagcgagtcactgagtgcttgcttgcgcaaggttcaacatttcaatgaaatttcaccgaaata

SEQ ID NO: 1025 - DNA, 1005 bp, Brachypodium distachyon
gggtgacaagccgggtggttctcccattcctggaaccatccaatcggcacggccggcgtacgcgtaaactaggctttcgcacgcgcgaaaccggcggaattgcggaaagaatccaccggcatccatcattggcgttggtgcacggcacggcacgccagcggtgcattgacttaagagaccttggcttgcttagccctaccatgctacctccatgtgatgtggttgaggcgggaggaagacgcatgcgagttgctccatcttcaacccctgtccttatacttatagcagctccatttgattggatctagcgatctcgtcgtctagtcttgtcgatcgagcgagcggtacaggaattcgggatcgctcagatcaggccggggggtggaagatatggcgcaggggacgctggaggtgctgctcgtcggagccaagggcctcgagaacaccgacttcctcagcaacatggatccttacgcggttctgatatgcacctcgcaggagcagaagagcaccgttgcgtcaggcaaaggaagtgatcctgaatggaacgaaacctttgtgttcaccgtctctgagaacgcgaccgagctcatcatcaagctcctggacagtgacaatggcacagaagatgattgtgttggtgaagcaacgatccctttggaagcagtgtacacggaaggaagcatctcaccaacggtttataatgttgtcaaagacgaagaataccgcggagaaatcaaaattggtctgacgttcactccggagccggaggagtctggggaatagaatttacctgaggaaaacctgggacagtggaatcaatcgtcttgagaagatcatgctttgatgaactgcaattgtgtgactagtatgctagaacgaagcctatgttaaagacagtacttctcactaatttccttaatggtggatgattgcaactctccgtattaatatgtatcattcttgtacttcaattattaataatggttttttttgttttctgcc

SEQ ID NO: 1026 - DNA, 816 bp, Zea mays
cagcaatcagtctcgaccttcagtcgtgctgcctacccatcagcatataattcctgatcgagcgagcgggagaggaaggcgagatcagtcagatcaggcccggagagaagatggcgcaggggacgctggaggtgctgctcgtcggagccaagggactcgagaacaccgactacctctgcaacatggacccgtacgcggttctaaaatgcacatcgcaggagcagaagagcaccgtcgcctcaggaaagggaagtgatcctgaatggaacgaaacctttgtgttcaccgtctctgagaatgcaaccgagctcgtcatcaagctcctcgacagtgatggtggcacggacgacgacagcgttggtgaagcaacgatcccattggatggagtgtacactgaaggaagcatcccaccaactgtttacaatgttgtcaaagacgaagagtaccgtggagaaatcaaaatcggtctgacgttcactccggaggaggctcgtgatgaggatcaacccgaggaaaactacggtgggtggaaccaatcatcttgagaagaagtaggtgctttgctgaactgtggtgcgtgacaagtcgtgtgctagaactaaagcctattttaattgttaaagactgtatttatcattgattccatcaattatggataagctacaaatctccttattgattggtatcgttttctagtattcaaatttgtaataacagtgttccccacttgtatgaagtatgagccctctttaatgtcactaaattgatttgcaatggtgatggccccatttcttaatagagaaggttgtgtgcatc

SEQ ID NO: 1027 - DNA, 798 bp, Pseudoroegneria spicata
tagtctcgtcgttcagtcgtgctgcctactcagcgtagttcctcatctgatcatctcgaccggagtggggtaggcgaaggcgagatcagtcagatcagaccgggggagaagatggcgcaggggacgctggaggtgctgctcgtcggagccaagggcctcgagaacaccgactacctctgcaacatggacccgtacgcggttctgagatgcacctcgcaggagcagaagagcaccgtcgcctcaggaaaaggaagtgatcctgaatggaacgaaacctttgtgttcaccgtctctgagaacgcatccgagctcgtaatcaagctcctggacagtgatggtggcacggaagacgacagcgttggtgaagcaacgatccctttggatgcagtgtatagtgaaggaagcatcccaccaactgtctacaatgttgtcaaagacgaagagtaccgtggagaaatcaaaattggtctgacgttcactccggaggaggctcgtgatcaggatgaacccgaggaaaattacggtgggtggaaccaatcatcttgagcagaagcagatactttgctgaactatggtgtgtgacaagtcgtgtgctagaactaaagcctattttaattgttaaagactgtgtattcatcattgattccctcaattatggataagctacgcctctccttattgattggtatcgttttctagtattcaaaattgtaataacagtgttccccgcttgtatgaagtatgagccctctttaatgtcactaaactgatttgcaatagggatggccccatttctta

SEQ ID NO: 1028 - DNA, 494 bp, Secale cereale
  misc_feature (8)..(8): n is a, c, g, or t
  misc_feature (11)..(11): n is a, c, g, or t
  misc_feature (225)..(225): n is a, c, g, or t
  misc_feature (403)..(403): n is a, c, g, or t
ccacgcgnccncagccgtgccgcctactcatcagcatataattcctgatcgagcgaccggaggcgagatcagtcagatcaggccgggagggaagatggcgcaggggacgctggaggtgctgctcgtcggagccaagggcctcgagaacaccgactacctctgcaacatggacccgtacgcggttctaaaatgcacctcgcaggagcagaagagcaccgtcgcctnaggaaagggaagtgatcctgagtggaacgaaacctttgtgttcaccgtctctgagaatgcaagggagctcgtcatcaagctcctggacagtgatggtggcacggaagacgacagtgttggtgaagcaacgatcccattggatggagtgtatactgaaggaagcatcccaccaactgtntacaatgttgtcaaagacgaagagtaccgtggagaaatcaaaatcggtctgacgttcactccggaggaggcacgtgatcaggatcaacccg

SEQ ID NO: 1029 - DNA, 669 bp, Picea glauca
ggtctcgttcagtcctgccggagaagtcagctgcgcagctcctgtcttcctgatcgacgcagatggcgcaggggacgctggaggtgctgctcgtcggagccaagggcctcgagaacaccgactttctgtgcgacatggatccgtacgcggttctgagatgcacctccgacgagcagaagagcagcgtcgcgtcaggcaaaggaagtgaacctgaatggaacgagacctttgtgttcacaacctctgaacacgcaactgagctcatcatcaagctcttggacagtgatgctggcacggaagacgacattgttggtgaagcaacgatcccattggatgcggtctatggtgaaggccgcataccaccaactgtttacaatgttgtcaaagacgaggagtaccgtggagaaatcaaaattggtctgacattcactccggaggagtgtcgtgattaagatttacccacgaaaaactatggtggtgcaatcaacttcttgagaagaagcagatatttgttgaactacaatgatgtgtgacaagtcgtgtttcgtttgttaatgtccttttccattgtttcctctgttattgataactgcaagtctccatattaactggtgtcatttttcagtatttaaatttgtaataatgttgtttgctctttaagggtcacca

SEQ ID NO: 1030 - DNA, 853 bp, Triticum aestivum
agacgcggccgagccttccatttttcaactcctagtcctatacatacagcggcgccccggggctcggatcggatctacagcgattagtctcgaccttcagtcgtgctgcctgctcatcagcatataattcctgatcgagcgagcgggagaggaaggcgagatcaggccgggagagaagatggcgcaggggacgctggaggtgctgctcgtcggagccaaggccctcgagaacaccgactacctctgcaacatggacccgtacgcggttctaaaatgcacctcgcaggagcagaagagcaccgtcgcctcaggaaagggaagtgatcctgagtggaacgaaacctttgtgttcaccgtctctgagaatgcaaccgagctcgtcatcaagcttctggacagtgatggtggcacggacgacgacagcgttggtgaagcaacgatcccattggatggagtgtacactgaaggaagcatcccaccaactgtttacaatgttgtcaaagacgaagagtaccgtggagaaatcaaaatcggtctgacgttcactccggaggaggctcgtgatcaggatcaacccgaggaaaactacggtgggtggaaccaatcatcttaagaagaagcaggtgctttgctgaactatggtgcgtgacaagtcgtgtgctagaactaaagcttattttaattgttaaagactgtatttgtcgttgattccgtcaattatgtataagctacaaatctccttattgattggtatcattttctaatcttcaaatttgtaataatagtgttccccacttgtatgaagtatgagccctttttaatgtcactaaactgagttgcaataaaaaaaaaa

SEQ ID NO: 1031 - DNA, 909 bp, Triticum aestivum
caccgcgtccatgtgacgcgacgtgggggaggtgcgaggaagacgcggccgagccttccatttttcaactcctagtcctatacatacagcggcgccccggggctcggatcggatctacagcaatcagtctcgaccttcagtcgtgctgcctacccatcagcatataattcctgatcgagcgagcgggagaggaaggcgagatcagtcagatcaggcccggagagaagatggcgcaggggacgctggaggtgctgctcgtcggagccaagggactcgagaacaccgactacctctgcaacatggacccgtacgcggttctaaaatgcacatcgcaggagcagaagagcaccgtcgcctcaggaaagggaagtgatcctgaatggaacgaaacctttgtgttcaccgtctctgagaatgcaaccgagctcgtcatcaagctcctcgacagtgatggtggcacggacgacgacagcgttggtgaagcaacgatcccattggatggagtgtacactgaaggaagcatcccaccaactgtttacaatgttgtcaaagacgaagagtaccgtggagaaatcaaaatcggtctgacgttcactccggaggaggctcgtgatgaggatcaacccgaggaaaactacggtgggtggaaccaatcatcttgagaagaagtaggtgctttgctgaactgtggtgcgtgacaagtcgtgtgctagaactaaagcctattttaattgttaaagactgtatttatcattgattccatcaattatggataagctacaaatctccttattgattggtatcgttttctagtattcaaatttgtaataacagtgttccccacttgtatgaagtatgagccctctttaatgtcactaaattgatttgcaatggtgatggccccatttc

SEQ ID NO: 1032 - DNA, 876 bp, Triticum aestivum
cacacaccgcgtccatgtgcgaggaagacgcggccgagctttccatttttcaactcctagtcctatacatacagcggaaccccggggctcggatcggatctacagcaattagtctcgaccttcagtcgtgccgcctgctcatcagcatataattcctgatcgagcgagcgggagaggaaggcgagatcaggccgggagagaagatggcgcaggggacgctggaggtgctgctcgtgggagccaagggcctcgagaacaccgactacctctgcaacatggacccgtacgcggttctaaaatgcacctcgcaggagcaaaagagcaccgtcgcctctggaaagggaagtgatcctgagtggaacgaaacctttgtgttcaccgtctctgagaatgcaactgagcttgtcatcaagctactggacagtgatggtggcacggacgacgacagcgttggtgaagcaacgatcccattggatggagtgtacactgaaggaagcatcccaccaactgtttacaatgttgtcaaagacgaagagtaccgtggagaaatcaaaattggtctgacgttcactccggaggaggctcgtgatcaggatcaacccgaggaaaactatggtgggtggaaccaatcatcttgagaagaagcaggtgctttgctgaactatggtgcgtgacaagtcgtgtgctagaactaaagcctattttaattgttaaagactgtatttgtcgttgattccctcaattatggataagctacgaatctacttattgattggtatcgttttctaatattcaaatttgtaataaacagtgttccccacttgtatgaagtatgagcctctttaatgtcactaaactgagttgcaaaaaaaaaaa

SEQ ID NO: 1033 - DNA, 1076 bp, Saccharum officinarum
  misc_feature (58)..(58): n is a, c, g, or t
  misc_feature (74)..(74): n is a, c, g, or t
  misc_feature (100)..(100): n is a, c, g, or t
  misc_feature (132)..(132): n is a, c, g, or t
  misc_feature (146)..(146): n is a, c, g, or t
  misc_feature (195)..(195): n is a, c, g, or t
  misc_feature (218)..(218): n is a, c, g, or t
  misc_feature (312)..(312): n is a, c, g, or t
  misc_feature (476)..(476): n is a, c, g, or t
  misc_feature (540)..(540): n is a, c, g, or t
  misc_feature (648)..(648): n is a, c, g, or t
  misc_feature (699)..(699): n is a, c, g, or t
  misc_feature (771)..(772): n is a, c, g, or t
  misc_feature (782)..(782): n is a, c, g, or t
  misc_feature (803)..(803): n is a, c, g, or t
  misc_feature (818)..(818): n is a, c, g, or t
  misc_feature (920)..(920): n is a, c, g, or t
  misc_feature (926)..(926): n is a, c, g, or t
  misc_feature (944)..(944): n is a, c, g, or t
cccacgcgtccgcgagccacaaaccccggagaaaccctagcaaggccggtggtccctntcaggcgcggcgcggngcggcatccccgacgaacgatggccngatatcgcagccggagtccgagccggagctanagcccgcggcggcngtacagccggagccctcctaggcgcaagcgctacgacgacccccgggancgctaccgctgggccggggccgncggaggcggggaccgacgtggttacggtcggccgtcggcgcagtccggtctcctcatccgcaacatctccctcacagccaggccagaagatatncgtgttccatttgagcaattcggccctataaaggacgtttacctacccaggaatttccacaccagggaacttcgtggttttggatttgtcaaattccgctaccctgaggatgctgcagttgccaagcaagagatgaatcatcaagtcatcggtggtcgagaaanttcaatagtttatgctgaggagaatcgaaaaacaccacaagaaatgcgcatgagaacaagaacnagtggtaggtacatggagggaagatacacaagacgatcactatcaagatctccaaggtctcgttcccactcttattcaccgtcgccttctccagttaggcgtgacttnagggcaggggacgccgggatgattattcccctgagtactcacactctccangccctcgggacaacaggcgctacaggtcagataatcgctctccaagcctagatgaccacaactcaggcgacnncagtcaatantggacatgtcagcagctgttncagtccagatatatnatgccatatgttgccttgaatgagtcggaggctggagacacagactatctttttcgtcaatcttctctaagagatgagtaggtttgtagtaaacagatgctngtaatngtattacaggtgatgttntggttttgaagcacgcctgtgcctttgtgacgctgctttaatgctttaccaaccgattgtaccaatggtggaagtttgcgtttttgttttggcttgaatattacattttttcatctttcggccattcattgg

SEQ ID NO: 1034 - DNA, 4911 bp, Brachypodium distachyon
cggcacgagggcgacgggagccaccacgccattacttcggcgccccgccccgccctcctccaaccgccacctccctccgcgatctcgccgcgcgatctccgaccgcccagccgcccaccttgcctccttggaggagcttcgagcctgacccgggcgtcccatggtgggtccgatacatcggggccgcgagatctagggttttcgagccgcggtgggagcgatggggcgccggaagatcacgacggcggcggcggcggcggctcctcctcggggctcgtcaagggctggggacggtgtcatatcagaaattcgggagaaacataaattggaattggagaatttgacgctaacaaagcatccattcaggacattgcacttcttcaacttagctatgttgcaatacttcaaaagattagcaacatatatcctaagtaaaggtgctttgtttgttctcctaattgttttggtggtaattcctggagttacgcttctggttacagatggtctgcacaaaaagcatgtccaggagttccttaattatgctagatttgtgttgtggtgggtttcattaggcgttgcctcgtcaattggactaggttcgggtttgcatacatttgtgctttatcttgggccccatattgctctcttcactatcaaggccgttcaatgtggccgaattgatttgaagaccgctccatacgataccatacagcttaaacaggcaccatcatggcttgataagaagtgttcggaatttggatcaccaatgtaccatgcatcagatcattcagtgatgatcccagtctttgatttactcccacaggttcagttggaagctgttctttggggtatcgggacagcactgggcgagcttcctccttattttatatcacgagctgctcgtttgtcaggaagtgagatagaagctgttaaggagctggatgttgctccgtcgacagaagatggtccaatagcatcgactctgaatcgcacaaaacgctggcttctttctcactctcagcatctcaacttcttcactatcttgatacttgcttcggttccaaacccgctgtttgaccttgctggtatcatgtgtggtcaatttggtataccattttgggagttcttctttgcaactttgattgggaaggccatcatcaagactcatattcagacactctttatcatctcgttatgcaacaaccaactcttgtattttatggaaaaggaattaatctggatatttggccatattcctgggttttctgccaccctgccatctgttatcgccaaactccacagtgccaaggagaagtatttatcaccaccggtgtcagtctcaccatcctcacaaatggaggataaacagtggaatttctctttcgcactggtctggaacactgtagtatggcttgtgcttgtgaacttcttcgttaagattgtcacatcaacggctcaggattatcggaaaaggcagcaggacgtagagatggaactcattactgattcctcgtccttgaatcattctaaaactaactaacaggaaaatggttgtatttatttggctgcaagttgcgaatattctcctcagtagccttaacgcctggcaaggccctttgcagatgataccaacgctggtagaagttgtattcttctgtacagtgagcagaaacatgggcttcgccaacctgccccaagtgatggctgcgacctttttcggtatggcggcggcggcgggcaatgtggagttcatccgcgcgcgcagcgacaagcgggagtaccgccgcgtggtgctccccaattcgctcgagtgcctcctcatcagggacgccgacaccgacaaggcggcggcctgtatggaggtcggcgtgggctcgttcagcgacccggaggggctcgagggcctcgcgcacttcctcgagcatatgctcttttatgccagcgagaaataccctggagaacaagattatacaaaatatatctcagagcatggcggttcttccaatgccttcacatcctctgagacaacgaatttctattttgatgttaatgtggacaatttcgaagaagccttagatagatttgcccagttcttcattaagccactgatgtcgcaggatgctgtgcttagagagatcaaggctgttgattctgaacacaagaaaaacttgttgtcggatggatggagaatgtatcagcttgaaaagcatttggcttcaaaggatcacccttaccataaattcagtactggaagttgggaaacattggaaactaaaccaaaagagaggggattggacatcagacttgagcttctcaagttctatgagaactattcagcgaatcttatgcaccttgttgtttatggaaaggagagtctcgattgtattcagagcttagtggaaagcttgtttattaacataaaaaacactgaccagagaagcttcaaatgtccaagtcaacctctttcagcagaacatttgcagcttctcgtcaaagcaatcccaataagagaaggcgactacctaaaaatatcatggccagtcacaccaaacatccacttttacaaagaaggcccttgccgctatctcagtcatctcgttgggcatgaaggcgagggatccatcttccatattataaaggaattaggatgggccatggacttggtggctggctctggcagtgacagcaatgaatattcttttttctcagtaggcatgaggctcactgatgctggtcatgaacacatggaggatatcattgggttggtcttcaaatacctccacctactaaaagaagatggaatccatgaatggatatttaatgagcttgcgtcgacaaatgaaacagcattccactatcaagacaaagtccatccgatcagctatgtgaccggtactgtctcaggcatgcggttgtttccaccagaggaatggttggttggagcatcattgccgtcgaagtatgcgccaaatagaataaatatgattcttgatgagttgtcatctgaaagagtaagaatactctgcgagtctaaaatttttgaaggaactacgaactgtgctgagccctggtacaatacatcatattctgttgaaaatgtcactcctcaaatgatacagcaatggattcaaaaggctcctactgagaagctccatctcccaaagcctaacattttcatcccaaaggatttatctcttaaagaagtgtgcgacaaggttaagtttccaacagtattaaggaagacaccactttcacggctttggtataagcccgacatgctgttcttcactccgaaggttaacgttataattgatttccactgtccactgtcaagccactcccctgaagcagccgtatctacaagtctctttgttgatttgttagtcgattacttgaatgcttatgcttatgacgctcaaattgcaggtttattctattcgatatatcttacttctactggatttcaggtcgccgtatgtggttacaatgacaagatgagagttctactgcatgccataatgaaacaaatagcaacctttgaagttaaagcaaacaggttttctgccctgaaggaaacttctgttaaggattatcaaaattttaacttcagccaaccatattctcaagcttcatactatctctcattaatattggaagagacaaaatggcctttggttgagaaacttcatgctctttctaagctcgagtcagattctcttgcaaagtttgtgccacacttgctatcaaagacatatttggaatgctacgttcaagggaacattgaaccaggtgaggctgagtctattgtccaggaaactgaagatactatatttaatacccccaattctgtattcaaatccatgtccccatcacaatatctggttaaaagggttatcatgcttgaaaatgagttaaaatgctactaccaaattgagggtttaaatcagaagaatgagaattcatcaattgtccaatacattcaggttcatcaggatgccgccatttcaaatatcaaacttcagttgttctctctaattgctagccagcctgctttcaaccagctgcggactgttgagcaacttgggtatataacatatctttcaaccagatctgatcgtggagttcgggcactcgaggttgttattcaatccactgtaaaggatccttcgtaccttgatgctagaattgatgaattctttaagatcttcgaaagcaaaatccatgagttgtctgacaaggatttcaagagaaatgtcaaatcacttattgattcgaaactggagaaattcaaaaacttgtgggaggaatctggcttctactggggagagattgaatccggagctctcaagtttgataggattgagtcagaggttgctcttctaagagatctcacgaaagaagaattcatcgaattctttgaccagtacataaaagttgatgcgcctcaaaggcggaccataagcgtgcaggtcttcagcggcaaccattcggcagagtttaagaaggctatcaccgaagctgacccacccaaaacttaccggattaccgacatattcggcttcaagcgatcaagacctctgcacccctcgctgaaggcaggtccaggccgggtcacaatggactaacagctcacagctatgcgctgctatacattttgtgtttcctgtagtgtagtatatagcctgcgcgcatgcatgaactcaattctgatttacacgactgcacaatgctattcatcctgtatggctgtatggatcgagttaccacgtgttgccattttcagaacaaatctacctgcagtagataaccatatatactttttgtttgttatgtatttcttcagacaactatacacactatatgtacaatagctttttacggtaaccgaaaattaatttgaactgtcatgca

SEQ ID NO: 1035 - DNA, 1927 bp, Cenchrus ciliaris
  misc_feature (700)..(700): n is a, c, g, or t
  misc_feature (1550)..(1550): n is a, c, g, or t
  misc_feature (1697)..(1697): n is a, c, g, or t
  misc_feature (1788)..(1788): n is a, c, g, or t
  misc_feature (1797)..(1797): n is a, c, g, or t
  misc_feature (1802)..(1802): n is a, c, g, or t
  misc_feature (1856)..(1856): n is a, c, g, or t
  misc_feature (1915)..(1915): n is a, c, g, or t
gaaattgaacgaaccgcgcgattgggagtcaggagggaacgaggaacagccatcgtctcgggcctcggcacctccgcagcgactgtggcttaagatctcgtgagcgatccgactcccccggcggcggctcgcgaagcggtcggagcttcgactcagatccgggcgggcgccccatgccccatggtgcggctctggtgccgttgagccgcgggatctagggttttcgcgcgccgcgggagtgggggagcgacgatggggcgccggaagatgtcagcggcggcgccgccgtctcggagctggtccaacgtcggcgggagcgtcatccccgaacttcgagcaaaacaaaaaatggagttggaaaatctgacgctgacgaaacagccaatcagaacattgcattttttcatgttggccttgttacaatacttgaaaagattagccacatatatcctgagtaagggtagtttgtttgttctcctaattcttctggtggtggctcctgcaatcttacttgtcgtttcagacggcctgcacaagaagcatgtgcaggagttcattaattatgctaaatttgcattgtggtgggtttcattaggtgtggcttcatcaattggactaggttctggtttacatacatttgtgctgtatctgggccctcatattgctctgttcactattaaagctgttcaatgtggccganttgatttgaaaatggctccatatgataccatacagttaaaagttggaccatcgtggcttgacaagaaatgttcagaatttggaccacccatatacccagcatcaactgattcagttaggatcccagtcttcgacttgctacctcagatacaactggaagcagttctttggggcattgggactgcacttggcgagcttcctccatattttatatcgcgtgctgctcgcttgtcaggaagtgagtcaaaagcagtcaaggagctggatactgctacttccaaagaagatggccgagtagcatccactcttaatcgaaccaagctgtggcttctttcccactctcaacatctgaacttcttctctattttgttacttgcttcggttccaaatccactttttgaccttgctggtattatgtgtgggcaatttggtgtgcccttctgggagttcttctttgcaactttgattgggaaggccatcatcaagactcatattcagacgctatttattgtgtccttgtgcaacaatcaactcttgtatttcatggagaaggaattaatctggatatttggtcacattcctggattttctgccaccctgccatctgtgattgccaaactccacgccgcaaaggacaagtatttatcgccaccagcaacagcctcatcgtcctcacaagtggaggacaagcagtggaatttctcttttacatttgtctggaactctatagtgtggattgtgcttctgaacttcttcattaagataatcacgtcaacagcacaggatcatctcaaaaaacagcaggatatggagatcgaacgtgtttctgattcctcagtctcagaccattntaaagctaactagttgtgcaactggtggcgtttattcagctgctagctgcgaagattctcctctgtagcctcagacgcctggctaaacccttgcagatggtacccaagttcactcgattggtattagtaattattcatctgtacagngaacaaaaaccctggcattggttaacttgccaggtgatggctgcgaccttttgtcattgagcctgtactggcttttcctggaggagaatgntcatgttanttttngtacatcaacacggataagcagtaggaattgttcatgaagcacgattgctttgngtagagatgtatcactggtacctgtttctgtttaatttggaaatgcaatagtaacctgngaggattcaaca

SEQ ID NO: 1036 - DNA, 2116 bp, Zea mays
tggcggacccacttatcaatcgatttatgggccccgcgtggcagagtcaaaagactcggaagggagttggttggtttttgtttcctccccgcacccgcaacaacggaaacaacggccccgtggtagcgaggagatcaggaattcaggagagcaaaaggggagagagaatgaattgaaacgaaggcccgcgacgcgaggagcgagggaactaccaccggtgaccggtctcggcgcctccgcgacgatagcctctccgacctcgagcgcggtccggttcctccctgcgtcagcacgcgagcccttggagcttcgagtcagatcccggcgggcgcccatggtggctctggtgccgttgagccgcgcgatgtagggttttcgcgcgccgcagagtaggagcgatggggcgccggaagatgtccgcggcggcaccgccgtctcggagctggtccaacgttggcggaagcgtcatcccggaacttcgagctaaacacaaaacagacttgcagaatttgacgctgaccaaacagccactcagaacattgcattttttcctgttagccatgttacaatacttgaaaagattagcaacatatatcctgagtaagggtggtttcttctttctcctaattgttttattggtagcttctggaatcttgctcgtcgtttcggatggtctgcataagaagcatgtgcaggaattccttaattatgctaaatttgtgtcgtggtgggtttcattaggtgtggcttcatcaattggactaggttctggtttgcatacatttgtgctgtatctgggtcctcatattgctctgttcactattaaggctgttcaatgtggtcgaattgatctaaaaattgctccatatgataccatacagctaaaggttgggccatcatggcttgacaagaaatgttcagaatttggaccacctgtgtatccagcatcagctcattcagttaggatcccagtcttcgacctactacctcagatacagctggaggcagttctttggggaattgggactgcgcttggtgagctccctccttattttatatcacgagcagctcgcttatcaggaagcgagtcaaaagctgttcaggagcttgatgcagctacttccaaagaagatgggccagtagcatcatcccttaatcgaaccaagcgttggcttctctctcactcccaacatctcaacttcttctctatcttgattcttgcttcggttccaaatccactctttgaccttgctggtattatgtgtgggcaatttggtgtgcctttctgggagttcttgtttgctactttgattgggaaagccatcatcaagactcatattcagacactatttatcgtgtccctgtgcaacaatcagctcttgtatcttattgaaaaggagttaatctggatatttggtcacgttcctgggttttctgccacccttccgtctgtgattgccagactccatgctgccaaggacaagtatctatcaccaccagccccagtctcaccgtcatcacaaatgggggagaaacagtggaatttctcttttacatctgtctggaactctatagtgtggcttgtgcttttgaacttcttcattaagatagtcacgtcaacagcacaggattatctcaaaaagcagcaggatacggagatggaacttatttcggattccccgatccaggaccattctaaaactaactagtggcgcagctagtggtgtttatacacagctgctagcagcaaagattctcctctgtagcttaagcccctgcagatgatttcaagttccaacaattagtattagtagttattcatctgcgcagtggacaaaaacatggacacatggtcttggttaacttgtcagttgacgaccttttgtcattgagcctgtacctgtactggcagctcctggtggagtcattctgtttattttcggacatctacacggataaacagtaggaattgtttatggagcacggttggctttttttgaagtgaagagcacggttggctttgtgagatgtatcattcatacctgttcctatgtattctgggaacttgaaatgcaatagaaacctgggaggatttaacaaggatacatcatttgtc

SEQ ID NO: 1037 - DNA, 2224 bp, Oryza sativa
agcagggtcagcgcgcgagtccgagtaatattcccccacaacctctgccacaacggaaaacaacggcctcgctttgctcctccaaaatcgaagagaaaatttccaacaccccaccctcccccatcgcctcctcctcccgtctcggccggggcggacataaatacgagccgctcgacggggaaccgccgcgccgcgtccaccacccaccacaagctcgccgccggcgtcgcggacggcggctcatcccggtccggcgtgcgatccggctgactggccggagacctaggagcttcgaccccccccccccccccgcgatctgggcggcccatggtggggtcggtaccgcagggcggcagccgcggcagcgagatctagggttttcggcgcctcgggggtggggagggagcgatggggcgtcggaaggtcgccgcggcggcggctgcgacgccgccgcgtggctcgtcgaaggccgggggcggcgtcatatccgaaatccgtgagaaacacaaattggaactggagaatttgacactaacaaagcatccattcaggacattacgttttttcatgttagctatgttgcaatacttgaaaagattagcaacatatatcctgagtaagggtgctttgtttgttgtcctcattgtgttggtgctagctcctggaattttacttgcggttacagatggtctgcataaaaagcatgtgcaggagttcctgaattatgctagatttgtgttgtggtgggtttcactaggcgtggcttcgtcaattggactaggttcaggtttgcatacatttgttctgtatctgggccctcatattgccctcttcactattaaggctgttcaatgtggtcggattgatttgaaaactgctccatacgataccatacagcttaagcaagggccatcatggctggacaagaagtgttcagattttggaccaccagtgtaccaagcatcggctcattctgtccggatcccagtctttgaattactccctcaggttcagctggaagctgttctttggggcattggcacagcgcttggggagctccctccttattttatatcacgagctgctcgtttgtcaggaagtgaaccagaagctgtgaaggagctggatgctgctgcttcggatgaacatggtccaatagcatccactctcaatcgaacaaaacgctggctcctttcccactctcagcatctcaacttcattactatcttgattcttgcttcggttccaaacccactgtttgaccttgctggtataatgtgtgggcaatttggcattcccttctgggagttcttctttgctactttgattgggaaggccatcatcaagacccatattcagacattatttattatctccttgtgcaacaatcaactcttgtatcttatggaaaaggaattaatctggatatttggtcacattcctgggttttctgcctccttgccatctgtgattgcaaagctccacagtgcgaaggataagtatttatcaacaccaacatcggccacatcatcctcaaaaatggaggatacacagtggaatttctcttttacattggtctggaacactgtggtgtggcttgtgcttgtgaacttcttcattaagatcgtcacatcaacagctcaagaatatctcaaaaaacagcaggatatagagatggagcttattactgattcctcgccccagagtcagtctaaaactaactaaatattgcaacttgtggtgtttattcagctgcaagttgcaaatattctcctcatgagattatactcctggccaaagcccttgcagatgatatcaagtaccggtactaagttggtatttgtagttattcatctgttcagtgagcaaatatacgggcttcattaacttgcccaagtgatggctgcaaccttttgccattgagccctggattggctgttcctcgaggagaacaagttaggctgctattctttagacgtcaacacggatgaaccttttaggaattgtttatgaagaacggttgcattagtgaggtgtatcactggtgcctttttctttctgttttggaaatactttagaaagcttgagaggattcgacagctatactttcattgttcaattcactgtaaaatgcagatttgcaactggtgccggctagaatataatggaatagtagactatttcggctacgcatactctgcgaatgaaacttttgagttttgat

SEQ ID NO: 1038 - DNA, 1983 bp, Sorghum bicolor
ccggagcgaggagagcaaaaaggggaagagaaaatgaattgaaacgaacagcgcgacccgcgacgcgagggaactcccaccggtctcggcgcctccgcggcggacagcctctccgatctcgagcgcggtccgctccggctcctccctgcgtcagctcgcgaggcccttggagcttcgagtcagatccgggcgggcgcggcccagggtggctccggtgccgttgagccgcgtgatgtagggttttcgcgcgccgcagagtgggactgggactgggagcgatggggcgccggaagatgtccgcggcggcaccgccgtctcggagctggtccaacgttggcggaagcgtaatccccgaacttcgagcgaaacacaaaatggacttggagaatttgacgctgacaaaacagccactcagaacattgcattttttcctgttagccatgttacgatacttgaaaagattagcaacgtatatcctgagtaagggtggtttcttctttctcctaattgttctgttggtagcttctggaatcttactcgccgtttcggatggccagaataagaagcatgtgcaggaattccttaattatgctaaatttgtgttgtggtgggcttcattaggtgtggcctcgtcaattggactaggttctggtttgcatacatttgtgctgtatctgggtcctcatattgctctattcactattaaggctgtccaatgtggtcgaattgatctgaaaatggctccatatgacaccatacagctaaaggttgggccatcatggcttgacaagaaatgttcagaatttggaccgcctgtgtatccagcatcagctcattcagttaggatcccagtcttcgacttactacctcagatacagctggaagcagttctttggggaattgggactgcgcttggcgagctccccccttattttatatcacgagcagctcgcttatcaggtagcaagtcaaaagctgttaaggagcttgatgccgctacttccaaagaagatgggccagtatcatccactcttaatcgaaccaagcgttggcttctctctcactctcaacatctcaatttcttctctatcttgatacttgcttcggttccgaatccactctttgaccttgctggtattatgtgtgggcaatttggtgtgcctttctgggagttcttttttgctactttgattgggaaagccatcatcaagactcatattcagacactatttattgtgtcactgtgcaacaatcagctcttgtatcttattgaaaaggagctaatctggatatttggtcacattcctgggttttctgccacccttccaactgtgattgccaaacttcatgctgccaaggacaagtatctatcaccaccagcgccagtctcaccgtcctcacaaatggaggggaaacagtggaatctctcttttacatttgtctggaactctatagtgtggcttgtgcttctgaacttcttcattaagataatcacgtcaacggcacaggattatctcaaaaagcagcaggatatggagatggaacttatttccgattccccactcctggaccattcgaaaactaactagtggcacagctagtggtgtttattcacagccgctagctgcaaagattctcctctgtagacttgactcctgggcttctggctaggcccctgcagatgatttcaagttccaacaattagtattagtagttattcatctgtacagtgaacaaaatcatgggcttggttaactagtcaggtgatggctgcgaccttttgtcattgatcctgtactggcagtttgtcgaggagtcattctgtttatttttcggacatctacacggatgagcagtagggattgtttatggaccacggttggctttgccgagatgtatcactcatacctgttcctatttattttggggacttgaaatgcaatagaaacccgggaggattcaacaatgatacatcattgtgtc

SEQ ID NO: 1039 - DNA, 2080 bp, Sorghum bicolor
ctttgtcatatccgttgctcgcaaaacgcccccacgccccacacgccgccgccgccggcgaccgttgcgagggagcggaaggaaaccgccacgccacgccaccgtcccggcgcctgcctctccgatctcgaacgcgatccgtctcctccctgcgggggccgctcgggagtcgtcctacctaggagctccccgtgtcagatccgggcgggggcggggcggcccatggtggtggctctggcgccgttggtacgcgagatctagggttgtcgagcgccgcgggggtgggaggcggaaggatgggccgccggaagatgtccgcggcggcgccgccgtcccggagctggtccaacgtcggcgggagcgtcatccccgaactccgagcaaaacacaaaatggacttggaaaatttaacgctgacaaaacaaccactcagaacattacatcttttcctgttagccatgttacaatacttgaaaagagtagcaaaatatatcctgagtaagggtggcttgttctttctcttaattgttttggtggtagctcctggaatcttactcgctatttcagacggcgtgcataagaagcatgtgcaggagttccttaattatgctaaatttgtgttgtggtgggtttcattaggtgtggcttcgtcaattggactaggcaaggttctggtttgcatacgtttgtgctctatctaggtcctcatattgctctgttcactattaaagctgttcagtgtggtcgaattgatttgaaaatggctccatatgataccatacagcttaaggttgggccgtcatggcttgacaagaaatgttcagaatttggaccgcctgtgtatccagcatcagctcattctgttaggatcccagtctttgacttactacctcagatacaactggaagcagttctttggggcatcgggactgcacttggcgagcttcccccttattttatatcacgagcagctcgcttgtcaggaagcaaatcaaaagctgttaaggagcttgatgtcgctacttccaaacaagatgggacagtagcctccactcttaatcgtaccaagcgttggcttctttctcactctcaacatctcaacttcttctctatcttgatacttgcttcggttccgaacccactctttgaccttgctggtattatgtgtggccaatttggtgtacctttctgggagttcttttttgcaactttgattgggaaggccatcatcaagactcatattcagacactgtttattgtgtccttgtgcaacaaccagctcctgtaccttatggaaaaggagttaatctggatatttggtcacattcctgggttttctgctaccctgccatctgtgattgccaaactcaatgctgccaaggacaagtatctatcaccaccaacaccagtctcaccgtcctcacaaatggaggagaaacagtggaatttctcttttacattggtttggaactctatagtgtggcttgtgcttctgaacttcttcattaagataatcacgtcaacagctcaggattatctcaaaaagcagcaggatatggagatggaactgatttctgattccccgaccctggaacaaaactgactactggtgcaactagtggtgtttatttcagctgctagctgcaaaagattctcctctgtagccttaacaactggctaagcccctgcagatgattccaagttccaacaattatcaattagtactagtagttattcatctgtacagtcaaggaaaacatgggcttggtaactggccgggtgatggctgtgagcctgtgctggcagttcatggaggagaatcattctattcttttttcggacatctacacggatagacagtagggattgtttatgaatcacggttggctttttgccaagatttagcgcccatagctgtttctatttattttggaattgctatagaaacatgtaaggattcattcaacaatgatacgctctgttgtcaagtttactgtgtatttggtttgcaatttgtgcccggaaagagcaaactatagttcatctatttccttttggcaaataaagcctcctatagaac

SEQ ID NO: 1040 - DNA, 2027 bp, Saccharum officinarum
  misc_feature (9)..(9): n is a, c, g, or t
  misc_feature (47)..(47): n is a, c, g, or t
  misc_feature (590)..(590): n is a, c, g, or t
  misc_feature (616)..(616): n is a, c, g, or t
  misc_feature (619)..(619): n is a, c, g, or t
  misc_feature (642)..(642): n is a, c, g, or t
  misc_feature (648)..(648): n is a, c, g, or t
  misc_feature (706)..(706): n is a, c, g, or t
  misc_feature (808)..(808): n is a, c, g, or t
  misc_feature (810)..(810): n is a, c, g, or t
  misc_feature (876)..(876): n is a, c, g, or t
  misc_feature (890)..(890): n is a, c, g, or t
  misc_feature (892)..(892): n is a, c, g, or t
  misc_feature (922)..(922): n is a, c, g, or t
  misc_feature (1001)..(1001): n is a, c, g, or t
  misc_feature (1361)..(1361): n is a, c, g, or t
  misc_feature (1364)..(1364): n is a, c, g, or t
  misc_feature (1398)..(1398): n is a, c, g, or t
  misc_feature (1400)..(1400): n is a, c, g, or t
  misc_feature (1411)..(1411): n is a, c, g, or t
  misc_feature (1439)..(1439): n is a, c, g, or t
  misc_feature (1444)..(1444): n is a, c, g, or t
  misc_feature (1451)..(1451): n is a, c, g, or t
  misc_feature (1478)..(1478): n is a, c, g, or t
  misc_feature (1481)..(1482): n is a, c, g, or t
  misc_feature (1490)..(1490): n is a, c, g, or t
  misc_feature (1495)..(1495): n is a, c, g, or t
tctttgtcntatccgttgctcgcaaaacgcccccacgccccacacgncgccgccggcgacgaccgttgcgacggggaggaagcagccacgccaccaccgtctcggcgcctcaccgcctctccgatctcgaacgcgatccgtctcctccctgcgggggccgctcgggagtcgtcctaccctacctaggggctccgtgtcagatccgggagggcgggcgccccatggtggtggctctggcgccgttggtccgcgagatctagggttgtcgagccgagcgccgcggagtgggagcggaaggatggggcgccggaagatgtccgcggcggcgccgccgtcccggagctggtccaacgtcggcgggagcgtcatccccgaactccgggcaaaacacaaaatggacttggagaatttgacgctgacaaaacaaccactcagaacattacatcttttcctgttagccgtattacaatacttgaaaagattagcaaaatatatcctgagcaagggtggtttgttctttctcttaattgttttggtggtagctcctggaatcttactcgctatttcagatggcgtgcataagaaggagnttcttaattatgctaaatttgtgtgnggngggtttcattaggtgtggcttcntcaatnggactaggttctggtttgcatacatttgtgctgtatctaggtcctcatattgctctgntcactattaaagctgttcagtgtggtcgaattgatttgaaatggctccatatgataccatacagcttaaggttgggccgtcatggcttgacaagaaatgttnanaatttggaccgcctgtgtatccagcatcagctcattctgttaggatcccagtctttgacttactanctcagatacagctngnagcagttctttgggcattgggactgcactnggcgagcttccccctttttatatcacgagcagctcgcttatcaggaagcaagtcaaaagctgttaaggagcttgatgcngctacttccaaagaagatgggacagtagcatccactcttaatcgtaccaagcgttggcttctttctcactctcaacatctcaacttcttctctatcttgatacttgcttcggttccgaacccactctttgaccttgctggtattatgtgtggccaatttggtgtacctttctgggagttcttttttgcaactttgattgggaaggccatcatcaagactcatattcagacactgtctattgtgtccttatgcaacaaccagctcctgtatcttatggaaaaggagtcaatctggatatttggtcacattcctgggttttctgctaccctgccatctgtgattgccaaactcaatgctgcnaangacaagtatctatcaccaccaacaccagtctcancntcctcacaaanggaggagaaacagtggaatttctctttnacatnggtttgnaactctatagtgtggcttgtgcttctnaanntcttcatnagatnatcacgtcaacagcacaggattatctcaaaaagcagcaggatatggagatggaacgtgtttctgattccccgaccctggaacaaaactaactactggtgcaactagtggtgtttatttcagctgctagctgcaaagattctcctctgtagccttaacaactggctaagctcctgcagatgattccaagttccaacaattatcaattagtattagtaattcatctgtacagtcaacgaaaacatgggcttggtaactggccgggtgatggctgtgatcttctgccattgagcctgtcctggcagttcctggaggagaatcattctattcttttttcggacatctacacggatagacagtagggattgtttatgaagcacggttgacttttgctgagatttagcactcatagctgtttctatttatttttggaattcctatagaaacatgtaaggattcaacgatgatacgctctgttgtcaagtttactgtgtatttggtttgcaattggtgcccagaaagagcaaacaagag

SEQ ID NO: 1041 - DNA, 1794 bp, Panicum virgatum
tcgctaagccctcggagctgcgattcagatccgggcgggggacgccctatggtggttatggtgccgttgaaccgcgggatctaggtttttcgcgcgccgcggagtgggagcgatggggcgccggaagatgtcagcggcggcgccgccgtctcggagctggtccaacgtgggaggaagcgtcatccccgaacttcgagtgaaacacaaaatggagttggaaaacttgacactgacaaaacagccactcagaacattacacttttttctgatggccttgttacaatacttgaaaagattagcaacatatatcctgagtaagagtggcttgtttgttctcctacttgttctggtggtagctcctggaatcttccttgttgtttcagatggcctgcacaagaagcatgtgcaggagttcattaactatgcaaaatttgtgttatggtgggtgtcattaggtgtggcttcatcaatcggactaggttctggtttgcatacatttgtgctgtatctgggccctcatattgctctgttcactattaaagctgttcaatgtggccgaattgatttgaaaatggctccatatgacaccatacagctaaaagctgggccatcatggcttgacaagaaatgttcagaatttggaccacctgtgtacccagcatcagctcattcagttaggatcccagtcttcgacttgctacctcagatacagctggaagcagttctttggggcattgggactgcacttggcgagcttcccccttatttcatatcacgtgcagctcgcctatcaggaagtgagtcaaaagcagtcaaggagcttgatgctgctacttccaaagaagatggccgagtagcatccactcttaatcgaaccaagcgttggcttctttctcactctcaacatctgaacttcttctctatcttgatacttgcttcggttccaaacccactctttgaccttgctggtattatgtgtgggcaatttggtgtgcccttctgggagttcttttttgcaactttgattgggaaggctatcatcaagactcatattcagactctctttattgtgtccttgtgcaacaatcagctcttgtatcttatcgagaaggaattaatctggatatttggtcacattcctgggttttctgccaccctgccatctgtgattgccaaactccatgctgcaaaggacaagtatctgtcgccaccagcagcagtctcatcctcctcacaaatggaggacaaacagtggaatttctcttttacatttgtctggaactctatagtgtggtttgtgcttctgaacttcttcattaagataatcacgtcaacagcacaggattatctcaaaaaacaacaggacatggagatggaacttgtctccgattccaagactaactagtggtgcaactggtggtgtttattcagctgctagctgcgaagatgctcctctgtagccttactcctgtctaagcccttgcagatgataccaagttgcaacactcaattggtagtagttagtcatctgtatagtgaacagagacatgggcttggttaacttgccaggtgatggctgcgaccttttgtcattgaacctgtactggcttctcccggaggagaatcgtcctgttatttgtcggacaccaacacggataaaatagtagtaggaattgtttatgaagcacgattgctttgccgagatgtatcgctggaacctgtttcaatttattttggaaatgtaatagaaactttggaggaatcaacgatgatattttccattaagcttactcc

SEQ ID NO: 1042 - DNA, 1562 bp, Sorghum bicolor
acgaagcgaactcacgagctcccgccaaattaatctccttcattcatccatccatatatacgaacgtcgaggcagaagaggacggagagctagcgtcgatccatctcgatcgatcaccgatcgattgagttgttcgtcgcatgcactgccgcagggtcctcttcctcgacgcgacgaactatataagctaggcagggcttgctccatctccatccggcgtgtgtgcaccatgctgcggtccaccggcgaccgcgtcgtcatcgttggcggcggcatcgccggcgccctcctcgccaagaccctccagaaccacgccgacgtcgtcctcatcgacccgaaggagtacttcgagatcccgtgggcgaacctgcgcgccacggtggacccggcggcggtggagcgcacggtgatcccgcactcggactacctgacgcacgccaaggtggtgaccgcgttcgccgtcggcgtggacgactccgtggtgctcacctccatcggccgcgccgtcgcctacgacttcctggtgatcgcgacggggcgcacctgcaaccgtccccagaagcagtcggagcggctggagatgttccagcgcgacaaggagcggatcgacgcggcggcctccgtgctgatcatcggcggcggtcccatcggcgtggagctggcggcggagatcgtgatgaagagccccgagaagcgcgtcaccgtcgtccacggcgcgccgcggctgctcaaggtgatgggcgccagggcgtcggccaaggcgctggagtggctgcggtccaagaacgtcaccgtgctgctggaccagacggtggacctggcgtcggcggcgccggacacccgggagttcacgacgtcggcgggggagacggtggaggcggactgccacttcgtgtgcacgggccggcccgtggcgtcccggtggctcagcgggacgatcctcggggagcacgtggacgaggaaggacacctccgggtggacgaccacctccgcgtcggcgggctgcggaacgtgttcgccgtcggcgacatcacggacgtcccggaggcgaagcaggggcacctcgcgcagcggcaggcaatggtggtgtcccggaacctccggctgctggtgaagcagggcgccacccgggaggagaagctgcaccggtacaagccgtcgccgaggacgtccatgacggtgacgctgggacaccgcgacgcgctggcggagctgccgttcatgacgctcatcgggcacatccccggcgccgtcaagccgcgggaccacttcatcaccaggacgcgcaggatgatggggatcaggagcaaaccctacggcacgatgccgcacgtcatgtgatccgatcgatcgacgtcctcggtccagagatccttccgtacggcgagtggtgcaccgatcgatgagcacatggaatggaactagctaggctctctgaattttttgccacgttctagctagaatcgtttgatctgatcgcacgagtatggacacatgcatgttgtatgtatgatacaggtacattaccggaaagtacttttaaatactccctctattcgaa

SEQ ID NO: 1043 - DNA, 1537 bp, Brachypodium distachyon
ccaaaaccgagagctccgcacgcagaccatcacggttttctttacagccgtgccccttcttcccccttccacccgcgcggagcagatcttttctccccccggtccggccccgcgcccgatcacgtcagtcaccgatccggcgtgggggcgacccgaggacgatggagagctccggcggggcaccaccagcggaggagcggcggctgttggcggcgtcgctgacggcgcggtactcggactgggtgctggaggagctggacgagctcccggggagcttcctgctcacggacccggccatgtcgggccaccccatcgtctacgcctccagggggctcgcctccctcacggggtaccggccccgcgacgtgctcggccgcaacgcgcgcctcttccagggcgccgccaccgaccgcgccgcggtcgccggtgtccgcgacgccgtgcggtgccagcgcgcgcaccaggtcgccatcctcaactaccgccgcgacggcgcgccgcactgggtgctgctccacgtcgcgcccgtcttccacgcccacgacggcagggtgctccacttcctcgccgtccaggtgcccatcgccgccgcgccgcgccgccgcgctgctccgtgccgacggccgcccgtgttcgcggcgtgccgggaggaggccagggtggaggaggagctgccttgcgcgagccacgcaggggaggcgtttgttgatatcgataagagaggtctggagacaaccagatggttggaagctggggaaccgcgtgtggctagcggttgtgacaaagagaaggctctgagcacagctaacagcatcttttctgcactgaatcgctatagcaaactaactggtttggtggtttgtggaaagagatgtgattctgctggtatcccagcactcagctcttccttaaatctctctctcggtagaatcaaacaaagctttgtattgactgaccgccatttgcctgacatgcctgtagtctatgctagtgatgcttttctatcattaacaggttactcgagagaagaaatattgggctgtaactgcagattcttaaatggtccaggaaccagtctggaggttttagaggagatcaatcggaacatttgctgtgagcaggcttgcacagtgcatctactgaactacaggaaagatgggctcgcgttccctgatctgctacatgtatctccgatccgaaatgcatcgggcaaggtcgcatttcatgtctgggttcacctggatgagagcatcaagcatgatttcaatgggctgagccccgaggtatggcagctgggtgctgttggtgcggtgagagttgcagtcagaagcttgtccgcgtcaggtagcctgttgagaccgtcccaatagcgttgtttttcctgtttccttccgattttgggacattccagttgctaatgtttgtatgtaaagtagttgctcggtgaataatattttagtgcatatcacagtaacaatggcgggtcaatacatgttgcgattgtgtaaaatgcaaaatgaaggaaaatggggggagg

SEQ ID NO: 1044 - DNA, 1285 bp, Pseudoroegneria spicata
cttttctcctcctcccccgcgccccgcgccgatcacgccaccgatccggcgcacccttcaccctttccagcggggcgatggagggggaggagcggcggctcgcggcgtccctcacggcgcggtactcggagtgggtgctggaggagctggacgagctgcaggggagcttcctgctcacggacccggccatgccgggccaccccatcgtctacgcctcccggggcctcgccgcgctcacgggctacccgcgccgcgaggtgctcggccgcaacgcgcgcctcttccagggcgccgccaccgaccgcgccgccgtctccggagtgcgcgaggccgtgcgcgctcagcgcgcccaccaggtcgccatcctcaactaccgccgcgacggctcgccccactgggtgctgctccacctcgcgcccgtcttccacgccgccgacgggcgggtgctccacttcctcgccgtccaggtgcccatagccgcgtcgccccgccgtcacccgggtcggcccgcggcgttcgcggcctgccgggaggaggctaggggggaggaggagttgccttgcgccagccacgtaggggaggtgtttgtggatatcgataagagagggttggaggccgaggaaccgcgtgtagctagcggttgtgacaaagagatggctgtaaccacagcgaacagcatcttctctacactgaaccgctatagcaaagtaactggtttggtggtttgcgagaagagatgtgattctgttggtatcccagcactcagctcttccttaaatctctctctcgaactgaccgccatttgcctgacatgccgatagtctatgctagtgatgcttttctatcattaacaggttactcaagagaagaaatattgggctgtaactgcagattcttaaacggtccaggtactagtgtggatgttttagaggagataaatcggcatatctgtcgtgaggtggcttgcacagtgcatttactgaattacaggaaagatggaagcgcattccgtgatctgctacatgtgtctcctatccgaaattcatcgggcaaggtcgcgtttcatgtgtgggttcaccttgacgagagcgtgaagcatgattttagtgggctgacccctgaggtatggcagctcggtgctgttggtgctgtaagagttgcagttagaagcctgtctgcgtcaggtagcctgttgagaccgtcccaatagcgtttttccggtttctttctgattttgtgttacgttgacttgccaatgtttgtatgtaaagtaactgcttagtga

SEQ ID NO: 1045 - DNA, 1745 bp, Brachypodium distachyon
gtctccagttcaccaccgccttgacccgccgcccgcgtcgccattccttcccctcctcctcctcctccgcacagcttccgtgcttctctccagcttgccagaggggcgggcagctgccggccgggaagaacaagaagcggccggcgagacaaggccgcctcaattcgtgccggcgagcgagggggaaggcaactataagccggagcagagcacggcgcgcagcgtccacgagagagaccgatgggggtgacaggtaggccgtccgcggcggcagtcctgctcgccggagcggtcgcctgctgcgcggccctcgccgtggccgctcagacgcagcagcagcagcagcggaagcatgtcaggatctcaggaaatgctggcgacgtgctcgaagacaacccagtagggaaactcaaggtgttcgtctacgagatgccgaggaagtacaaccagtacctgctggagaaggacaacaggtgcctgtaccacatgtttgcggccgagatcttcatgcaccagttcctgctggcgagcgcggtgcggacgatggaccccgaggaggccgactggttctacacgccggtgtacacgacgtgcgacctcacgcagcagggcttccctctgccgttcagggctccccggatgatgaggagtgccgtgcagtacatcgcggcgacgtggccttactggaacaggactgaaggggcagaccacttcttccttgctccccatgactttggggcatgcttccactaccaggaggagagggcaattgagagggggatcctgccggtgcttcggcgtgcgacgctggttcagacattcgggcagaggaaccatgtgtgcatgcaggaagggtccataaccatccctccctacgccaacccgcagaagatgcaggctcacctcatctcccctggcacgcctcgctccatctttgcctacttccgcggcctcttctacgacatgggcaacgaccccgaaggcggctactacgccaggggcgcgcgggcgtcggtgtgggagaacttcaaggacaaccctttgttcgacatgtcgacggagcacccgtcgacgtactacgaggacatgcagcgcgccatcttctgcctgtgcccgctggggtgggcgccctggagcccccggctcgtggaggccgtggtgttcgggtgcatcccggtgatcatcgccgacgacatcgttctccccttcgcggacgccatcccctgggaccagatcagcgtcttcgtgcccgaggccgacgtgccgcggctcgactccatcctggcatccgtgccgcccgaggacgtgctccggaagcagcgcctgctggccagcccggccatgaagcaggccgtgctgttccaccagccggcgcagccacgggacgcctttgatcaggtgctcaacgggctcgcccgcaagctgccgcaccgggaaggggtgttcctgaggccgggacagaaggtgatcgactggaacgccggccagtacgatgatctcaagccttggtagtaggatttgtgtgtacattttttgtttttttttgggcagacctcacgcacgcacgcactgtttttcttcttcttttctgttcatgtcacttgtggccttgcctgtatgcagcagcgaccgaccgatagagagatgtgtgatttgtttgtacaagcctcgtcgtgctggatggatcccccatttttttttaatttccgtctgctgcagcaacgaacttctgacggttctgaaag

SEQ ID NO: 1046 - DNA, 1478 bp, Zea mays
ggccgctctctctgccacactcgggtgcctccaccaccaccagtagcagcagcagcaggatcaaaaggccaatgggggcgcacgccaccgcggccgcggccgccgtcctgctcgtcgccacctgcgtcgcggcggcggcggcggcgccgctgcagcagcacgagcccggcaggatctcaggggacgcggtgggcgtgctggacgacgaccccgtggggaagctgaaggtgttcgtgtacgagatgccgcgcaagtacaacaggatgctgctggacaaggacagccggtgcctgcaccacatgttcgcggcggagatcttcatgcaccagttcctgctgtcgagcgcggtgcggacgctggacccggaggaggccgactggttctacacgcccgcgtacaccacctgcgacctcacgccgcagggcttcccgctgccgttccgggcgccgcggatcatgcgcagcgccatccgctacgtggccaccacgtggcccttctggaaccgcaccgacggcgccgaccacttcttcctcacgccgcacgacttcggcgcctgcttccactaccaggaggagcgcgccatggagcggggcatcctgccgctgctccgccgcgccacgctggtgcagacgttcggccagcgcaaccacgtgtgcctgcaggacggctccatcaccgtcccgccctacgccgacccgggcaagatgcaggcgcacctcatcagccccggcacgccgcgctccatcttcgtctacttcaggggcctcttctacgacatgggcaacgaccccgagggcggctactacgccaggggcgctcgcgcgtcggtgtgggagaacttcaaggacaacccgctgttcgacatctcgacggagcacccgtcgacgtactacgaggacatgcagcgcgccatcttctgcctgtgcccgctggggtgggcgccctggagcccccggctggtggaggcggtggtgttcgggtgcatccccgtcatcatcgccgacgacatcgtgctgccgttcgcggacgccatcccctgggaggacatcagcgtgttcgtggcggagcgggacgtgccgcgcctcgactccatcctcacctccatcccgctgcccgacatcctgcggaggcagcgcctgctggcgcgggactccgtcaagcaggcgctgctgttccaccagcccgccaggcccggggacgccttccaccaggtgctcaacgggctggcgcggaagctgccgcacggcgagggcgtgttcctgcagcccggggagaaggcgctcgactgggacgccggactccagagcgacctcaagccctggtagtggactggactcgttgtacatctcttcgtgttcctttgtactctttcatttgacatgacatcgatggatggatggatcacgcattagtttttgtaccacggcccgtttacatgcagcagcaatatactaatatatagtgtattttccctgctc

SEQ ID NO: 1047 - DNA, 1553 bp, Sorghum bicolor
cagcagcaggatcaagcgcaatggggccgtgcgtcgccgccgtggtcgctattctgctcgtcgccacctgcgtcgcggcggcgccgccgcagcagcagccgcgcaagcccggcaggatctcagggaacgcggtgggcgtgctggacgacgaccccgtggggaagctgaaggtgttcgtgtacgagatgccgcgcaagtacaacaagatgctgctggacaaggacagccgttgcctgcaccacatgttcgccgcggagatcttcatgcaccagttcctgctgtcgagcgcggtgcggacgctggaccccgaggaggccgactggttctacacgcccgtgtacacgacctgcgacctgacgccgcagggcttcccgctgccgttccgcgcgccgcggatcatgcggagcgcgatccggtacgtggcgacgacgtggccgttctggaaccggacggacggcgcggaccacttcttcctcaccccgcacgacttcggcgcgtgcttccactaccaggaggagcgcgccatggagcgcggcatcctgccgctgctccgtcgcgccacgctggtgcagacgttcgggcagcggaaccacgtgtgcctccaggacgggtccatcacggtgccaccctacgccgacccgcacaagatgcaggcgcacctcatcagccccggcacgccgcgctccatcttcgtctacttccgcggcctcttctacgacatgggcaacgaccccgaaggcgggtactacgccaggggcgcgcgcgcgtcggtgtgggagaacttcaaggacaacccgctgttcgacatctcgacggagcacccctacacgtactacgaggacatgcagcgggccatcttctgcctgtgcccgctggggtgggcgccgtggagccccaggctggtggaggcggtggtgttcgggtgcatccccgtcatcatcgccgacgacatcgtgctgccgttcgccgacgccatcccctgggaggacatcagcgtgttcgtggcggagcgggacgtgccgaggctcgactccatcctcacctccatcccgctcgccgacatcctgcggaggcagcgcctgctggccagggaatccgtcaagcaggcgctgctgttccaccagccggcaaggacaggggacgccttccaccaggtgctcaatgggctggcgcgcaagctgccgcacggcgacggcgtgttcctgcagcccggggagaaggtgctcgactgggacgccggactcgacagcgacctcaagccctggtagtactagtactagtgtaccacttgttgtgcaatctgttcatgttcgtttcttctctttgatttgacatcggtggatggatgggtgtatcacgcattagtttttgtaccacggcccgtttacatgcataacagcagcagtataatatagagggtatattcgtcgggagatgtcaagttcagattaacgtatagtgatcgctactatgcaagtacatcaatgattcaaatgtgacgtgatttcgcatttgtaataaatcgagctgaattaattaactgttacgatccc

SEQ ID NO: 1048 - DNA, 1449 bp, Panicum virgatum
gccgttattctgctcgtcgcctcctgcgtcgccgcggcgccgctgcagcagcaccagcgcgccaggatcacaggggacgccggcggcgtgctggacgacaacccggtggggaagctgaaggtgttcgtgtacgagatgccgcgcaagtacaaccagatgctgctgtccaaggacagccggtgcctgcaccacatgttcgcggccgagatcttcatgcaccagttcctgctgtccagcgcggtgcggacgctggacccggaggaggccgactggttctacacccccgtgtacaccacctgcgacctcacgccgcagggcttccccctcccgttccgggcgccgcggatcatgcgcagcgccgtcaagtacgtcgccaccacgtggccctactggaacaggaccgagggcgccgaccacttcttcctaacaccccacgacttcggcgcctgcttccactaccaggaggagagggcgatggagaggggcatcctgccgctgctccggcgcgcgacgctggtgcagacgttcgggcagcggaaccacgtgtgcctgcaggaggggtccatcaccatcccgccctacgccaacccgcacaagatgcaggcgcacctcatcaaccccggcacgccgcgctccatcttcgtctacttccgcggcctcttctacgacatgggcaacgaccccgagggtggctactacgccaggggcgcgcgcgcgtcagtgtgggagaacttcaaggacaacccgctgttcgacatttcgacggagcacccgtcaacgtactacgaggacatgcagcgcgccatcttctgcctgtgcccgctggggtgggcgccgtggagcccgcggctggtggaggcggtggtgttcggttgcatcccggtgatcatcgccgacgacatcgtactgcccttcgcggacgccatcccctgggagcagatcagcgtgttcgtggcggagcgcgacgtgccgcgcctcgactccattctcacctccatcccgctccaggacatcctcaggaagcagcgcctgctcgccggcgcgtccgtcaagcaggcgctgctcttccaccagcccgcaaggcccggggacgccttcgaccagatactcaacgggctggcgcgcaagctgccgcacggcaagggcgtgttcctccagcccggggagaaggtgctcgactgggacgctgggctcgagagcgacctcaagccttggtaggcgcagcagcgcctgccttcacatttgttcatgttcttttgttttgttcttttatttaaatctttcgatcgatggatggatggatcacgcattagtttttgcacgaccagtttacacgcagcagcaatatagagcgagatttctcgggatatttgtgagaggcagcccttgtgtgatttaaatttagtgttcactacatcgatggttgccatgtgttttatttagcgtatg

SEQ ID NO: 1049 - DNA, 1491 bp, Leymus cinereus x Leymus triticoides
  misc_feature (1440)..(1440): n is a, c, g, or t
ctccgcagtccgcaccacaccaaccagcagcactggtctcctagctagtgccggccactcgagcgagcaaggcgcagtacgtagccgctgcttctgtcggcggcaggtaggtagcgccgtgcgtgcgtgagtgcgtgtgttggttggccggcgaggatgatgaagacggtggcggtggcggtggccgtgctgctcgcggtggcggtggcggcggaggcgagcgagctcaaggcggggtactacgacaagagctgccggggcgtggagaacgtggtgaagtggcacgtcgccaaggccatcaaggccaaccgcaagagcggcgccgccctcgtccgcctcatcttccacgactgcttcgtcaggggttgtgacgcctcggtgctgctggacccgacaccggagaacccgaacacggagaagacggcgccgatcaacatcggcctggccgccttcgatctgctcgacgatatcaagtcggcggtggaggaccggtgccccggcatcgtctcctgcgcagacatcctcatcttcgccgcccgcgacgccgccagcctgctgagcaacggccacgtccacttcgacgccctggcgggccgcctggacggcgtgcactcccacgcggcggaggcgcagcaggacctccccgactccaccttcaccatctccgagctcatccagaacttcaagcgcaagaacttcacaatcgaggagctggtgatcctgtccggcgcgcacgccgtgggcgtgggccactgctcgtcgctccgtgcccggctcaccgcccccgccgagcagatcctcccggcctaccgcggcctcctcgccgggaagtgcgccaagggcccggaccccatcgtgccgaacaacatcagggacgaggacgccggcgcggtggcggcgaccatcccggggttcctcccgaagctgaggaaggtgaaggacttcctggacaacagctactaccacaacaacctggcgaggatcgtcaccttcaactccgactggcagctgatgacggagaaggaggcgcggggccacgtgcacgagtacgccgacaacggcacgctgtgggacgaggacttctccgactcgctcgtcaagctcagcaagctgcccatgccgcacggcagcaaaggcgagatcaggaagcagtgccgcttcgtcaaccactactaagcttttcgagttgccatcgctgacgttttccatgggttgaattgcattgcatcgatcggtcacgtttgattattcgtttgttgttatgttttatttttatttttttcttgttcgatttgtgggattgatttgtggacaaatgtgcgcatgcgcctgcgtgcgatctgtgtagattttccccccgtaagtgttgtgccttttgatccaatgctcatgtaataataagggtaaaagaagataatgaagtaaattacgtagtagtanaattgcccctagtttgccctgttcttcgaagaaaggaatgttggtcgttca

SEQ ID NO: 1050 - DNA, 1776 bp, Oryza sativa; identical to SEQ ID NO: 79

SEQ ID NO: 1051 - DNA, 1524 bp, Triticum aestivum
cactccgcagcccgcaccacaccaaccagcagcactgctctcctagctagtgccggccactcgagcgagcaaagccgctgcttctgtcggcggcaggtaggtggcgccgtgcgtgcgtgagctggtcggccggcgaggatgatgaggacggtggcggcggtggcggtggccgtgctgctggcggcggcggtggcggcggaggcgagcgagctcaaggtggggtactacgacaagagctgccggggcgtggagaacgtggtgaagtggcacgtcgccagggccatcaaggccaaccgcaagagcggcgccgccctcgtccgcctcatcttccacgactgcttcgtcaggggctgtgacgcgtcggtgctgctggacccgacgccggagaacccgcacacggagaagacggcgccgatcaacatcggcctggccgccttcgacctgctcgacgacatcaaggcggcggtggaggaccggtgccccggcgtcgtctcctgcgcggacatcctcatcttcgccgcccgcgacgccgccagcctgctgagcaacggccacgtccacttcgacgccctggcggggcgcctggacggcgtgcactcccacgcggcggaggcgcagcaggacctcccggactccaccttcaccatcgccgagctcatccagaacttcaagcgcaagaacttcaccatcgaggagctggtgatcctgtccggcgcgcacgccgtgggcgtgggccactgctcgtcgctccgcgcccggctcacggcccccgccgaccagatcctcccggcctaccggggcctcctcgccgggaagtgcgccaagggcccggaccccatcgtgcccaacaacatcagggacgaggacgccggcgcggtggcggccgccatcccggggttcctcccgaagctgaggaaggtcaaggacttcctggacaacagctactaccacaacaacctggcgaggatcgtcaccttcaactccgactggcagctgctgacggagaaggaggcgcggggccacgtgcacgagtacgccgacaacggcacgctgtgggacgaggacttctccgactcgctcgtcaagctcagcaagctgcccatgccgcacggcagcaagggcgagatcaggaagatgtgccgcttcgtcaaccaccactgatgctttctccaaattcctaccgctgacgttcttcatgtgttaaatttgcatcaatcgatcgggtttgattattcgtttgttgttatgttttattttcatttttttttccttcttcgatttgtgggattgatttgtggacaaatgtgcgcatgcgcctgcgtgcgaactgtgtagatttttttcccgtcaagtgttgtgccttttggccggcttggataccatccatcaaaggcatccaatgctcatgtaataataagggtaaaaggtgatgatcaagtaaattgcgtagtagtacaattgtccctatagtttgccatgttctttggcgaaaagaatgttggtcgttccaaaaaaaaaacaaca

SEQ ID NO: 1052 - DNA, 2055 bp, Aquilegia formosa
ggatgacttagtattactcttcttcttcttcttcttcttcttcttcaactagtcgtctctctctctttctttacttgtttcttcaaacagagctaaaactactatttcttatcgattttatttgtaatcgatcgcttattagctttgattagtcttagtttcagcttagatcatcgaaatcgtacagtgaaaaccctttcgattaaggggtttttgttttgtgttctgtggaaaattagctgtgatgtatttggtttggtgttctagtcttgattagaacaccgttgttgaataaggacataagagctttaaaatttgggggaacctttgttgattgtattggaacatcatttggtttcaatgatggttgagggtccaaagtttacaggaattataggcaacgccaacaacgggaacaatttctacgattttactcaagggttttatcaaaaactcggagagggttctaacatgtcaatcgatagtatggggagcttgcagaccagtaatggtgggggatctatctccatgtctgtagacaacagcagtgttggatccaacgattcccatactcatattttaaaccaccctggacttcggccagttcataataacaactctgtaggtcacagtgtgcttcgtcctgggagggtttcacatgctttgagtgatgatgcactggctcaagctctaatggatagtagatttcccactgaaggacttcaaaattttgatgagtggacaattgatttgaggaaacttaatatgggaatggctttcgcccagggagcttttggaaagctatacaaagggacatacaatggagaggatgttgctataaagatactggaaaggcctgaaaatagccctgagaaagcacaactaatggaacagcagttccaacaagaagtcatgatgcttgctactctaaaacaccctaacatagttcgtttcatagggggttgtcgtaagcccatggtttggtgcattgtcacagagtatgcaaagggtggatcagttcgccagttcttacaaaggcgccagaatcgatcagtgccattgaaattagctgtcaagcaggccttggacgttgctagggggatggcttatgtacatggtcttggattcatccacagggatctgaagtctgataatcttttgatctttggggacaagtcaataaagattgcagatttcggggttgcacggatagaggttcagactgaggggatgacaccagagacgggaacatatcgctggatggccccagagatgattcagcataggccttacacacagaaggttgatgtttacagctttgggattgtactgtgggagctcattacaggcatgcttccctttcagaatatgaccgctgtgcaggcagcctttgcggttgtgaacaaaggtgtcaggcctattattcccaatgactgccttcctgttctcaatgagatcatgactcgctgctgggatgccaacccggaggttcgtccacctttctctgaagttgttcgaatgcttgagcatgcggaggctgaggttatgagtacagttcggaaggcccgtttcaggtgttgcattacccaaccgatgactgttgactaagtcagagaagaaagaataaaaagaaaatgaaagtgagaaaaaatgaaaaggaggggggaaagagggaacaagaagcagaggaaggtgattctatctgcccttgtgtatctattaatattttcctttttcagataggaagaaagcttgcatctggtatctgagtggtctctggtttctgttttctggactactgttgttgaagtaattgtagggatccttaccactgttacatatggaccttcccttttattaacttatttgcccaaaagtagctatatcaattggatcgatatggctttctagtgttttttttagtttgttttccctctgttcttgtttttagtttgtattccctccgtccttatttttagtttgtattccctctgttgttgtttaagcatttcttttctggtaattagatattacagcatgttttatgattctccc

SEQ ID NO: 1053 - DNA, 1772 bp, Hordeum vulgare
cggcacgaggctctctcgcttttgataatttctatcttctctctccgaataatcccccccccccccccaccctgcccctcatcccgacgccgcggctccgggggctcccgatcgaggccctgatcgccggaatccgtgcggcgccgagaagcagcgagttgtacttccgggcccgaaaagcgggcagtttcggggtaaatagcctttgggtggactgtgtgagggagaaaggaagagcggaaaggttgcgggagctcaggctttggttatctgagaatgatggaatcggccaagttccccgggatcattagtgccgtaagcggccaggacggtggcgtcaacttctgtgacatggcatactaccagaagctaggggagggctccaccatgtccattgatagccttaacagcatgcaaaccagcatgcacggtggttccataatgtctgtggacaacagtagtgttggttctactgactcgcgtactgggatgcttaaccatcctagccacaggggacctgttgctgtggtcagctactcggttgggaacagcattttccgtcctgggcgcgtgtctcatgctttgagtgatgatgcgttggcacaggctttgatggacactagattcccgactgagacactcaaggattatgaggagtggaccattgatttggggaagctccacatgggattgccctttgcacaaggcgcatttgggaagctatacagggggacctacaatgggatggatgttgccattaagcttttggagaggcccgaggccgaccccccacaagctcagctgctggagcaacagtttgtgcaagaagttaggatgcttgcagagttaaggcatccaaatatagttaagtttgttggcgcatgcaggaagccaatagtttggtgcattgtcacagggtatgcaaagggtggatctgttaggaatttcctgaataggaggcagaacaggtctgttccactgaagctggcagtgaagcaggcactagatgttgcacgtggcatggcttatgttcatggccttgggttcatccacagagatctcaagtcagataacctcttgatttctggtgataaatcgatcaagattgctgacttcggagttgctaggattgaagtgaagaccgaggggatgacacctgaaacaggaacatatcgttggatggctcctgagatgatccagcacagaccatacaatcagaaagtagatgtctacagttttggcatcgtcctgtgggagctaataactgggacccttccttttccaaacatgacagcagtgcaagctgcatttgctgtggtgaacaagggtgtccgcccagccataccccatgactgcctccctgcccttggggagatcatgacgaggtgctgggatgcaaaccccgatgtccgcccccctttcactgatgttgcgaggatgctggagcgtgtggagattgaggtcctgaacaatgttcgcaaggccagattccggtgttgcatctcccaacccatgaccttagactaaggcaggcagaattcaaaagaaaagaaagcaatttggagagaagttaaatcccatgtatttattatattaatacttttgatacagaagcagaaaagcccgcctgagcatacgtgtgtgctcgggcttcacatatttatcttagaccataccatagtccccgtcctcgtcttaaaactgtcattgtactagaaacagttttatccttaacattgccaaaacatcgtcatgaggtttcctctggttgc

SEQ ID NO: 1054 - DNA, 1869 bp, Brachypodium distachyon
cccccccccgcagccgcctccctccgccgcggctccgcgcgcgcgccgatcgacccccggatcgacggaacccgcgcggcggcgaggctccaactggacgcagcaaggtaatcgcctttcggggaaactgtgtgagggagcacgggaagagagtgaagaggctgcggaaactgagggtttggttatccgaagatgatggacggcgccaaattccctgggatcattggcgccgtgggtggtggccatgacgggggcgtcaacttctgtgacatggcctactaccagaagctgggggagggctccaccatgtccattgatagcatgaacagcatgcagaccagcatgcatggtggttccataatgtcggtggacaacagcagcgttggttctaccgactcccgaactgggatgcttaaccatcctggtctcagggggcctgttgctgtggccagctactcggttgggaacagcattttccgtcctgggcgtgtgtcgcatgccttgagtgatgacgcactggcacaggctttgatggacactagattcccgaccgagacgctcaaggattatgaggagtggaccattgatttggggaagctccacatggggatgccctttgcacaaggtgcctttgggaaactctacaggggaacctacaacggaatggatgttgccattaagcttttggagaggccggaggctgcccctgtgcaagctcagctgttggagcagcaatttgtgcaagaagttatgatgcttgcaacattaaggcatccaaatatagtcaagttcattggcgcgtgcaggaagccaatggtctggtgtattgtcacagagtatgcaaagggtggatctgttcggaatttcttgaccaggaggcagaacagatctgttccactgaagctggcagtgaagcaggcactagatgttgcacgtggcatggcatatgttcatggccttgggttcatccacagagatctgaagtcagacaacctcttgatttctggtgataaatctatcaagattgcagacttcggagttgctaggattgaagtaaagaccgaggggatgacacctgaaacgggaacataccgttggatggctcctgagatgatccagcacagaccatacaaccagaaagttgacgtgtacagtttcggcattgtgctgtgggagctaattaccgggacccttccttttgcaaaaatgacggcagtgcaagctgcatttgctgtggtgaacaagggcgtccgcccaacaataccccatgactgcctcccagcccttggggagatcatgaccaggtgctgggatgcaaatcccgacgtccgtcctccgttcaccgatgttgtcaggatgctggagcatgtggagatggaggtccttacttctgtccgcagggccagattccggtgttgcatctcccaaccgatgacactggactgaaccaggcgaaatccagaagaagaaagcaacctggagagaagttgaagtccttgtatttatcatattaatagacttgtgatgcagcagaagcagaaagcccaccccagcacactgtgtgtgcttgggcgtaatacgatctccctttacgtatttatcttagaccataccctagtctctatcgttgtcgtaaaactgtcagttgtactagagacagctttatccttaacatcttgaaaacatcatgcaggtttccttttgttgtaatgaccggcatacatgttcctgctgccctgtccgtgtgttatccatcctgcaggaacatgagcaagctttgatgcttcatagtatatatagtatgtacaatcacctggtttggttttgtctatgtcagcatcatttaacctagttgtatgcagcacgtca

SEQ ID NO: 1055 - DNA, 2052 bp, Zea mays
caagtttaaaaaacaccgcaattaaccagctcaccctggctaacccaccaccaccaccaccataccaggagagagaaaagagagaggcgcctccactcgtgactcgtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaacgccggaaaccgtgggcttcgcgaggttgcctctcttcgtccaagcggtagataacataacagtgcgacaggtgaattgcagagagaaggggggcatttggtcgctgtatgatggcggaaggccccaatttcgctggcatgattggaggccatgacaatggtggggatttctgcgacatggcatactaccggaagctcggtgagggctcaaacatgtcggtagacaaccttaatagcatgcagaccagcacacatggtggctccattgcaatgtctgtggacaacagcagcgtagggtcctgtgactcccatactaggatgctcaatcaccctggcctcaagggacctgtcgttggcaattactcggtcggcgggcacagcattttccgtcatggacgggtgtctcacgccttgagcgacgatgcgctggcacaggcgttgatggacccaaggtacccgactgagacactcaaggattatgaggagtggacgattgatttagctaagctccacatgggaatgccctttgcacagggcgcctttggaaagctctacaggggtacctacaacggtgaggatgttgccattaagcttttggagaggccagaggcagatccggagagagccgggttaatggaacagcagtttgtgcaagaagttatgatgcttgcaaccttgaggcaccagaatattgttaaatttattggagcatgcaggaagccagtggtttggtgcattgttacggagtatgccaagggcggatcagttaggcagtttctggcaaagaggcagaataggtcagttccactaaaactggcggttaagcaagcactggatgttgcaagggggatggcgtatgttcatggtcttggcttcattcatagggatcttaagtcagataacctcttgatatctggtgataaatctatcaagatagctgactttggagtagctcggattgaagtaaaaactgaggggatgacacctgaaacgggaacctatcgttggatggcaccagagatgattcagcacaggccatatgaccaaaaagttgatgtctacagctttggcattgtgctgtgggagctcataactggcatgctcccttttgctaatatgacagcagtgcaggctgctttcgctgtggtgaacaagggtgtccgcccagctataccccaggactgcctgcccacccttgctgagatcatgaccaggtgctgggatccaaatcctgatgtccgtccgccattcactgaagttgtgaggatgctggagcatgctgagatggagatcctgagcactgtccgcaaggcccgatttcggtgttgcatgtcccaaccgatgactaccgactgaatcaaacaagagagttgaaatgaactccatggaagcgtaattgagtgtatttatcatgtgtccaaacttcgctcagctgaagtagaaagcacacctgagtttatggctgtatgtgtgtatactcaggtgtaagccttgttgtctttgaaatattcctgcacttagaaatatacctagttcgcgttttcagactcttgagatgttttagggctagtctatgtcctgtcgaaacatcatgcagggttcctattcttgtaatgttcttgtgatcctgctactggaatgtgcctcctactggaggtggtctgttcatgttataaccctcctactggaatatgcacaaatacttcgttgcttgagcatatagcatgtataatttcctgacaa

SEQ ID NO: 1056 - DNA, 1918 bp, Zea mays
ccactctcgctttcttctgtctcgcctcgccctcgcctttgttgatcttttcctttctcgcgttcccctcgccttcctcttcctcccccacacccaccggtcgccgcccccgtcgccccgtcctcctcggtccagagacgagggggtccgcgccgttccgacgccacaccgcaaccgcatcacatcacacaccgcctgctcccaccgtccgtccgccctccctcgatcgcgccccccggatcgctggtacctccgcgcgcggctccgacctcatcttcctccatcgactggcatcggcagcggcggcgtgttcccggccagccttcgaaagggtaatcaatcgccagacttttgggagctctgttgggggggaccggggggaagagccaagttactgcagaggctaacatttcggttgtcgagtgatggcgcaaggcatcaacttccctgacttcatcggcgccgtgggtggccatgatggtggtgtggactttggtgggaacttctgtgacatggccttctaccagaagctaggggagggcaccaacatgtcggtcgacagcctcaacagcatgcagaccagcatgcatggggggtccatcgccatgtctgtggacaacaacagcagcgttggctctaacagtgactcccgcactggcatgcttggtcatcctggtctcaaggggcctgccattgtgggaagctactcggttgggcacagcatcttccgccctggccgggtgtcccacgccttgagtgaggatgcgctggcacatgctctgatggacaataagttcccaactgagacactcaaggattatgaggagtggactattgatctggggaagctccacttgggaatgccctttgcacaaggtgcctttgggaagctctacaggggaacatacaatgggatggatgttgctattaagcttttggagcgacctgaggctgaccctgagaaagctcaactgttagagcagcagtttgtccaagaagttatgatgcttgcaacactgaggcacccgaatattgtcaagttcattggtgcgtgcaggaagccgttggtttggtgtattgtgacggagtatgcaaagggtggatctctcaagaatttcttgagcaagaggcagaacaggtctgtcccgctgaagttggcagtcaagcaggcattggatgttgcacgtggcatggcctatgtccatggccttgggttcattcatagagatcttaagtcggacaacctcctgatttctggtgataagtccattaagattgctgactttggagtggctaggattgaagtcaagactgaggggatgacacctgaaactggaacataccgctggatggctcctgaaatgatccagcataggccatacaaccagaaagttgatgtctacagttttgccattgtcctgtgggagttagtgactgggaatgtcccctttgcaaacatgagcgcagtgcaagctgcatttgctgtggttaacaagggcgtgcgaccagccataccccacgactgcctccctgcccttgcggagatcatgaccatgtgctgggacacaaaccctgaagtccgtcccccattcgctgagattgtgaggatgctggagcaggtggaggtggaggttctgaccactgtccgtaaggctcgcttccgctgttgcatcgcccaaccgatgacgctggactgacggactgagtcgtccgcaatccaggaaaagaacctggagaggggtttaatcctatgtgtttataatcccaatagacttgtgcttcagaaacagaaggctgactcctcatctgccttctgtctttgacatgttatcgtagagtacacctagctgtcgtcaccagtggttgtaatagaggtagctttatgcttgactaaatacccttccgttataacaagtgc

SEQ ID NO: 1057 - DNA, 2004 bp, Zea mays
agcccaccggccgtgctaacccccgcacttaccaagagagagaaaaagcgagaggcgactccacgcgtctcgtctcgtctcgtctcgtctccctctctctcgtccggtcctccctccccttcctgaggcgttccctctctctcctcccctttcctctgctggtctctactctcttgtcatcgcacccgtctccccgctctgactccgtcccgagcggccgactccgcccgcgccgccgccgccgccgcctcgtcccgatcgacccccgaatcgccggaaaccgtggacttcgcgaggttgtgtctttacctccgagcggtgtagggaatataacagggtgacagctgaattgcagaaaaaaggaggacatttggttgttgcatgatggtggaaggccccaatttcgctggcctgattggtggtcatgacaatggtgggaatttttgcgacatggcatactaccggaaactcggtgagggctcaaacatgtcgatagatagccttaacagcatgcagaccagcacgcatggcggctccattgcaatgtctgtggacaatagcagtgtagggtcctgcagctcccatactaggatgctcaatcatcctggcctcaagggacctgttgttggcaattactccgtcggtgggcacagtattttccgtcatggacgggtgtctcatgccttgagcgatgatgcgctagcacaggcgttgatggacccaaggtacccgactgagacactcaaagattatgaggagtggacaattgatttagccaagctccacatgggaatgccctttgcacagggcgcctttggaaagctctacaggggtacctacaatggggaagatgttgccattaagcttttggagaggccagaggctgatccagagagagctgggttaatggagcagcagtttgttcaagaagttatgatgcttgcaaccttgaggcaccagaatattgttaaatttattggagcatgcaggaagccagtggtttggtgcattgtgacggagtatgccaagggtggatcagttagacagtttctagcgaagaggcagaataggtcggttccactaaaactggcggttaagcaagcattggatgttgcaagggggatggcctatgttcatggtcttgggttcatccatagggatcttaagtcagataacctcttgatatctggtgataaatctatcaagatagctgactttggagtagctcgcattgaagtaaaaactgaggggatgacacctgaaacgggaacctaccgttggatggcaccagagatgattcagcataggccatatgaccagaaagttgatgtctacagctttggcattgtgctgtgggagctcataactggcatgctcccttttgctaacatgacagcagtgcaagctgcttttgctgtggtgaacaagggtgtccgcccagctataccccaggactgcctgcccaccctcggtgagatcatgaccaggtgctgggatccaaatcctgatgtccgtccgccgttcactgaagttgtgaggatgctggagcatgctgaggtggagatcctgagcactgtccgcaaggcccgatttcggtgttgcatctcccaaccgatgaccaccgactgaatcaaacagaagagagtcgaaaagaactccatgcaagcataattgagtaaatttatcttgtgtccagacttcgctcagctgaagtagaaagcacacctgagtggctgagtgtatggccgtgtgtgtgtatactcaggtgtaagcatattgtctttgaaatattcctgccattagaaatatacctagttcgcggtttcagactcttgagatgttttagggctagcctatgccctgacgaaacatcatgcaggcttcctattcttgtaatgtcgttgtggccctgctgctttgttcatgttataaccctcctactggattatgcaaacactttgttttgttgcttctgagtatatagcatgtataatttccttgcaa

SEQ ID NO: 1058 - DNA, 2087 bp, Oryza sativa
ctcttctttttagcgaagcaaaccctcacctcttctctactctctctctctctctctctctcaagctcggcggaggcggaggcaagcaaagccttctcccctcgcctcacctcgcaatccaccttgggcgggccgtccggcgagctgagcgcggcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtaattgcttgccttctgaggaactgcgggagggagcgaggagtcgtggagcgactcttgaaggatggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttccgtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctcctgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgtcccccgttcaccgaggtggtcaggatgctggagcaagtggagatggaggtcgttaacactgtccggagggcccgcttccggtgttgcatctcccagccaatgaccctagactgagtcacagccaggatccagggtggaaaaaggcaacctggagaaaagttaagtcctgtgtacctatcatattaataggcctgttctgcagagaagatgaaagcccaagctgagtgtacttggcgtcgcgcgttctcttcgtttaccctagacaatacctagtatctatcgtcagactggaatgtattagcggtagctttttatctttgacaacaaaaaaacaccatgcagggctcttgttgcaacaaccgcatgttcctgctgtatgttatctgttgtaatcatcctgcttggaacatgtgcaaggctgcaaggcttgatgcctaatagtatatatagcatatgtataattacctggcatgtgtcatacctgtttttatagttctggcatgtgttttttaacctgcttccatagttctgaacttcttattgatgcagctttcatggttaatgttatataccatgtactattaa

SEQ ID NO: 1059 - DNA, 2014 bp, Sorghum bicolor
ctcgtctcgtctcccctgtctcctccggtcctctctctcccctcctgagccgtttcccccccctctctctcctccgctttcctctggtctctggtcatcgcacccgtctccccgctctgactccgtcccgagcggccgactccgcccgcgccgccgcctccaggacgcgggccctcgactcagcgccgccgcctcgtcccgatcgaccctcgaatcgccgggaaccgtggacttcgcgaggctgtcacttttcctctaagcggtgtaaggaagataacagggcggcaggtgaattgcagagaaaaggagaacattaggctgttgcacgatggtggaaggccccaatttcgctggcatgattggtggtcatgacaatggtgggaatttctgcgacatggcatactaccggaagctcggtgagggctcaaccatgtcgatagatagccttaacagcatgcagaccagcacacatggtggctccatcgcaatgtctgtggacaatagcagtgtagggtcctgtgactcccatactaggatgctcaatcatcctggcctcaaggggcctgttgttggcaactactcggttggcgggcacagtattttccgtcatggacgggtgtctcatgccttgagcgatgatgcgctagcacaggcattgatggacccaaggtacccgactgagacgctcaaggattatgaggagtggacaattgatttagccaagctccacatgggaatgccctttgcacagggtgcctttggaaagctctacaggggtacctacaatggtgaagatgttgcaattaagcttttggagaggccagaggctgatccggagagagctgggttaatggagcagcagtttgtgcaagaagttatgatgcttgcaaccttgaggcaccagaacattgttaaatttattggagcatgcaggaagccagtggtttggtgcattgtgacggagtatgccaagggtggatcggttaggcagtttctggcgaagaggcagaataggtcagttccactaaaactggcggttaagcaagcattggatgttgcaagggggatggcgtatgttcatggtcttgggttcatccatagggatcttaagtcagataacctcttgatatctggtgataaatctatcaagatagctgactttggagtagctcggattgaagtaaaaactgaggggatgacacctgaaacgggaacctaccgttggatggcaccagagatgattcagcacaggccatatgaccaaaaagttgatgtctacagctttggcattgtgctctgggaactcataactggcatgctcccttttgctaacatgacagcagtgcaggctgctttcgctgtggtgaacaagggtgtccgcccagctataccccaggactgtctgcccacccttgctgagatcatgaccaggtgctgggatccaaatcctgatgtccgtccgccattcactgatgttgtgaggatgctggagcatgctgagatggagatcctgagcactgtccgcaaggcccgatttcggtgttgcatctcccaaccgatgactaccgactgaatcaaacaaaagagagtcgaaaagaactccatggaagcataattgagtgtatttatcatgtgtccagactccgctcagctgaagtagaaagcacacctgagtgtatggctgtgtgtgtgtatactcaggtgtaatcctgttgtctttgaaatattcctgcccttagaaatatacctagtttgcgttttcagactcttgagatgttttagggctagcctatgtcctgtggaaacatcatgcaggcttcctattcttgtaatgtccttgtgatcctgctgctttgttcatgttataaccctcctactggaatatgcacaaacactttgttgcttatgagtatatagcatgtataatttcctggcaatgattgttcctatgacaagtgctctgatagtggccgtcttagctaatatgtagaatttgatcaggactaatacagaa

SEQ ID NO: 1060 - DNA, 2014 bp, Sorghum bicolor
ctccctcgactcccacccccaccccactctcgctccctcctgccctgcctttgttggatcttttcccctctcgtctcacattcccctcgcctagttccacccccacccaccggtcaggtcaccgcccgcccccgtcgtcgccccgccgggggctcctcaccatcccgacgccgcacccgcacccgcacccgcacccgcatcgcatcaccgcctgctcccaccgtccgtcctcctcgatcgctggtaccttggcgccacgcggctccgacctcgtcctgtcctcctccatccactgccatcggcatcggcggcggcgaagtcttcttcccggccatcttctcaaagggtaatcaattgccaggcttttgatggcacaaggcgccaactttccaaacttcatcggcgccgtgggtggccatgatgatggcgtgaactttggcgggaacttctgtgacatggccttctaccagaagctaggggagggctccaacatgtctgttgatagcatcaacagcatgcagaccagcatgcatggtggatccatcgccagcagcatttgctctaacagtgactcccgcactggcatgcttggccatcctggtctcaaggggcctgtcattgtgggaagctactcagttgggcacagcatcttccgccctggccgggtgtcccatgccttgagtgaggatgcactggcacatgctctgatggacaacaagttcccaactgaaacgctaaaggattatgaggagtggactattgatctggggaacctgcacatgggcatggcctttgcacaaggtgcctttgggaagctctacaggggaacatacaatgggatggatgttgctattaagcttttggagcgacctgaggctgaccctgagaaagctcaactgttggagcagcagtttgtccaagaagttatgatgcttgcaactctgaggcacccgaatattgtcaaattcattggtgcgtgcaggaagccattggtttggtgtattgtcacagagtacgcaaagggtgggtctcttaagaatttcttgagcaagaggcagaacaggtctgttccgctgaagttggcagttaagcaggcattggatgttgcacgtggcatggcctatgtccatggccttgggttcattcacagagacctgaagtcagacaacctcctgatttctggtgataagtccattaagattgctgactttggagtggctaggattgaagtcaagactgaggggatgacacctgaaactggaacataccgatggatggctcctgagatgatccagcataggccatacaatcagaaagttgacgtctacagttttgccattgtcctgtgggagttggtaactgggaatctcccttttgcaaacatgactgcagtgcaagctgcatttgctgtggttaacaagggtgtgcgaccagccataccccacgactgcctccccgcccttggggagatcatgaccaggtgctgggatgcagaccctgaagtccgtcccccattcactgagattgtgaggatgctggaacaggtggagatggaggttctgaccactgtccgtaaggctcggttccgctgttgcgttgcccaaccgatgacgttggactgaatcatccacaatccaggaaaagaacctggagagaggtttaatcctatgtatttataatattaatagacttgtgcttcagaagcagaatgctgactcccctcagtctgccttctgtctttgacatgttatcgtagagtacacctagttgtcatcaccagagtggttgtaatagaggtagctttatgcttgactaaatacccttctgctgtaacaagtgcatgttcttgctgctcgctgtttgtgtgtttatcatcatgcggcaacatgtggaagctttgatgcttcatggtatatataacatgtgttattaagtaactagcatggatttgttcctgcctcgtagtcagtcgaaatttggtgctaacagaatcattcatctttgccttggtcag

SEQ ID NO: 1061 - DNA, 1950 bp, Saccharum officinarum
  misc_feature (152)..(152): n is a, c, g, or t
  misc_feature (1949)..(1950): n is a, c, g, or t
ctcgtctcccctctctcctccggtcctcccctcctgagccgtcccccccccccccccgccgtgtttcctccgctttcctctggtctctggtcatcgcgcccgtcttccccgctctgactccgtcccgagcggccgactccacccgcgccgcngcctcccggacgcggccccccgcctcagcgccgccgcctcgccccgatcgaccctcgaatcgccggaaaccgtggacttcgcgaggttgtgtctttacctccaagcggtgagagaaagataacagggcgacaggtgaatttccgagaaaaggagaacatttggttgttgcatgatggtggaaggccccaatttcgctggcatgattggtggccatgacaatggtgggaatttttgcgacatggcatactaccggaagctcggtgagggctcaaacatgtcgatagatagccttaacagcatgcagaccagcacacatggtggctccatcgcaatgtctgtggacaatagcagcgtagggtcctgcgactcccatactaggatgctcaatcatcctggcctcaaggggcctgttgttggcaattactcggtcggtgggcacagtattttccgtcatggacgggtgtctcatgccttgagcgatgatgcgctagcacaggcgttgatggacccaaggtacccgactgagacactcaaggattatgaggagtggacaattgatctggccaagctccacatgggaatgccctttgcacagggtgcctttggaaagctctacaggggtacctacaacggtgaagatgttgcgattaagcttttggagaggccagaggctgatccagagagagctgggttaatggagcagcagtttgtgcaagaagttatgatgcttgcaaccttgaggcaccagaacattgttaaatttgtaggagcatgcaggaagccagtggtttggtgcattgtgacggagtatgccaagggtggttcagttaggcagtttctggcgaagaggcagaataggtcagttccactaaaactggcggttaagcaagcattggatgttgcaagggggatggcatatgttcatggtcttgggttcatccatagggatcttaagtcagataacctcttgatatctggtgataaatctatcaagatagctgactttggagtagctcggattgaagtaaaaactgaggggatgacacctgaaacgggaacctaccgttggatggcaccagagatgattcagcataggccatatgaccagaaagttgatgtctacagctttggcattgtgctgtgggagctcataactggcatgctcccttttgctaacatgacagcagtgcaggctgctttcgctgtggtgaacaagggtgtccgcccagctataccccaggactgcctgcccacccttgctgagatcatgaccaggtgctgggatccaaatcctgatgtccgtccgccattcactgacgttgtgaggatgctggagcatgctgagatggagatcctgagcactgtccgcaaggcccgatttcggtgttgcatctcccaaccgatgactaccgactgaatcaaacaaaggagagtcgaaaagaactccatggaagcataattgagtgtatttatcatgtgtccagacttcgctcagctgaagtagaaagcacacctgagtgtatggctgtgtgtgtgtatactcaggtgtaagcctgttgtctttgaaatattcctgcccttagaaatatacctagttcgcgttttcagacacttaagatgttttagggctagcctatgtcctgtcgaaacatcatgcaggcgtcctattcttgtaatgtccttgtgatcctgctgctttgttcatgttatgaccctcctactggaatatgcacaaacactttgttgcttatgagtatatagcatgtataatttcctggcaatgatttgttctgccnn

SEQ ID NO: 1062 - DNA, 2030 bp, Panicum virgatum
ccgacaccgagcagtctctcctcctcctccttcccctcgcctttttgatctttccccctcccctcgcattcccatccccctcgcgctcctccctctccccggagccacccaccggccccggcctgctcggtccagcggcgaggggggacaccgccgtcccgccccgctcccaccgcccggtcctcccccccgatcggccgccccggatcgccggcgcccgcggccccccaccctggtcccgatcgattggcggcggagggcgtgctccgggacacccaaaggcaaaccaattgccaggcaggcttctggggtgctgtgctgggggagcagggaggaggtggagtgattgtggaagctaggattccagtcgttgagtgatggcgcaaggcgccaacttccctggcttcattggcgccgcgggtggccatgatggtggcgtgaactttggtgggggcttctgcgacatggccttctaccagaagctaggggagggctccaacatgtccatggacagcctcaacagcatgcagaccagcatgcacggcggctccatcgccatgtctgtggacaacagcagtgtcgggtctaacagcgactcgcgtaccgggatgctcggccatcctggtctcaagggccccgttgttgtcggcagctattcggtcgggaacagcatcttccgtccagggagagtgtcgcatgccttgagtgaggatgcgctggcacaggctctgatggacaataggttcccgacagagacactccagaattatgaggagtggacaattgatctgggcaaacttcacttggggatgccctttgcccaaggcgcctttggtaagctgtacaggggaacatacaatggcatggatgttgccataaagcttttggagcggccagaggctgacccagagaaagctcaattgcttgagcagcaattcgtgcaggaggttatgatgcttgcaaccttaaggcaccccaacattgtcaaattcattggtgcttgcaggaaaccattggtttggtgcattgtcacagaatatgcaaagggcgggtcgctcaagaatttccttagccggaggcagaacaggtctgttccgctgaagttagcggtgaagcaggcattagatgttgcacatggcatggcctatgtccatggacttgggttcatccacagagatctcaagtcagataacctcctgatttctggtgataagtccattaagattgctgactttggagtggctaggattgaagtgaagactgaggggatgacacctgaaacaggaacatatcgttggatggctcctgagatgatccagcacagaccatacaaccagaaggttgatgtctacagctttggcattgtcctgtgggagcttgtaactgggaatgttccttttgcaaacatgaccgcggtgcaagctgcatttgctgtggtgaacaagggtgtccgtccgaccatacctcatgactgcctccccgccctaggggagatcatgaccaggtgctgggactcaaaccctgaagtccgccccccattcactgatattgtcaggatgctggaacaggtggagatggaggtcctgcgcactgtccgtagggcccgcttccgctgctgcatcgcgcaaccgatggccctggactgagctgtccggaatccaggaaaagaacctggagagaggtttagtcctgtgtatttatcgtattataatagacctgcgcttcagaatcagaaagccaactctcgacagtctcgagtgtgccttctgtcgttgacatgtttatcgtagattacacctagtttctgtcatcagagtggttgtaatagaagtagttttatccttgactccatacccttcctgttgtaacaagtgcatgttcctgctgcgcgctctgtttttctgtttatcatcatgcggctacatgtgaaagctctgatgcttcatggtatatataatatgtataattaactagcatggatttgctcctgtgttgtcctgaatgatgtcaaaattcagcatatcagaatc

SEQ ID NO: 1063 - DNA, 1933 bp, Panicum virgatum
gccaagagagagaaagtgagaggcgactccactcgtcttccctctctctctctctctctctctctcctcctcctcctcctttcctctggtctctggtcatcgccctcgtctccccgctctgactccatccccagccgccgccgccgccgccgcctccagccgctgcccccgcctccgcgccgccaacccgtcccgatcggcccctgaatcgccggaaaccgtgagctgcgcgaggcggccactgttcctacaacatatcagggacgacaggtggacttctgaaaagggtaaaccttagattgttgcacgatggtcgaaggtcccaatttcgctggcatgattggtggtattggtggtcatgacaatggtgggaacttttgcgacatggcatactaccggaagcttggtgagggctcaaacatgtccatcgatagccttaacagcatgcagaccagcacgcatggtgggctccattgcaatgtctgtggacaacagtagtgtagggtcatgcgactcccatactaggatgctcaatcatccgggtctgaagggacctgttgtaggcaattactcagtcggcgggcacagtattttccgccatggacgggtgtctcatgccttgagtgatgatgcgctagcacaagcattgatggacccaaggtacccaactgagaccctcaaggattatgaggagtggacaattgatttggctaagctccacatgggaatgccctttgcacagggtgcctttggaaagctctacagggtacctacaacggtgaggatgttgccattaagcttttggagaggccagaggctgatccagagagagccgggttaatggagcagcagtttgtgcaagaagttatgatgcttgcaaccttgaggcaccagaatatagttaaatttattggagcatgcatgaagccagtggtttggtgcattgtgacggagtatgcaaaaggtggatcagttaggcagtttctgacaaagaggcagaacaggtcagttccactaaaactggcggtgaagcaagcattggatgttgcaagggggatgggctatgttcatggtcttgggttcattcatagggatctaaaatcagacaacctcttgattgctggtgataaatctattaagatagcagactttggagtagctcggattgaagtcaagactgagggaatgacactgaaacaggaacctaccgttggatggcaccagagatgattcagcacaggccatatgaccagaaagttgatgtctatagctttggcattgtgctgtgggagcttataaccggcatgctcccttttgctaacatgacagcagtacaagctgctttcgctgtggtgaacaagggtgtccgcccagccataccccaggactgcctgcccacccttggcgagatcatgacaaggtgctgggatccaaaccctgatgtgcgtcccccgttcactgaagttgtccggatgctggagcatgctgagatggagatactgagcaccgtccgcaaggcccgatttcggtgttgcatctcccaaccgatgactaccgactgaatccgacaaaaggagagttgaaaaagctctgtggaagcataattgagtgtatttatcatatgtcaagactttgctcagctgaagtagaaagcccacctgagtgtatggctgtgtgtgtatatactcaggttgtctcccaaatatccctctccttagaatatacctagtttgtgttttcagactcttgagatgttttagggctagcctatgtcctgttgtcaaaacaccatgcagggttcctattcttgtaagttgtaacggccttgtccctgttgctttgttcatgtgttatgaccctcctgctgaaatatgcttatgtgcacaaacatgtgttgcttcagtgtatatagcatatataatttcctggcaaa

SEQ ID NO: 1064 - DNA, 1807 bp, Triticum aestivum
gctcttggggcaaacgcccctcctctctccatctcacaaacacaacagctgaccctgtcccctgcggccctcatcccgacgccgcggctccgggggctcccgatcgaggcccggatcgccggaatccgtgcggcgccgaggtcgcgtggggtgcgaattggaagcagcgagctgtacttccggacccgaaaagtgggcagttccggggcaatcgcctttgggtggactgtgtgagggagaaagggaagagcggaaaggttgccggagctcaggctttggttatctgagaatgatggaagcgggcaagttccccgggataattggtgccgtaagcggccaggacggtggcgtcaacttctgcgacatggcatactaccagaagctaggggagggctccaccatgtccattgatagccttaacagcatgcagaccagcatgcacggtggttccataatgtctgtggacaacagtagtgttggttctactgactcgcgtactgggatgcttaaccatcctagccacaggggacctgttgctgtggtcagctactcggttgggaacagcattttccgtcctgggcgggtgtctcatgccttgagtgatgatgcgttggcacaggctttgatggacactagattcccgactgagacactcaaggattatgaggagtggaccattgatttggggaagctccacatgggattgccctttgcacaaggcgcatttgggaagctatacagggggacctacaatgggatggatgttgccattaagcttttggagaggcccgaggctgaccccgcacaagctcagctgctggagcaacagtttgtgcaagaagttatgatgcttgcagagttaaggcatccaaatatagtcaagttcgttggcgcatgcaggaagccaatagtttggtgcattgtcacagggtatgcaaagggtggatctgttaggaatttcctgaataggaggcagaacaggtctgttccactgaagctggcagtgaagcaggcactagatgttgcacgtggcatggcttatgttcatggccttgggttcatccacagagatcttaagtcagataacctcttgatttctggtgataaatcgatcaagattgctgacttcggagttgctaggattgaagtgaagaccgaggggatgacacctgaaacaggaacataccgttggatggctcctgagatgatccagcacagaccatacaatcagaaagttgatgtctacagttttggcattgtcctgtgggagctaataactgggacccttccttttccaaacatgacagcagtgcaagctgcatttgctgtggtgaacaagggtgtccgcccagccataccccatgactgcctacctgcccttggggagatcatgacaaggtgctgggatgcaaaccccgatgtccgccccccttttaccgatgttgtgagaatgctggagcgtgtggagatggaggtcctgaacaatgtccgcaaggccagattccggtgttgcatctcccaacccatgaccttagactaaagcaggcagaatccaggagaagagaaagcaatctggagagaagttaaatcccatgtatttatcatattaatacttttgatacagaagcagaaaagcccacctgagcatacgtgtgtgctcgggcttcacatatttatcttagaccataccatagtccctgtcgtcgtcttaaaactgtcattgtactggagacaggtttatccttaacattgtcagaacattgtcatgcggtttcctctggttgtaccgacgccatgctcctgctgc

SEQ ID NO: 1065 - DNA, 2625 bp, Oryza sativa
tacacatatatacatctctttgcatatttatattcttgtcagttgtttgctgaggcccccactgtgagaagttcatattccatttgggattatcaggactccttcagattattccaatccttccctgcatacagaaagtgatctagctgaggtgagatcagagagagagagagattgagctggttttaccaggaagtttccagtggtgtttgctttgctgcacatgtgatgcccttcaagttgtaagttcatctcaaccatgtgtgtaataatgcttactttttgccatgcattgcattgcgtcctctccttctccggcggctgctgctgctgcatggtgtgatggtggtggtggtggtcgtcgtcgtcggctgttttgcgattctggagattggttttgtacttttgtgcgtatccggggacatgcaccgccgtcgaattattctcgccgttgttgcgtgccacgcctcccctccttccctccctgcgaatataggccggtgcggattcccaattaattcccattgatctatcgtatgtgccactagcttcccgttcgttcgatcgagagcctatttaagcttcgccgccgcgttaatccctctttcctcctccaaattaatctcatcctaattctgttttaatttctggtgggaatttcgctgtttgatctggcctcttcacgtaaccgtaatgttctatgtgtaaattgaattaatggagttggttgtgaaatcgttgaattgatggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtggcggcgaagccgattctgccggcgatggatgcgccgagcctgcagaaccagatggagaatcagctgacaaggaactgcatcggcgcggcaactccggtgacccccaccggaaacctcgccggatcaggtgcgccgagcaagacgcggatcaggtggacgcaggacctgcacgagcggttcgtcgactgcgtcaatcagctcggcggcgcagacaaggcaactccgaaggggattctgaagctgatgaattcggatggcctgacgatctaccacatcaagagccatctccagaaatatcgcatagcgaagtacatgccagcgtcatctgaagggaagcaactggagaaaagagcaacaggaaatgacatgcagaatctggaccccaaaactggaatgcaaatcacggaagcactgcgtgttcagctcgacgtgcagaggcgcctccatgaacagctagagattcagagaaatctgcagctgaggatagaggagcaggggaagaggctgcagaagatgttcgaggaccagctgaaggcgagcaggagcgtgatggaaccgcaggagctggacgacgtcgtcgccttcgccgccggcgacggagacgacgacgcgttcgatgacgtcgacgtgcagctgctggccgtcgctggcagcggctatgacgacgccgggttccagtccaaaataagctaggacagccttttttgcgttttgtgttttggcactttgatttgacaaatattgttctggttcttcgacgtatgatacgcacaatgctattttttgcccgtgtagttggcgaaagtttcaaaaagatattttaagaaagagagtgggatccacagattcgcgcttaatttttttttttgtagctagtttgatcagagttgtaaatttaggctttttcaattggcctgcactgcatttcttaatggttttagttaggtcttagcaggcaaaaaacaggttaagttcaagtggcaatatattgctcatgtcacattcacatatgggcttgggatgctctacgtgtaccaccatgacaccatcctacgcagaaaaaggaaattacaaaatggatatcaaccacagaacgcaataatgctgttgtggattgtctactagataccttgaattaatttgtcaatagttaagaaataagaccttaatgatttgcacttaactttcagcagcaacctggactgatgttcaacagtagaagtatcatcaagaatatggacatggtcctcacgcgcatcttcataa

SEQ ID NO: 1066 - DNA, 820 bp, Amborella trichopoda
ggtctgggtttagggtttcctctagtgcggaggccctctcctgttgactggtgtttattgatcaaaggttaaagaattcctatcatccaatggctcctaaagccgctgccacaaagaaggctgaccccaaggcccaggctttgaaagctgctaaggcagtgaagtctggtgcatcaactcttaagaagaaaaccaagaagatccgcacgtcagttacttttcaccgccccaagacattgaagaaagagaggaaccccaagtatcctcgcattagtgcacccccaaggaacaaacttgatcactaccagattctgaagttcccactcacaacagagtcagcaatgaagaagattgaggataataacacattggtctttattgttgacattcgtgctgacaagaagaagatcaaggcggcagtcaagaagatgtatgatattcaggccaagaaagtgaacaccttgatcaggcctgatggaaagaaaaaggcttatgtgaggttgacgcctgatcatgacgcattggatgtggctaacaagatcggcattatctgaggctccatttttctctttttgcttcttttctcggatatcatttatcatgtcaccttgtatttgagtttcttttgtagggcctgtttatttgtgacggtttagttgtgttagatacagcagtagtacttctttttatgggattttaggcatgagtaatctcgattgggctttctcttagttgattgaggcccatggtaccttcattgttggcggattctatatgaatcttgaatttgagaagtgaccttcatattgctgcgtattac

SEQ ID NO: 1067 - DNA, 664 bp, Antirrhinum majus
gcagttaactcaggtgagatttagtgtttgagcttgattgatcctgaaaatggcgcctaaagctgatcaagccaagaaggccgaccccaaggctcaggccttgaagactgccaaggctgttaaaaccggtactttcaagaagaaggcggcaaagaagatccgcaccaaggttaccttccaccgaccgaggacattgaagaaggatagaagtcccaagtacccgcgcatcagtgcccctccacgcaacaaacttgatcattaccagattttgaagtacccactaaccactgagtctgccatgaagaaaattgaggacaacaacacccttgtttttattgtcgacattcgtgctgacaagaagaagatcaaggatgcagtcaagaagatgtatgacattcagacaaagaaggtcaacaccctcatcaggcctgatgggaccaagaaggcgtacgttcggttgacgcccgactacgatgcattggatgttgcaaacaaaattggaatcatctaagcctttgtccccaggaattttgttatgctttttttgaaggaagattgtactcgatgcacttcagttttgtaaacctatttttattgcagttaagatgttcaagagtttcagaaattatagtttttaagtaatgtcggatcatggttgagtgct

SEQ ID NO: 1068 - DNA, 607 bp, Antirrhinum majus
  misc_feature (12)..(12): n is a, c, g, or t
  misc_feature (61)..(61): n is a, c, g, or t
gagatttattgnaggttttagggtttattgaatctgaaatggcacctaaagctgatcaagntaagaaggcagacccaaaggctcaggccttgaagactgccaaggctgtgaaaacgggtacttttaagaagaaggctgctaagaagatccgcaccaaggttacttttcaccgcccgaggactttgaagaaggatagaagtcccaagtaccctcgcattagtgcacctccacgcaacaaactcgatcactaccagatcctgaagtatccactcaccactgaatccgccatgaagaaaatcgaagacaacaacacccttgttttcattgttgacatccgtgccgacaagaagaagattaaggatgctgtcaagaagatgtacgacattcagaccaagaaagtcaacactcttatcaggccagatggtaccaaaaaggcttatgttaggttgactcccgactatgatgctctggatgttgcaaacaagattgggatcatctaagcgactgtccttctagatttatgtttatgccttttcttaattgttatagccgacgtacaacttttataaacaaaaattttctggtttttagatgtttcagtttcagg

SEQ ID NO: 1069 - DNA, 679 bp, Antirrhinum majus
  misc_feature (22)..(22): n is a, c, g, or t
aatcctcacaggtttagaattnattagggtttagggattaaatctgctgaaatggctcctaaagttgataagaaggcagacccaaaggctcaggccttgaagacggccaaggcggttaaaactggtacctttaagaagaaggcggcgaagaagatccgcactaaggttacgttccataggccgaggacattgaagaaggatagaagtcccaagtacccccgcattagtgctcccccacgcaacaagcttgacattaccagattctgaaatatccactcaccactgagtctgccatgaagaagattgaggataacaatacccttgttttcattgttgacattcgtgccgacaagaagaagatcaaggatgctgtcaagaagatgtacgacattcagaccaagaaggtcaacacacttatcaggcctgacggaaccaagaaggcttatgttaggttgacacctgattatgatgctttggatgtcgcaaacaagattggaattatctaagagactcgcacacatttaagttcttgatatttcttaaaggattgtaggcaactgcccaatttttgcaaaccagatcctgatctttgtaagtttcagagagaggggacagctttttaagatcattttagattgtactttttcccattttggttcatgtttgattttattattat

SEQ ID NO: 1070 - DNA, 818 bp, Malus domestica
acgcttgcaggtctctctctcgctctctgcagacacacgcttttgaaaactgagaaagtgttgaaatttacgtgctgtatctatctgtgtgtccttttagggtttccaggtggtgatttgggaatataaccagagcttcttcatcggcatcaatggctccacgtaaagctgatgtttcaaaaaaggctgacccaaagtcacaagccgtgaaggctgcaagggctttgaaatctggacctactgttaagaaagttaagaagatcagaacctcagttacatttcaccgccctaggacattgaaaaaggagaggaaccctaagtaccctcgtattagtgctacaccgaggaacaagcttgatcattatcaaatattgaaatatcctcttaccactgagtctgcaatgaagaagattgaagataacaacactttggtctttattgttgacatacgtgctgacaagaagaaaatcaaggatgcagtcaagaagatgtacgacattcagaccaagaaagtgaataccttgatcaggcccgatggtaccaaaaaggcttatgttaggctaacccctgactacgatgctttggatgtggcaaacaaaatcggtatcatctaagttagcggcaaagcttcgctaagaggggagttctgtgagtttgcggtggctctgttttagttttgaagttgtaacaccttttgatacccgattactagtcttttatcttttgtggttataactgcagttctcacattatttatgttttcatatgcgatgacatttttgcatattaacgaatggttaatggctaaaaaaaaaaaa

SEQ ID NO: 1071 - DNA, 696 bp, Malus domestica
agctgctcttcgtttacaggtaggatcgtttcccgcagagcttggagcaatggcccctgctaaagttgacagcaagaagaaagatcccaaggcccaggccttgaagactgccaaggctgtgaaatcaggccctgctttcaagaagaaggccaagaagatcaggacatcggtcacattccacaggccaaggacattgaagaaggaaaggaaccccaagtatccccgcatcagtgcaacaccaagaaacaagttggaccactatcaaattctcaagtatccattgaccactgagtctgccatgaaaaagattgaggacaacaacacacttgtattcattgttgacatccgagctgataagaagaagatcaaggatgcagtgaagaagatgtacgacattcagaccaagaaagtgaacaccttgatcaggcctgatggaacgaagaaggcttacgtcaggttgacaccggactatgacgccttggatgttgccaacaagattggaatcatttaagttaatgttgtatcgtcttttatccggtttcaagagattccattgttgctatgacagttttgttactagttgcactgtatcagtactcctgcattagtttggttttctttaatttgtattgggagctatatttgctttttatggcaatgcgatgcgtttaaaatttagttcaatgtgccaatagt

SEQ ID NO: 1072 - DNA, 729 bp, Malus domestica
cgaattccgttgctgtcgagctgctcttcgtctacaggtaggattgtttcccgcagagcttggagcaatggcccccgctaaagttgacagcacgaagaaaagtgatcccaaggctaaagccttgaagactgccaaggctgtgaaatcaggccctgcttttaagaagaaggccaagaagatcaggacatccgtcacattccacaggccaaggacattgaagaaggaaaggaaccccaagtatccccgcatcagtgcaacaccaaggaacaaattggaccattaccaaattctcaagtatccattgaccactgagtctgcaatgaaaaagattgaggacaacaacacccttgttttcattgttgacatccgagctgacaagaagaagatcaaggatgcggtgaagaagatgtacgacattcagaccaagaaagtgaacaccttgatcaggcctgatggaacgaagaaggcttacgtcaggttgacaccggactatgatgccttggatgttgccaacaagatcgggatcatttaagttaaagctgtatcgtctttttatttggttccaagtgattccattgtggctatggcagttttgttagtagttgcactgtatcagtactcctgcattagtttggttttctttaatttgtattgggagctatatttgctttttatggcaatgcgatgcgtttaaaatttagtttttacaatgtgccattggtacaatac

SEQ ID NO: 1073 - DNA, 773 bp, Aquilegia formosa
aaatcgccccagcaaaaggttgaattgaggcaatggctcctccatccaaagttgctaccacaaagaaggctgatccaaaggcacaggctttgaaggcagccaaggcagtgaaatcaggtgcgtcaacccttaagaagaaagtcaagaagatccgcacctcggtcacatttcaccggcctaagactttgactaaggaaaggaaccccaaataccctcgtgttagtgcacccccaaggaacaagctcgatcattatcagattttgaaatatcccctcaccactgaatctgccatgaagaagattgaagacaataacactctggtcttcattgttgacatccgtgctgacaagaaaaagatcaaggccgcagtcaagaagatgtatgacattcagactaagaaagtcaatacattgatcaggcctgatggaaccaagaaggcgtacgtgaggttgactccagattatgatgctttggatgttgcaaacaaaataggaattatatagattggaactggccttcattttctgtcagattattgtattagagaggtcatgtttaagagtttagcagctatacaactgagaatcatgttaccaaattcaattgaacgtgttatgcttttgttgggatccttattttcatgatctggtattgagttgcagtgcagtgcattagtcttttgaaatctagcatatttggttctaggtctttaatttccttgcttaaaccccttgtgtggcagaaaagctgttgataatccatctttctgtctg

SEQ ID NO: 1074 - DNA, 762 bp, arabidopsis lyrata
acgcttttgtttcattttcacatcccttagaataaataaaaaccagcagcaacttgaagctgttctagggtttctgtttcgccgctcaggttttgtgaaaagaatctatcttgagtaatgtctccagctaaagttgatgtcaccaagaaaaccgaccctaaggctaaggctttgaaagctgcgaaagcagtgaaatctggccaaatccttaaaaagcctgctaagaagatcaggacaaaggtgactttccacaggccaaagacattgacccttcagaggaatcctaagtatccaaggatcagtgctactccaaggaacaaattggatcactaccagatcctcaagtaccctctcactaccgagtctgccatgaagaagatcgaagacaacaacaccttagtcttcattgttgacatccgtgctgacaagaagaagatcaaagatgctgtcaagaagatgtacgacattcagaccaagaaagttaacaccctcattaggcctgatggaacgaagaaggcgtatgtgaggttgactcctgattacgatgctttggatgtggctaacaaaatcgggatcatctaaatttaatcatcgatatcacttttggggttgaaacagacttctggtttttctcttccatagtctcagttttgctagagaagttaagatattaccatcacctctttgttatgctttatcttttgattcaaaaagatttatatgtttggtatctgttgatgcgtcaaagtttctttttagatc

SEQ ID NO: 1075 - DNA, 575 bp, arabidopsis lyrata
cagatttcgagtctgaagaatcatttcgagccatgtctccggctaaagttgatactaccaagaaggttgatcctaaggccaaggccttgaaggcggcaaaggctgtgaaatctggtcagacctttaagaagaaggacaagaagattaggaccaaggtcaccttccacaggccaaagactcttaccaagcccagagatggtaagtacccaagaatcagcgctactccaaggaacaagttggatcattaccaaatccttaagtacccactcaccactgaatctgcaatgaagaagattgaagacaacaacactcttgttttcattgttgacattcgtgctgacaaaaagaagattaaggatgctgttaagaagatgtatgacatccagaccaagaaagtgaacacactcatcaggcctgatggaaccaagaaggcttacgtgaggcttacaccagactatgatgctttggatgttgctaacaaaattggcatcatctaagtctcttatctatctttgcagttatgaagactcttgtggttttgtctcttgtagtctcagttttgctttaagatatta

SEQ ID NO: 1076 - DNA, 641 bp, arabidopsis lyrata
cagatttcgagtctgaagaatcatttcgagccatgtctccggctaaagttgatactaccaagaaggttgatcctaaggctaaggccttgaaggcggctaaggcagtgaagtctggtcaaaccttcaagaagaaggacaagaagattaggactaaggtcaccttccacaggccaaagactcttaccaagcccagagatggtaagtacccaagaatcagcgctactccaaggaacaagttggatcattaccaaatccttaagtacccactcaccactgaatctgcaatgaagaagattgaagacaacaacactcttgtctttattgttgacattcgtgctgacaagaagaagattaaggatgctgttaagaagatgtatgacatccagaccaagaaagtgaatacactcatcaggcctgatggaaccaagaaggcttacgtgaggcttacaccagactatgatgctttggatgttgctaacaaaattggcatcatctaagtctcttatctatctttgcagttatgaagactcttgtggttttgtctcttgtagtctcagttttggttttacaatacattcttgttgcagtttattgttgaattcaagttctatgtttttgacttctcacaaaatctcattata

SEQ ID NO: 1077 - DNA, 773 bp, Arabidopsis thaliana
acggttttgtttcattttcacttcccttagaataaataaaaaccaccaagcaacttggatctactctagggtttctgtttcgccgctcaggtttcgtgaaaagaatctatcttgagcaatgtctccagctaaagttgatgtcaccaagaaagccgaccctaaggctaaggctttgaaagctgcgaaagcagtgaaatctggccaaatcgttaaaaagcctgcgaagaagatcaggacaaaggttactttccacaggccaaagacattgaccgttcctagaaagcctaagtacccaaagatcagtgctactccaaggaacaaattggatcattaccagatcctcaagtaccctctcactactgaatctgccatgaaaaagattgaagacaacaacaccttagtcttcattgttgacatccgtgctgacaagaaaaagatcaaagatgctgtcaagaagatgtatgacattcagaccaagaaagtcaacaccctcattaggcccgatggaacaaagaaggcgtatgtgaggttgactcctgattatgatgctttggatgtggctaacaaaatcgggatcatctaatctgatcattgtcgctctgtgattttactttttctggtttttctcttccatagtctcagttttgctagagaagttaagatattactatcaccatctctttgttatgcttttatctttggattcaaaaagattatatgtttggtatttgttgatgcgtcatagtttctattcagatcgtgttccaattctt

SEQ ID NO: 1078 - DNA, 639 bp, Artemisia annua
ggttattgaagtagcttcagtcaacaatggcccctaaagctgatgccacaaagaaaggtgatgcaaagtctcaggctttgaagacagccaaggctgtgaagaccggcactaccttcaagaagaaggccaagaagatcaggaccaaggttaccttccaccgcccaaagacattgaagaccgacaggaacccaaagtatccccgtatcagtgctcccccaagaaacaaattagaccactaccagattctcaaatacccattgaccacagaatctgcaatgaagaagattgaagacaacaacacccttgttttcatcgttgacctccgtgctgacaagaagaagattaaggctgcagtcaagaagatgtacgacatccagaccaagaaggtcaacaccttgatcagacctgatggaacgaagaaggcatatgtcaagttaactccagattttgatgccttggatgttgcaaacaaaattggaatcatctaaattaaacggttcgaagagggtgtttatcattttcgacattgttagttttgttgtcttgaatagagtttcaaatttgttatgtttgttttgaattgcggattcaaatatgctaatggatcatacttccgtagttggagttattttgttctga

SEQ ID NO: 1079 - DNA, 714 bp, Persea americana
  misc_feature (46)..(46): n is a, c, g, or t
  misc_feature (48)..(48): n is a, c, g, or t
  misc_feature (478)..(478): n is a, c, g, or t
ctcctccaggttcctgttcttctccctctccatctctcaaagtttncnggtaagtgcaaaatttctagagttttagctatcaatggctccccctgctaaagctgcttctgcaaagaagaatgatccaaaggcacaagccttgaaagctgctaaggcagtgaaatctggtgcctcgaccttaaagaaaaaagccaagaagatccgaacatctgttacttttcatcggccaaagacattgaagaaagaaaggaaccccaagtaccctcggatcagtgcgccaccaaggaataagcttgaccagtatcggatactgaaatatcccctcacaacagagtctgcaatgaagaaaattgaggacaacaatactctggttttcattgttgacatcaaggctgacaagaaaatgattaaggctgcagtgaagaagatgtatgacattcagaccaagaaagtgaataccttgatcaggcctgatggnaccaaaaaggcatacgtgagattgactcctgactatgatgcattggatgtggcaaacaagatcggcatcatctagatcactagccttgacatggcatttttgcgttgtagcctttttaatgacttggggcgtgtcttaatctaggtactattttggagaactatgtaattttactttggagtgtttggtggaaagagaactgcttttccagaaccatgttatgcatttttcctggc

SEQ ID NO: 1080 - DNA, 712 bp, Persea americana
tgcatttgcaagttgcaactctcaaagcaggagctgcggtcttctctcgctccgcctaaatctggtagttgaacaaagtttctggagtttagctatcaatggctccccctactaaagctgcttctactaagaagagtgatccgaaggcacaggccttgaaagctgctaaggcagtgaaatctggtgcatcaaccttaaagaagaaggcgaagaagatccgaacttccgtcacttttcatcgcccaaagacattgaagaaagaaagaaaccctaagtacccccgtatcagtgcaccaccaaggaataagctcgaccaatatcggatactcaaatatcccctcacaacagaatctgcaatgaagaagattgaggacaacaatactctggttttcattgttgacattaaagcagacaagaagatgatcaaggctgcagtgaagaagatgtatgacattcagaccaaaaaagtgaataccttgatcaggcctgatgggaccaaaaaggcatacgtgaggttgacgcccgactatgatgccttggatgtggcaaacaagatcggcatcatctagactagattatgtttcaacatggcatttcctgcattttagccatttagtgttttgatctaggtattatcttggaaaaccatgtaattttgtcttggaatcttgagttgaaagatgaactggtgatttcagtaccagtgttttgc

SEQ ID NO: 1081 - DNA, 668 bp, Brassica juncea
tatcacgcagagtacgcggtctctcaaactgatcaacgggtttcgtttcgccgctcagtttttgtaggaaaggatctgacttttgagtaatggctccggctaaagttgatgtcactaagaaggctgacccaaaggccaaggccttgaaagctgcgaaagcggtgaagtcagggcaagtcatcaagaagaaggcgaagaagatcagaacgaaggtgacgttccacaggccaaagacattgacaaaggctagagaccctaagtacccacgcatcagtgcaactccaaggaacaagttggaccactacggaatcctcaagtacccactcaccaccgagtctgcaatgaagaagatcgaagacaacaacaccttggtcttcattgttgacatccgtgctgacaagaagaagatcaaagatgctgtcaagaagatgtatgacattcagaccaagaaagtcaataccctcatcaggcctgatggaacgaagaaggcgtacgtgagattgactcctgattatgatgctttggatgttgctaacaaaattggaatcatctaagctattatcatttgatctctgtcattttacttttggagttgaaaacagacttcttgtcttagtctcagttttgttagaaaataatatctctgctgtgctttatcgttggattcg

SEQ ID NO: 1082 - DNA, 644 bp, Brassica juncea
agggtttcagctgcttcacctctccagatcttgtgtcggaaaggatctcgttcaggacaatgtctccggctaaagttgataccactaagaaggccgacccaaaggccaaggccttgaaggctgcaaaggcggtgaagtctgggcaagcctttaagaagaaggacaaaaagatcaggactaaggtcaccttccacaggccaaagactttgaccaaggccagagaccccaagtacccaagaatcagcgcaactcccaggaacaagttggaccattacggtatccttaagtacccactcaccaccgagtctgcgatgaagaagattgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggcttacaccggactatgatgctttagatgttgctaataagattggcatcatttaagttttatctatctctgcaattaccaaaaaaaacagacttgtggttttgtttctcggtagtctctgtttttacaatacattcttgttgcagttaattgttgaattcgacttttctgttttt

SEQ ID NO: 1083 - DNA, 698 bp, Brassica juncea
agggtttcagctgcttcacctctccagattttgtgtcggaaggatcgttcagagcaatgtctccggctaaagttgataccactaagaaggccgacccaaaggccaaggctttgaaggctgcaaaggcagtgaaatctggccaggccttcaagaagaaggacaaaaagatcaggacaaaggtcaccttccacaggccaaagactttgaccaaggccagagatcccaagtacccgaggatcagtgctactcccaggaacaagcttgaccattacggtatcctcaagtacccactcaccaccgagtctgccatgaagaagattgaggacaacaacactcttgtcttcattgttgacattcgtgccgacaagaagaagatcaaagatgctgttaagaagatgtatgatatccagaccaagaaggttaacactctcatcaggcctgatggaacgaagaaggcttacgttaggcttacaccggactatgatgcgttagatgttgctaacaagattggcatcatctaagtttatctactacctctactactatttgtgaaacagtgttttttgtcgcttgtagactcagttttgcctttgagatatctaccatcgtccggttaatgtgtttgggcaaaatctctttttacaatacattcttgttgcagtttaattttgaattcaagttctatgctttttggttac

SEQ ID NO: 1084 - DNA, 557 bp, b_nigra
attttgtgtcggaaggatcgttcagagcaatgtctccggctaaagttgataccactaagaaggccgacccaaaggccaaggctttgaaggctgcaaaggcagtgaaatctggccaggccttcaagaagaaggacaaaaagatcaggacaaaggtcaccttccacaggccaaagactttaaccaaggccagagatcccaagtacccgaggatcagtgctactcccaggaacaagcttgaccattacggtatcctcaagtacccactcaccaccgagtctgccatgaagaagattgaggacaacaacactcttgtcttcattgttgacattcgtgccgacaagaagaagatcaaagatgctgttaagaagatgtatgatatccagaccaagaaggttaacactctcatcaggcctgatggaacgaagaaggcttacgttaggcttacaccggactatgatgcgttagatgttgctaacaagattggcatcatctaagtttatctactacctctactactatttgtgaaacagtgttttttgtcgcttgtagactcagtt

SEQ ID NO: 1085 - DNA, 741 bp, Brassica oleracea
  misc_feature (94)..(94): n is a, c, g, or t
gaacacacacactaataaaagtgtctgccgctgcaaaactcacctagcgtttcagcagcttcacctcaccagattttgaagtggcaaggatcgntcagagcaatgtctcctgctaaagttgataccacgaagaaggctgacccgaaagccaaggccttgaaggctgcaaaggcagtgaagtctggccaagctttcaagaagaaggacaagaagattaggactaaggtcaccttccacaggccaaagactttgaccaaggccagagatcctaagtacccgaggatcagtgctactccaaggaacaagttggaccattacggtatcctcaagtacccactcaccactgagtctgcgatgaagaagattgaggacaacaacactcttgtcttcattgttgacattcgtgctgacaagaagaagatcaaggatgctgttaagaagatgtacgacatccagaccaagaaggtcaacaccctcatcaggcctgatggaacgaagaaggcttacgttaggcttacacccgactatgatgctttagatgttgctaacaagatcggcatcatctaagtttctctatctctgcaattataaattcagacttgcggttttgtctctctctagtatcattacactcatctggttgtagtattttgagcaaaatcttctttctttttttttttttttacaatacattcttgtcgcagtttattgaattcaagttctatgtttttggtttggcgg

SEQ ID NO: 1086 - DNA, 691 bp, Brassica oleracea
gccataagataaataataaataaaaacctcaaaactgatactagggttttcgtttcgccgctccagattttgtggaaaggatctcactttgagcaatggctccagctaaagttgatgttactaagaaggctgacccaaaggccaaggccttgaaagctgcgaaagcggtgaagtcaggccaaatcatcaagaagaaggcgaagaagatcaggacaaaggtgacgttccacaggccaaagacattgacgaaggctagagacccgaagtacccacgcatcagtgcaactccgaggaacaagttggaccactacggaatcctcaagtacccactcaccaccgagtccgcaatgaagaagatcgaagacaacaacaccttggtcttcattgttgacatccgtgcagacaagaagaagatcaaggatgctgtcaagaagatgtatgacattcagaccaagaaagtcaacaccctcattaggcctgatggaacgaagaaggcgtacgtgagattgactcctgattacgatgctttggatgtagctaacaaaatcgggatcatctaatcttatcataccattgttcttttggagtttaaaacacagacttcttgtttctgtttctttattatgagttttgttagagaaattaatgatacgtctctttgctgtgctttatcgttggactccaagatatg

SEQ ID NO: 1087 - DNA, 708 bp, Brassica oleracea
gggaatttttccttatctgaaaactgatcaaagggtttccgtttcgccgctcagtttttgtaggaaaggatctgacttttgagtaatggctccagctaaagttgatgtcactaagaaggctgacccaaaggccaaggccttgaaagctgcgaaagcggtgaaatcagggcaagtcatcaagaagaaggccaagaagatcaggacgaaggtgacgttccacaggccaaagacattgacaaaggccagggaccccaagtacccacgcatcagtgcaactccaaggaataagttggaccactacggaatcctcaagtacccactcaccactgagtcagcaatgaagaagatcgaagacaacaacaccttggtcttcattgttgatatccgtgctgacaagaagaagatcaaggatgctgtcaagaagatgtatgacattcagaccaagaaagtcaataccctcatcaggcctgatggaacgaagaaagcgtacgtgagattgactcctgattatgatgctttggatgtggctaacaaaataggaatcatctaagttattaatttattatcatctgagctccgtcattttacttttgcagttaaaaacagacttctcgtcttagtatcagttttgctagaaaagataatctctttgttgtgctttatcgttggattcgaagctttgttttggtatttattttttcatctcgt

SEQ ID NO: 1088 - DNA, 713 bp, Brassica oleracea
gtctgcggctacatttttagtttagggtttcagcttcttagttagcatctctccaggttttgagtgggaagaatcatcttgagctatgtctccagctaaagttgataccacgaagaaggctgaccctaaggccaaggccttgaaggctgcgaaggcagttaagtctggccaagccttcaagaagaaggacaaaaagatcaggactaaggtcaccttccacaggccaaagactttgaccaaggctagagatcccaagtacccaagaatcagtgctactccaaggaacaagttggatcactatgggatccttaagtacccactcaccactgagtcagcgatgaagaagattgaagacaacaacactcttgtcttcattgttgacattcgtgccgacaagaagaagatcaaggatgctgttaaaaagatgtatgacatccagacgaagaaggtcaacaccctcatcaggcctgatggaacgaagaaggcttacgttaggcttacaccagactacgatgctctagatgttgctaacaagattggcatcatctaagtttatcttacctctgctattataaaaaggacttgtggttgttttgtttcaagtagtcaaaacgttgttttacaatacattcgtgttgcacttaattgttgaattcaagttctatgtctttttggcttcttaacagtcttatcatataccactttataaaccg

SEQ ID NO: 1089 - DNA, 673 bp, Brassica oleracea
gagggtttcagctgcttcacctctccagatcttgcgtcggaaaggatcgttcagagcaatgtctccggctaaagttgataccacgaagaaggccgacccaaaggccaaggccctgaaggctgcaaaggcagtgaagtctggtcaagccttcaagaagaaggacaaaaagatcaggactaaggtcaccttccacaggccaaagaccttgaccaaggctagagatcccaagtacccaaggatcagtgcaactcccaggaacaagttggaccattacggtatcctcaagtacccactcaccaccgagtctgccatgaagaaaattgaggacaacaacactcttgtcttcattgttgacattcgtgccgacaagaagaagatcaaagatgctgttaagaagatgtacgacatccagaccaagaaggttaacaccctcatcaggcctgatggaacgaagaaggcttacgttaggctcacaccggactatgatgcgttagatgttgctaacaagattggcatcatctaagtctatctacctcctgctattatatgaaacagacttgtgtttttgtcgcttgtagactcagttttgctttgagatattatctgccatcatcttttcctacaaaacattcttgtttaatgttgaattcagtttcctctgtttttgggcaaa

SEQ ID NO: 1090 - DNA, 631 bp, Brassica oleracea
gactcttttccattttccagtttttatttttgcccatcaatggcacctcctactaaagatggaaagaaggttgaccctaaggcaaaagccttgaaagctgccaaggcagtgaaggccggcgcatcgacattgaagaagaaggataagaagatcaggaccaaggtcaccttccacaggcctaagacattgaagacaagcaggaaccccaagtaccctcgcatcagtgctactcccaggaacaagttggaccactaccaaattcttaagtaccctcttaccaccgagtctgccatgaagaagatcgaggacaacaacacattggttttcattgttgaccttcgcgctgataagaagaagatcaaggctgccgtcaagaagatgtacgacattcaggccaagaaagtgaacaccttgatcaggcctgacggtacgaagaaggcttacgtacggttgacaccagaccatgatgcattggatgttgcgaacaagattggtatcatataaattgtattttgcatttttattttcagtggcgatgtctactttcaacagttttgttatagaatccagtttctccaaatgttagattttgtgtacttgaccccccaataccaatgttagctatggtatg

SEQ ID NO: 1091 - DNA, 2152 bp, Brassica rapa
  misc_feature (2052)..(2052): n is a, c, g, or t
gatcggccgaggctcattcatctctgctcaggatctatgtcgactgtgtaccggaagttggcaatatgcggcggtgaaggaggaagtgaatgggacgatgatgtatacgaaggtgtaagaaaagtctatgtagggcaagatctcaaacgtatcacttacatcaaattcgactacgtgaaggttgatggccaagtagtaacacgtgaatatgggacaaaagatcaaaacccaaaagagtttattgtagctcaacatccggacgaacagatcatagcggtggagggaagctacaacaaagtgggtctccttggcacggacgtgatcacatctctcgtattcaagacttcaaagggtaggaagtctccaacgtttggcccaaacttgctcggacttgtgaatggtacaaagttcgagtttgaggatcccggaaagaaaatcgtagggtttcatggacgtgcgggtgatgctctcgacgccattggagtttactttgtaattaactctctcccaccttcattgtctcctatttacaagctggatgctcaaggtggtacagagggacgtgtttggaatgatggctctttcgacgcggttaaaaggctgcgcattggtcaagataatgttcgtatcacttatttagagttcgagtatgccaaaggtggcaagtcagagcaacttcaccatggagtgaaaggaggaacaccatccgagtttgtgcttgatttcccggatgaatacatcaaatcggtggaagcaacctatgataagccaaacctttttcaaaataccgtcatcacatcgcttaccatcaaaacatcaaaaggaagaacatcatcctttgggtatacaaagggaaagaagtttgttcttgagcaaaaggattgtccccttgtcggattccatggaaaagtaggtgacgctattgatgctctaggagcatattttgcacctttggtaccagccaagaaactaccatcggtaggcggcaacggaggagttgcatgggatgatggtgtttacgacggtgtaaggaagatatacgtaggacaaggtaacgacggtgtatcctttgtgaagtttgagtacactaagggaacagagtttggtatctggagatgaacatgggaaggcgacaatactcggagctgaagagtttgttcttgaggatggtgagtatctcacggccttggtaggatactatgataagatctatggagtggatgaaccagctattatctcacttcagttcaagacgaacaaaagggagtcaattccgtttggaatgagtgcgggtgagaagttcactctcggggagagtggccacaagatcgtcgggttccacggacaagctagtgatgtcatccacagtgttggagtcactatcgtgtccatcaccgagtgaaataagccttcaattgtcttaataaaccagccagtcatgtcggttgacgatgaatatacctttcaataaggcatgtgtgtgttcttttgtatttcgctcaatgtgattttattcctataaaaaatcgccgctcagattttgtggaaaggatctcactttgagcaatggctccagctaaagttgatgttactaagaagcctgacccaaaggccaaggccttgaaagctgcgaaagcggtgaagtcaggccaaatcatcaagaagaaggcgaagaagatcaggacaaaggtgacgttccacaggccaaagacactgacgaaggctagagacccaaagtacccacgcatcagtgcaactccaaggaacaagttggaccactacggaatcctcaagtacccactcaccaccgagtccgcaatgaagaagattgaagacaacaacaccttggtcttcattgttgacatccgtgcagacaagaagaagatcaaggatgctgtcaagaagatgtatgacattcagacgaagaaagtcaacacactcattaggcctgatggaacgaagaaggcgtacgtgagattgactcctgattacgatgctttggatgtggctaacaaaatcggaatcatctaatccatcaatccattttccttntgttcaaaacagacttcatgtttttctcttctgtagtttcagttttgttagaaaaatgaaggataatacatctctttgtgctttaatcgttggactcaaa

SEQ ID NO: 1092 - DNA, 709 bp, Brassica rapa
gggtgcctgcggctacatttttagtttagtgtttcaacttcttagttagcatctctccaggttttgagtgggaagaatcatcttgagctatgtctccagctaaagttgataccacgaagaaggctgaccctaaggccaaggccttgaaggctgcgaaggcagttaagtctggccaagccttcaagaagaaggacaagaggattaggactaaggtcaccttccacaggccaaagactttgaccaaggcgagagatcccaagtacccaagaatcagtgctactccaaggaacaaattggaccattacggtatccttaagtatccattgaccactgagtcggcgatgaagaagattgaagacaacaacactcttgtcttcattgttgacattcgtgccgacaagaagaagatcaaggatgccgttaaaaagatgtatgacattcagaccaagaaggtcaacaccctcatcaggcctgatggaactaagaaggcttacgttaggcttacaccagactatgatgctttagatgttgctaacaagattggcatcatctaagtttatcttacctctcctattacaaaaagtacttgtggttttgtctcaagtagtcaaaatgttgttttacactacattcgtgttgcagttgattgctgaattcaagctctatgttttttggcttcttaacagtttatcatataccactttataaa

SEQ ID NO: 1093 - DNA, 741 bp, Brassica rapa
  misc_feature (681)..(681): n is a, c, g, or t
gggtttcagctgcttcacctctccagatcttgtgtcggaaaggatctcgttcaggacaatgtctccggctaaagttgataccacgaagaaggtcgacccaaaggccaaggctttgaaggcagcaaaggctgtgaagtctgggcaagccttcaagaagaaggacaaaaagatcagaactaaggttaccttccacaggccaaagactttgaccaaggccagagaccccaagtacccaaggatcagtgctactcccaggaacaagttggatcactacggtatccttaagtacccactcaccaccgagtctgcgatgaagaagattgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagtcttatctacctcctgctattgtgaaacagtggttttgtcgcttgtagactcagttttgctttgagatattatctaccgtcatcttttttctacaaaacattcttgttgcagtttaatgttgaattcagtttcctctgtttttgggcttctcatcantctttttaactcgttataaacttttgaaatgcaaacatacaaaaccccgaaaaaaaaaaa

SEQ ID NO: 1094 - DNA, 716 bp, Brassica rapa
agaaaagtgtctgccgctgcaaaactcacctcgcgtattcagctgctttcacctcaccagattttgaagtggcaaggaaaagtccagaccagagcaatgtctcctgctaaagttgataccacgaagaaggctgacccaaaagccaaggccttgaaggctgcaaaggcagtgaagtctggccaagctttcaagaagaaggacaagaagattaggactaaggtcaccttccacaggccaaagactttgaccaaggctagagatcccaagtacccgaggatcagtgctactcctagaaacaagttggaccattacggtatcctcaagtacccacttaccactgagtctgcaatgaagaagattgaagacaacaacactcttgtcttcattgttgacattcgtgctgacaagaagaagatcaaggatgctgttaagaagatgtatgacatccagaccaagaaagtcaacaccctcattaggcctgatggaacgaagaaggcttacgttaggcttacacctgattatgatgctttagatgttgctaacaagattggcatcatctaagttttatctatctctgccattataaaaacagacttgtggttttgtttctcttggtagtctctgtttttacaatacattcttgttgcagttaattgttgaattcaagttctctgtttttgaatttgcttatggacaatcttaccacaaaacaccct

SEQ ID NO: 1095 - DNA, 727 bp, Brassica rapa
  misc_feature (84)..(84): n is a, c, g, or t
  misc_feature (123)..(123): n is a, c, g, or t
aaaaaaaaaaaaaaaaaaaaaaaactcacctcgggtttcagctgcttcacctctccagatcttgtgtcggaaaagatcgttcanatcaatgtctccggctaaagttgataccacgaagaaggncgacccaaaggccaaggccttgaaggcagcaaaggcagtgaagtctgggcaagcctttaagaagaaggacaaaaagatcaggactaaggtcaccttccacaggccaaagactttgaccaaggccagagaccccaagtacccaaggatcagtgctactcccaggaacaagttggatcactacggtatccttaagtacccactcaccaccgagtctgcgatgaagaagattgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagtcttatctacctcctgctattgtgaaacagtggttttgtcgcttgtagactcagttttgctttgagatattatctaccgtcatcttttttctacaaaacattcttgttgcagtttaatgttgaattcagtttcctctgtttttgggcttctcatcaatctttttaactcgtta

SEQ ID NO: 1096 - DNA, 687 bp, Brassica rapa
aaaactgatccaaagggttttcgtttcgccgctcagtttttttgtaggaaaggatctgacttttgagtaatggctccagctaaagttgatgtcactaagaaggctgacccaaaggccaaggccttgaaagctgcgaaagcggtgaagtcagggcaagtcatcaagaagaaggcgaagaagatcagaacgaaggtgacgttccacaggccaaagacattgacaaaggctagggaccctaagtacccacgcatcagtgcaactccaaggaacaagttggaccactacggaatcctcaagtacccactcaccaccgagtctgcaatgaagaagatcgaagacaacaacaccttggtcttcattgttgacatccgtgctgacaagaagaagatcaaagatgctgtcaagaagatgtatgacattcagaccaagaaagtcaataccctcatcaggcctgatggaacgaagaaggcgtacgtgagattgactcctgattatgatgctttggatgttgctaacaaaattggaatcatctaagctattatcatttgatctctgtcattttacttttggagttaaaaacagacttcttgtcttagtctcagttttgttagaaaagataatatctctgttgtgctttatcgttggattcgaagctttgttttggtatttattttcatcttgttcccc

SEQ ID NO: 1097 - DNA, 664 bp, Brassica rapa
  misc_feature (38)..(38): n is a, c, g, or t
  misc_feature (50)..(52): n is a, c, g, or t
ttcagctgcttcacctctccagatcttgtgtcggaaangatctcgttcannncaatgtctccggctaaagttgataccacgaagaaggccgacccaaaggccaaggccttgaaggcagcaaaggctgtgaagtctgggcaagcctttaagaagaaggacaaaaagatcaggactaaggtcaccttccacaggccaaagactttgaccaaggccagagaccccaagtacccaaggatcagtgctactcccaggaacaagttggatcactacggtatcctcaagtacccactcaccaccgagtctgcgatgaagaagattgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagtcttatctacctcctgctattgtgaaacagtggttttgtcgcttgtagactcagttttgctttgagatattatctaccatcatcttttttctacaaaacattcttgttgcagtttaatgttgaattcagtttcctctgtttttg

SEQ ID NO: 1098 - DNA, 662 bp, Brassica rapa
  misc_feature (79)..(79): n is a, c, g, or t
  misc_feature (106)..(106): n is a, c, g, or t
  misc_feature (115)..(115): n is a, c, g, or t
  misc_feature (145)..(145): n is a, c, g, or t
  misc_feature (160)..(160): n is a, c, g, or t
  misc_feature (169)..(169): n is a, c, g, or t
  misc_feature (178)..(178): n is a, c, g, or t
  misc_feature (211)..(211): n is a, c, g, or t
  misc_feature (232)..(232): n is a, c, g, or t
  misc_feature (238)..(238): n is a, c, g, or t
  misc_feature (241)..(241): n is a, c, g, or t
  misc_feature (262)..(262): n is a, c, g, or t
  misc_feature (265)..(265): n is a, c, g, or t
  misc_feature (316)..(316): n is a, c, g, or t
ttcagctgcttcacctctccagatcttgtgtcggaaaagatcgttcatatcaatgtctccggctaaagttgataccacnaagaaggccgacccaaaggccaaggcnttgaaggcngcaaaggctgtgaagtctgggcaagccttnaagaagaaggacaanaagatcagnactaaggtnaccttccacaggccaaagactttgaccaaggcnagagaccccaagtacccaagnatcagngcnactcccaggaacaagttggancantacggtatcctcaagtacccactcaccaccgagtctgcgatgaagaagatngaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagtcttatctacctcctgctattgtgaaacagtggttttgtcgcttgtagactcagttttgctttgagatattatctaccatcttcttttttctacaatacattcttgttgcagtttaatgttgaattcagtttcctctgtttttg

SEQ ID NO: 1099 - DNA, 724 bp, Musa acuminata
gtccgactcggaggctgtggcgaagtgcgcttgctggggagcaagtttatccactagggaaactattctgcgctagatggctccaccggcaaaagccacctccaagaaggccgatgacaaaacacaggctttgaaggttgccaaggctgtgaagtcagggtccaccttgaagaagaaggccaagaagatcaggacatctgttaccttccaccggccaaggacactgacaaaggagagaaaccctaagtatcctagaatcagtgccccgccaagaaacaagcttgatcagtatcaaatcctcaaatatcccctgacgactgaatctgcaatgaagaagatcgaagacaacaacacactagtcttcattgttgatattcgagctgacaagaagaagatcaaagcagctgtgaagaagatgtatgacatccagtcaaagaaagtgaatactctgatcaggcctgatgggaccaagaaggcatatgtgagattgacgcccgactacgatgctctcgatgttgcaaataaaatcggcatcatctaagactcagacaagcttcgtgaggctgcattcaacatctatcagttacttgcaccaccaggtcttggattggaaatctagagagactcatggtgtgacttttaatatttttaagcttgacaagggattttgtttctatttatgctgttatttaagctttgttgtttcttcagcgaccacttgatg

SEQ ID NO: 1100 - DNA, 770 bp, Musa acuminata
ggggtcagcggcgcgccgatcgggaagcgaggttgaagtttgtttactaggacacctgttcagcaatcctagatggctccacctgcaaaagctacctccaagaaggctgatgacaagacacaggctctgaaggttgcgaaggctgtgaagtccggatctaccttgaagaagaaggccaagaagattaggacgtctgttacttttcacaggccaaagactctgacaagggacagaaatccgaagtaccctagaattagtgctccaccaagaaacaagttggatcagtatcaaatcctcaagtatcccctgaccactgaatctgcaatgaagaagattgaagacaacaacacactagtcttcattgttgacattagagccgacaagaagaagatcaaagcagctgtgaaaaagatgtacgacattcaggccaagaaggtgaataccctgatcagacctgatggtactaagaaggcttacgtgagactgactccggactatgatgcgcttgatgttgcaaacaaaatcggcatcatctaatcttggacaaattcatagctatccaaatgattctgacttgaggctctatttgggatctcaagaaatttacagcactatggaagccgatgtctatgatgtgacttccgaaacgtcattcttattttcaaaatggagttttattctgtctttgacatttttttaggtttttgttgtgttacttcaaagactattatgcaagtttgccctacttagttggctcgatagctttaaac

SEQ ID NO: 1101 - DNA, 773 bp, Musa acuminata
tatattgagtagggaacctattctgtgattctagatggctccacctgcaaaagctacctccaagaaggctgatgacaaagcgcaggctttgaaggctgccaaggctgtgaagtcaggatcagccaccttgaagaaggcaaagaagattaggacctctgttacttttcaccggccaaagacactttcaaaggcgagaaatccgaagtatcctagaattagtgctccaccaaggaacaaactggatcactatcaaatcctcatgtatcccctgaccaccgagtctgcaatgaagaagattgaagacaataacacactagtcttcattgtcgatattcgagctgacaagaagaagatcaaaggagctgtcaaaaagatgtatgacattcaggcaaagaaagtgaatactctgatcaggcctgatggaactaagaaggcttatgtgagattgacgcctgactatgatgctctggatgttgcaaacaaaatcggcatcatttaaggctctcaaaaattggcagctgcccacttgattttggttaagaggctctgtttgggagctttcgtatccggtagcaacggacctcgaagaagtttactattatgagaatctccatgaagtcacttttatgatggatttgttgtgtttatgatgctgtccaagtttctgttctgcttgtttaagaaccatttagttaaaagtatgtcgagtgtagttgtagttgcaaaaactaatctggcttgagttttcttgatcagtaaaatccactcttttg

SEQ ID NO: 1102 - DNA, 762 bp, Musa acuminata
ggggggtcagcggcgcgccgatcgggaagcgaggttgaagtttgtttactaggacacctgttcagcaatcctagatggctccacccgcaaaagctacctccaagaaggccgatgacaagacacaggctctgaaggttgcgaaggctgtgaagtcaggatctaccttgaagaagaaggccaagaagattaggacgtctgttacttttcacaggccaaagacactgacaagggacagaaatccgaagtaccctagaattagtgctccaccaagaaacaagttggatcagtatcaaatcctcaagtatcccctgaccactgaatctgcaatgaagaagattgaagacaacaacacactagtcttcattgttgatattagagccgacaagaagaagatcaaagcagctgtgaaaaagatgtacgacattcaggccaagaaggtgaataccctgatcagacctgatggtactaagaaggcttatgtgagattgacgccggactatgatgcgcttgatgttgcaaacaaaatcggcatcatctaagcttggacaaattcatagctatccaaatgattctgacttgaggctctaattgggatctcaagaaatttacagcactacggaagcccgatgtctatgatgtgacttccgaaacatcattcttattttgaaaatggagttttattctgtcttcgacatttttttagtttttgttgtgttactttaaagactattatgcaagtttgcctacttagttggctcgata

SEQ ID NO: 1103 - DNA, 775 bp, Musa acuminata
gtccgactcggaggctgtggcgacgtgcgcctgctggggagcaagtttatccactagggaaactattttgtgctagatggctccaccggcaaaagccacctccaagaaggccgatgacaaaacacaggctttgaaggttgccaaggctgtgaagtcagggtccaccttgaagaagaaggccaagaagatcaggacatctgttaccttccaccggccaaggacactgacaaaggagagaaacccaaagtatcctagaatcagtgccccaccaagaaacaagcttgatcagtatcaaatcctcaaatatcccctgaccactgaatctgcaatgaagaagatcgaagacaacaacacactagtcttcattgttgatattcgagccgacaagaagaagatcaaagcagctgtgaagaagatgtatgacatccagtcaaagaaagtgaacactctgatcaggcctgatgggaccaaaaaggcatatgtgagattgacgcccgactacgatgctctcgatgtcgcaaacaaaatcggcatcatttaagactcagacaaagcttcgcgagactgcattcaacatctatcagttacctgcaccaccaagccttggattggaaatctagagactcatggtgtgacttaaatatttttaagcttgacaagggattttgtttctatttatgctgttatttaggctttgttgtttcttcagcgaccacttgatgccttgattaatcttcttttagtatccctttcgatgtagtttcacctatgttta

SEQ ID NO: 1104 - DNA, 844 bp, Musa acuminata
ggcgcccgagcaaggtatgcctgcgtctgcgctcggttcatcatcccgaaagccctagaattctatattgagtagggaacctattctgtgattctagatggctccacctgcaaaagctacctccaagaaggctgatgacaaagcgcaggctttgaaggttgccaaggctgtgaagtcaggatcagccaccttgaagaagaaggcaaagaagattaggacctctgttacttttcaccggccaaagacactttcaaaggagagaaacccaaagtatcctagaattagtgctccaccaaggaacaaactggatcactatcaaatcctcatgtatcccctgaccactgagtctgcaatgaagaagattgaagacaataacacactagtcttcattgtcgatattcgagctgacaagaagaagatcaaaggagctgtcaaaaagatgtatgacattcaggccaagaaagtgaatactctgatcaggcctgatggaactaagaaggcttatgtgagattgacgcctgactatgatgctttggatgttgcaaacaaaatcggcatcatttaaggctctcaacaattggcagctgcccacttgattttggttagaggctctgtttgggagcttttgtatccggtagcaagggacctcgaagaagtttactattatgagaacctccttgaagtcacttttatgggggatttgttgtgtttatgatgttctccaggtttctgtttctgcttgtttaagaaccttttagttaaaagtatgtctgagtgtagttgtagttgcaaaaactcatctggcttcagttttcttgatcagtaaaatccactcttttgtaga

SEQ ID NO: 1105 - DNA, 702 bp, Ocimum basilicum
gcacgccgtattgttgatacatcaaagaaaactgatgctaaggctcacgcgttgaaggctgctaaggcagtgaaatcggcaagcaccttcaagaagaaggctaagaagatccgcaccaaagtaactttctatcggccaaagacactgaagaaagataggaaccctaagtaccctcgcattagtgcccctccacgcaataaactcgatcactatcagattctgaagtatcctttgaccacggaatctgctatgaaaaagattgaagacaacaatactttggtttttatagttgacatccgcgctgacaagaagaagatcaaggatgctgtgaagaaaatgtacgacatccagaccaagaaggttaacaccctcatcaggccggatggtaccaagaaggcctatgttaggttgacaccagactacgatgctttggatgttgcaaacaaaatcgggatcatctaaaaaaagtttgtctccgcatttcaggcttatcctttttatctgtgctactttgacacactcaggttttgtaactcgtagtggctttccaggttttattgtgttttagattgtcgaggttcattgtcgaactccactttttttgtttttcttgttttgttcaaaatgagaaatcttgcaaactattttcgcaccattaatgtgttcaacacaaatgttatattactacactatactcgcttc

SEQ ID NO: 1106 - DNA, 807 bp, Phaseolus coccineus
actgccactgcttctcacgcgcagggtttttcgaagatttaagaactagggtttcttcccctttcgcgactcatggctcccaaagctgatagttcaaagaaggccgatcctaaggcacaggccttgaaaactgctaaagcagttaagtcaggtgctacctttaagaagaaggccaaaaaggaccgaaattctgttaccttccatcggccaaagactttgaaaaaggataggagccccaaatacccgcgcattagtgctccacccaggaataagcttgatcactatcagatactgaagtatcctctcacaactgagtccgcaatgaagaagattgaagacaacaacactttggttttcattgttgacctgcgggctgacaagaagaagatcaaggatgcagtgaagaaaatgtatgatattcaggccaagaaagttaacaccttgatcaggcctgatgggaccaagaaggcttatgtcaggttgacacctgactatgatgccctggatgtggccaacaagattggaattatctaaaccattaccaggcatcaccaaattcaatttctgtttagatggtagtttgttttgttgtgatctgagggagacatttgaaacaaggttaagttctaagttttgcggtttgtttatctggtgtatttttagttcaattggaattaaatttacttttgttacaatttccaatttgatgagtaaatgagttatcataatcattctccatttattgttttgagcaactttttcgtacgatggacgtataacagtttcttaattacttatgctgaattt

SEQ ID NO: 1107 - DNA, 774 bp, Phaseolus coccineus
tggccggggagagccggtttcttccctgcgcaggaattaggaatatttaacaggtagagtttcttcaatggctcccgctaaagttgatagttctaagaagggtgatccaaaggcacaggccttgaaaactgctaaggcagttaagtctggtcctacctttaagaagaaggggaagaagacccgaaattctgtgactttccacaggccgaagacattgaagaaggacaggagtcctaagtaccctcgcattagtgcaccaccaaggaacaagcttgaccattatcagatcctgaagttccctcttaccactgagtctgctatgaagaagattgaggacaacaacactttggttttcattgttgaccttcgtgcagacaagaagaagatcaaggatgcagtaaagaaaatgtatgacatccaggccaagaaagttaacaccttgatcaggcctgatggtaccaagaaggcttatgtcaggttgacccccgattacgatgcattggatgtggcaaacaagatcggcattatctaagatagtacctgggttttattaaatgttaggctgttctatggtgattcttgatggtaacttttcaaaaaatgataggttctatattttgggttttattattttgtatcttttggttcagaagacactaaacagacatcgtgtttcaattttgtctcttaaattgatgattaaaatgagcatgttaaaagtttatattttttagtgattaggcgactcgttgaatgaggttaatgagtgtatgt

SEQ ID NO: 1108 - DNA, 1406 bp, Beta vulgaris
  misc_feature (272)..(273): n is a, c, g, or t
ttggagaaacccccctcttttcggcgaattttttaatataaagggggggggtgcccccgggccccccatttttgttataaacctccttgaagaggtttttgggggtaaaggcgggggtttgggacctttttttcccggggccccttaagggtttttttttgggggggctaaaaacacagggcctttggttggccttgggctttgtcaaatttttggtttcccattgggaaaaaattccctttgggggaaacccccccccccaccccgggccnnttttttggggggaggggaaggccctttgaaaaccctttcccgggtgggggttttttaaaacgggcccccggtttccccggaaaagggcgggggccaccccattttgtgggttgcccccccttggcccccaggttttcctttttttttccggccttttttttggggattgggaggggaacaattttccccggaaaccgtttagccccgttttcccccagctcgaaatttacccccctaaagggaaccaaaaagggggtttccccccggggggggcccgttttaaattaggggattccccgggctccagaatttggcccgaggattgccgctacttctttctttcgcttatttcaggtttgaaaattccaccattaatggcgcctcctgctaaagatggaaagaaggctgatcccaaggcacaggccttgaaagctgccaaagccgtgaaatctggctcaagtaccttgaagaagaaggcgaagaagatcaggaccaaggttactttccataggccaaagacattgaagacagacaggaagcccaaataccctcgtattagtgcaacaccaagaaataagttggatcattaccagatccttaaatatccattgaccactgagtctgcaatgaagaagattgaggacaacaacaccttggtttttattgttgacatccgtgcggacaagaagaagattaaggactctgtcaagaagatgtatgatatccaggccaagaaagtgaataccttgatcaggcccgatggcactaaaaaggcgtatgttcgattgacaccagactatgatgccttggatgtggctaacaagattggaatcatctaatgtgttttgctctgtatttgttttcaagctgacatttttgataggaacttgttcaatagaaaaaacatgttattttgatgctatgcagtagcctgagtttcgttgtggctagtcatttctatgctatttcagaaaaaaaaaaaaaaaaaatttctgggggggggtcccggacctcggcgaaatagtaaagtattgaagtgtacgcggagatagagatatagagaatgagtattaagcttttggggtcgtgggaggatgggattgagtaagaatgtaaaaaaagggaacctggaa

SEQ ID NO: 1109 - DNA, 797 bp, Beta vulgaris
  misc_feature (16)..(16): n is a, c, g, or t
ggggggaacaccttgncgcagttcttctctccactctctctcctagggtttatcagttcgagcatcaatggcgcctcctgctaaagatggaaagaaggctgatcccaaggctcaggccttgaaagctgccaaggctgttaaatcaggttcatcaaccttgaagaagaaagccaagaagattaggaccaaggttactttccacaggccaaagacattgaagaaggacagaaaccccaagtatcctcgcatcagtgctcctccaaggaataagttggaccactaccagatccttaaatttccattgaccactgagtctgcaatgaagaagattgaagacaacaacactttggtctttattgttgatcttcgtgccgataagaagaagattaaggatgccgtcaagaagatgtatgatattcaggccaagaaagtcaataccttgattaggcccgatggcaccaagaaggcatacgtccgcttgacaccggactatgatgcgttagatgtggcaaacaagatcggaatcatataagcttgcattttcttcttttaggtctcaagtggactcattacttgtggcaattttgttagggacatcaatttctatttaaagctcagatcttatgtgatttcttgaacacccttatatggttagttgtatgctctttcagtcgtagtaattaatggcgcgtttgcaatgtttatctcttgtcctatctgggcttaattattttgaactatgtctgttaattggggtaacctaaggctgtactcgagagtaacaatcggtttgaaaa

SEQ ID NO: 1110 - DNA, 788 bp, Brachypodium distachyon
agggtttctccacagccgtcttcgcttcgcttcgcttcgagcacgccccgcagaggtaagtttgggaggttgtactcagaagctccaatggctcctaaagttgctgtcgccaagaagggcgatgccaaggcccaagctgcgaaggttgccaaggctgtgaagtctgggtcaatcaagaagaagacaaagaagatccgcacatccgtgacatttcaccgccccaggactctcaagaaggccagggacccaaaatacccaagaatcagcacacctggaaggaacaagcttgatcagtaccaaatcctcaagtatcctcttaccaccgaatctgcaatgaagaagattgaagacaacaacaccctggtcttcattgttgacctcaaggcagacaaaaagaagatcaaggctgctgtcaagaagatgtatgatattcaggctaagaaggttaacaccctgatcaggcctgatggtaagaagaaggcttacgtgaagctgacagcagactatgatgctcttgatgtggccaacaaaattggcatcatctaagtcagacggtcctgtagttggcttttgtcctggtttcttatgttatctaagttttgtagctgttacttagcaaagggccaaggtggctccattgcctacatatcgccgcacacttccatgaatttgatgcaatccaagtttcttatatttgagctttgcatttgagtatgccattggttggctcatattttgttgtcattatgggttgaaattttacacatttgagcagcctttgttctggt

SEQ ID NO: 1111 - DNA, 779 bp, Brachypodium distachyon
gagtcgctcgggtccataatataaggcctcgtccgcaaggctctagggtttctccacagccgtcattcgcttcgagcacgccccggagaggtaagttcttggggttgtactgagaagctccaatggctcccaaagttgctgttgccaagaagggcgatgccaaggctcaagctgcgaaggttgccaaggctgttaagtcagggtcaatcaagaagaaagtaaagaagatccgcacatctgtgacatttcaccgccccaggactctcaagaaggccagggacccaaagtacccaagaatcagtacacctggaaggaacaagcttgatcagtaccaaatcctcaagtatcctcttaccactgaatctgcaatgaagaaaattgaagacaacaacactctggtcttcattgttgacctcaaggcagacaagaagaagatcaaggctgccgtcaagaagatgtacgatattcaggccaagaaggttaacaccctgatcaggcctgatggcaagaagaaggcgtacgtgaagctgacagcggactacgatgctcttgacgtggccaacaaaattggcatcatctaagtccagagaggcctgctgttggcactcgtgtcctggtttcttatgttatcagagttttgtagctgttatttagcgaagagtgtcagtgtctatgtctccaatgcctccatatctttgcacactaacatgaatttgatgcagtcaagttacttatgtttgagctttgcatttgattatgccagtggttgcttgactagc

SEQ ID NO: 1112 - DNA, 804 bp, Theobroma cacao
  misc_feature (664)..(664): n is a, c, g, or t
cggggagcaaaccctagaacggctccaccgcttttccccatcgacagggtttagaagggtttgaggcatcaaccaatggctccaaaagttgagaagaaggcagatccaaaggcacaggccttgaaggctgcgaaagcagtgaaatctggagcaacttttaagaagaaggccaagaagatccgaacaaaggttacattccacaggccaaagaccttgaagaaggataggaaccctaagtatccacgcattagtgctccaccaaggaacaagcttgaccattatcagattctcaagtttcccctcacaactgagtcagcgatgaagaagatcgaagacaacaacactttggttttcattgttgatattcgtgcagacaagaagaagataaaggatgctgtcaagaagatgtatgatattcaggccaagaaagtgaacacgttgatcaggcctgatggtacaaagaaggcatacgttaggttgacacctgattatgatgccttggacgtagcaaacaaaattggagttatctaagatagttggtggctaccttgttttgagcatttattttttgttttgttgcaaagagtaaagacagttcttttgagactttgagcagggagatttaagtttagctgttaaagttgtaatcttgtgtttactgccngttaatcttctgtggtttaacgtaaaacaaaaggtgatttttgatttacgtgttttcgaaattttattgaaaatggttcagcgcttgaaagttagctatttgcttctgacatgatctccttgagaaaaaaaaaataaaaa

SEQ ID NO: 1113 - DNA, 797 bp, Theobroma cacao
gggaaagaaaaccctaaactctccagcggccgcagctaaaaaggggtaattgaagtaagaattcagcaatggctccagctaaagtcgacagcaagaaaaaaactgatccaaaggctcaagcagttaaggctgccaaggctgtgaagtctggtacaacattcaagaagaaggctaagaagatccggacaaaagttacatttcatcggccaaagactctaaaaaaagaaaggaacccaaaatatcctcgcattagtgcaccacccagaaataagttggatcagtatcaaatcctcaagtatccactaactactgagtctgcaatgaaaaaaattgaggacaacaacacactggttttcattgttgacattcgtgctgacaagaagaagattaaagatgcagtgaagaagatgtatgacattcagacgaagaaagtgaatacattaatcaggcctgatggaactaagaaggcatatgttaggttgactccagattatgatgccttggatgtggcaaacaagattgggattatctaaggtatctgggctgtcaagcgatgtcttcaactctttcaacagttttgttaggagtgattcactatgttaggaccttgttcgcattttggcattatatgtatcaagaattatgtttgcaattaaattctgcatgggaattggattgggatttacacacttgatatgctgttatgaatggttttaacatttcattatcatgcttaattcagctgcgcagctgcttacccatcaatatttatggagtaattttcttattattgatca

SEQ ID NO: 1114 - DNA, 777 bp, Brassica napus
atcaacgcagagtacgcgggggattttgccttctctcaaactgatccaaagggttttcgtttcgccgctcagtttttttgtaggaaaggatctgacttttgagtaatggctccagctaaagttgatgtcactaagaaggctgacccaaaggccaaggccttgaaagctgcgaaagcggtgaagtcagggcaagtcatcaagaagaaggcgaagaagatcagaacgaaggtgacgttccacaggccaaagacattgacaaaggctagggaccctaagtacccacgcatcagtgcaactccaaggaacaagttggaccactacggaatcctcaagtacccactcaccaccgagtctgcaatgaagaagatcgaagacaacaacaccttggtcttcattgttgacatccgtgctgacaagaagaagatcaaagatgctgtcaagaagatgtatgacattcagaccaagaaagtcaataccctcatcaggcctgatggaacgaagaaggcgtacgtgagattgactcctgattatgatgctttggatgttgctaacaaaattggaatcatctaagctattatcatttgatttctgtcattttacttttggagttaaaaacagacttcttgtcttagtctcagttttgttagaaaagataatatctctgttgtgctttatcgttggattcgaagctttgttttggtattttatattttcatcttgttccccaatttctattgctgcctatttgacacccgtcatatcaggttaattttggtt

SEQ ID NO: 1115 - DNA, 742 bp, Brassica napus
  misc_feature (622)..(622): n is a, c, g, or t
  misc_feature (658)..(658): n is a, c, g, or t
gagggtttcagctgcttcacctctccagatcttgtgtcggaaaagatcgttcatatcaatgtctccggctaaagttgataccacgaagaaggtcgacccaaaggccaaggccttgaaggcagcaaaggcagtgaagtctgggcaagcctttaagaagaaggacaaaaagatcaggactaaggtcaccttccacaggccaaagactttgaccaaggccagagaccccaagtacccaaggatcagtgctactcccaggaacaagttggatcactacggtatccttaagtacccactcaccaccgagtctgcgatgaagaagattgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagtcttatctacctcctgctattgtgaaacagtggttttgtcgcttgtagactcagttttgctttgagatatttatctaccatcatcttttttctacaanacattcttgttgcagtttaatgttgaattcagtttnctctgtttttgggcttctcatcaatcttcaactcgttataaacttttgaaatgcaaacatacaaaaccaatctcttcatcaaag

SEQ ID NO: 1116 - DNA, 699 bp, Brassica napus
ggtctgccgctgcaaaactcacctagcgtattcagctgctttcacctcaccagattttgaagtggcaaggaaaagtccagaccagagcaatgtctcctgctaaagttgataccacgaagaaggctgacccaaaagccaaggccttgaaggctgcaaaggcagtgaagtctggccaagctttcaagaagaaggacaagaagattaggactaaggtcaccttccacaggccaaagactttgaccaaggctagagatcctaagtacccgaggatcagtgctactcctagaaacaagttggaccattacggtatcctcaagtacccacttaccactgagtctgcgatgaagaagattgaagacaacaacactcttgtcttcattgttgacattcgtgctgacaagaagaagatcaaggatgctgttaagaagatgtatgacatccagaccaagaaagtcaacaccctcatcaggcctgatggaacgaagaaggcttacgttaggcttacacctgattatgatgctttagatgttgctaacaagattggcatcatctaagttttatctatctctgccattataaaaacagacttgtggttttgtttctcttggtagtctctgtttttacaatacattcttgttgcagttaattgttgaattcaagttctctgtttttgaatttgcttatggacaatcttacccc

SEQ ID NO: 1117 - DNA, 753 bp, Brassica napus
ggcaataaaagtgcctgcggctacatttttagtttagggtttcaacttcttagttagcatctctccaggttttgagtgggaagaatcatcttgagctatgtctccagctaaagttgataccacgaagaaggctgaccctaaggccaaggccttgaaggctgcgaaggcagttaagtctggccaagccttcaagaagaaggacaagaagattaggactaaggtcaccttccacaggccaaagactttgaccaaggcgagagatcccaagtacccaagaatcagtgctactccaaggaacaagttggatcactatgggatcctcaagtatccattgaccactgagtcggcgatgaagaagattgaagacaacaacactcttgtcttcattgttgacattcgtgccgacaagaagaagatcaaggatgccgttaaaaagatgtatgacattcagaccaagaaggtcaacaccctcatcaggcctgatggaacgaagaaggcttacgttaggcttacaccagactatgatgctttagatgttgctaacaagattggcatcatctaagtttatcttacctctcctattacaaaaagtacttgtggttttgtctcaagtagtcaaaatgttgttttacactacattcgtgttgcagttgattgctgaattcaagctctatgttttttggcttcttaacagtgttatcatataccactttataaacctctataatacaaattatacaaatgcaattccag

SEQ ID NO: 1118 - DNA, 742 bp, Brassica napus
ctgcggctacatttttagtttagggtttcagcttcttagttagcatctctccaggttttgagtgggaagaatcatcttgagctatgtctccagctaaagttgataccacgaagaagactgaccccaaggccaaggccttgaaggctgcaaaagcagttaagtctggccaagccttcaagaagaaggacaagaagattaggactaaggtcaccttccacaggccaaagactttgaccaaggctagagatcccaagtacccaagaatcagtgctactccaaggaacaagttggaccattacggtatcctcaagtacccactcaccactgagtctgcaatgaagaagattgaagacaacaacactctggtcttcattgttgacattcgtgccgacaagaagaagatcaaggatgctgttaaaaagatgtatgacatccagacgaagaaggtcaacaccctcatcaggcctgatggaacgaagaaggcttacgttaggcttacaccagactacgatgctctagatgttgctaacaagattggcatcatctaagtttatcttacctctgctattataaaaaggacttgtggttttgtctctagtagtcaaaacgttgttttacaatacattcgtgttgcacttaattgttgaattcaagttctatgtttttttggcttcttaacattcttatcatataccactttataaacctttatagtacaaattatacaaatgcaattccagga

SEQ ID NO: 1119 - DNA, 713 bp, Brassica napus
ggctgcaaaactcacctagcgtatcagcagcttcaactcaccagattttgaagtggcaaggatcgttcagagcaatgtctcctgctaaagttgataccacgaagaaggctgacccgaaagccaaggccttgaaggctgcaaaggcagtgaagtctggccaagctttcaagaagaaggacaagaagattaggactaaggtcaccttccacaggccaaagactttgaccaaggccagagatcccaagtacccaaggatcagtgctactcctagaaacaagttggaccattacggtatcctcaagtacccacttaccactgagtctgccatgaagaagattgaggacaacaacactcttgtcttcattgttgacattcgtgctgacaagaagaagatcaaggatgctgttaagaagatgtacgacatccagaccaagaaggtcaacaccctcatcaggcctgatggaacgaagaaggcttacgttaggcttacacccgactatgatgctttagatgttgctaacaagatcggcatcatctaagtttctctatctctgcaattataaattcagacttgcggttttgtctctctctagtatcattacactcatctggttgtagtattttgagcaaaatcttctttctttttttttttttttacaatacattcttgtcgcagtttattgaattcaagttctatgtttttggtttggctt

SEQ ID NO: 1120 - DNA, 769 bp, Brassica napus
ggtggcttccacaatgtaactctccgccgctgagaaatgaactagggtttcagctgcttcacctctccagatcttgcgtcggaaaggatcgttcagagcaatgtctccggctaaagttgataccacgaagaaggccgacccaaaggccaaggccctgaaggctgcaaaggcagtgaagtctggtcaagccttcaagaagaaggacaaaaagatcaggactaaggtcaccttccacaggccaaagaccttgaccaaggctagagatcccaagtaccccaggatcagtgcaactcccaggaacaagttggaccattacggtatcctcaagtacccactcaccaccgagtctgccatgaagaaaattgaggacaacaacactcttgtcttcattgttgacattcgtgccgacaagaagaagatcaaagatgctgttaagaagatgtacgacatccagaccaagaaggttaacaccctcatcaggcctgatggaacgaagaaggcttacgttaggctcacaccggactatgatgcgttagatgttgctaacaagattggcatcatctaagtctatctacctcctgctattatatgaaacagacttgtgtttttgtcgcttgtagactcagttttgctttgagatattatctgccatcatctttttctacaaaacattcttgtttaatgttgaattcagtttcctctgtttttgggcttctcggcaatctttttaactctttatataaacttgtgaaatgcaaagatacaaaag

SEQ ID NO: 1121 - DNA, 732 bp, Brassica napus
gaaagataaataataaataaaaacctcaaaactgatactagggttttcgtttcgccgctcagattttgtggaaaggatctcactttaagcaatggctccagctaaagttgatgttactaagaagcctgacccaaaggccaaggccttgaaagctgcgaaagcggtgaagtcaggccaaatcatcaagaagaaggcgaagaagatcaggacaaaggtgacgttccacaggccaaagacactgacgaaggctagagacccaaagtacccacgcatcagtgcaactccaaggaacaagttggaccactacggaatcctcaagtacccactcaccaccgagtccgcaatgaagaagattgaagacaacaacaccttggtcttcattgttgacatccgtgcagacaagaagaagatcaaggatgctgtcaagaagatgtatgacattcagacgaagaaagtcaacacactcattaggcctgatggaacgaagaaggcgtacgtgagattgactcctgattacgatgctttggatgtggctaacaaaatcggaatcatctaatccatcaatccattttccttttgttcaaaacagacttcatgtttttctcttctgtagtttcagttttgttagaaaaatgaaggataatacatctctttgtgctttaatcgttggactcaaaagtgttggtacttactggtgcgttataattttcttattatcatgttctccgggga

SEQ ID NO: 1122 - DNA, 718 bp, Brassica napus
atcaacgcagagtcgcggggctctgaaaactgatcaaagggtttccgtttcgccgctcagtttttgtaggaaaggatcttacttttgagtaatggctccagctaaagttgatgtcactaagaaggctgacccaaaggccaaggccttgaaagctgcgaaagctgtgaaatcagggcaagtcatcaagaagaaggccaagaagatcaggacgaaggtgacgttccacaggccaaagacattgacaaaggctagggaccccaagtacccacgcatcagtgcaactccaaggaataagttggaccactacggaatcctcaagtacccactcaccactgagtcagcaatgaagaagatcgaagacaacaacaccttggtcttcattgttgatatccgtgctgacaagaagaagatcaaggatgctgtcaagaagatgtatgacattcagaccaagaaagttaataccctcatcaggcctgatggaacgaagaaagcgtacgtgagattgactcctgattatgatgctctggatgtggctaacaaaataggaatcatctaagttattaatttattatcatctgagctctatcattttacttttgcagttaaaaacagacttctcgtcttagtatcagttttgctagaaaagataatctctttgttgtgctttatcgttggattcgaagctttgttttggtatttatttttcatcttgttccac

SEQ ID NO: 1123 - DNA, 948 bp, Brassica napus
agctgcttcacctctccagatcttgtgtcggaaaggatctcgttcaggacaatgtcaccggctaaagttgataccacgaagaaggccgacccaaaggccaaggctttgaaggcagcaaaggctgtgaagtctgggcaagccttcaagaagaaggacaaaaagatcagaactaaggttaccttccacaggccaaagactttgaccaaggccagagaccccaagtacccaaggatcagtgctactcccaggaacaagttggatcactacggtatcctcaagtacccactcaccaccgagtctgcgatgaagaagatcgaggataacaacactcttgtcttcattgttgacattcgtgccgacaagaagaagatcaaggatgctgttaagaaaatgtacgacatccagaccaagaaggttaacaccctcatcaggcctgatggaacgaagaaggcttacgttaggctcacaccggactatgatgcgttggatgttgctaacaagattggcatcatctaagttttatctacctctgctattgtgaaacagtggttttgtcgcttgtagactcagttttgctttgagatatttatctaccatcatcttttttctacaatacattcttgttgcagtttaatgttgaattcagtttcctctgtttttgggcttctcatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgctctaaaggatccaagtttacgtacgcgggcttgcaacgtcatagctcttctataggggcccctaaattcaattcacgggccggcgttttacaacgtcgggacggggaaaacccgggggttacccaatttaatcgccttgaagcaaatccccctttcgcc

SEQ ID NO: 1124 - DNA, 656 bp, Brassica napus
attttgtggaaaggatctcactttgagcaatggctccagctaaagttgatgttactaagaaggctgactcaaaggccaaggccttgaaagctgcgaaagcggtgaagtcaggccaaatcatcaagaagaaggcgaagaagatcaggacaaaggtgacgttccacaggccaaagacattgacgaaggctagagacccgaagtacccacgcatcagtgcaactccgaggaacaagttggaccactacggaatcctcaagtacccactcaccaccgagtccgcaatgaagaagatcgaagacaacaacaccttggtcttcattgttgacatccgtgcagacaagaagaagatcaaggatgctgtcaagaagatgtatgacattcagaccaagaaagtcaacaccctcattaggcctgatggaacgaagaaggcgtacgtgagattgactcctgattacgatgctttggatgtagctaacaaaatcgggatcatctaatcttatcataccattgttcttttggagtttaaaacacagacttcttgtttctgtttctttattatgagttttgttagagaaattaatgatacgtctctttgctgtgctttatcgttggactccaagatatgttttggtactagtgcgttataattttcttat

SEQ ID NO: 1125 - DNA, 1753 bp, Brassica napus
  misc_feature (743)..(743): n is a, c, g, or t
  misc_feature (745)..(745): n is a, c, g, or t
  misc_feature (747)..(749): n is a, c, g, or t
  misc_feature (751)..(751): n is a, c, g, or t
  misc_feature (1714)..(1714): n is a, c, g, or t
ggactcccctaaagataaataataaataaaaccctcaaaactgatactagggttttcgtttcgccgctccagattttgcggaaaggatctcactttgagcaatggctccagctaaagttgatgtcactaagaaggctgatccaaaagccaaggccttgaaagctgcaaaagcggttaaatcaggccaaatcatcaagaagaaggcgaagaagatcagaacaaaggtgacattccacaggccaaagacactgacgaaggctagagaccccaagtacccacgcatcagtgcaactccaaggaacaagttggaccactacggaatcctcaagtacccactcaccaccgagtccgcaatgaagaagatcgaagacaacaacaccttggtcttcattgttgacatccgtgcagacaagaagaagatcaaggatgctgtcaaaaagatgtatgacattcagaccaagaaagtcaacaccctcattaggcctgatggaacgaagaaggcctacgtgagattgacccctgattacgatgctttggatgtggctaacaaaatcgggatcatctaatctatcattccattttccttttgctcaaaaaacagactttcatgtttttctcttctgtagtttcagttttgttaattaaggatactaccatctctttgtgcttcttcgttagactcgaagataatgttttggtattacttgttcgttataattttcttagtcttgttcccctctttnanannnanaaaaaaaaaactcgagctcctttatattttagttatggccaagattggtttgaaacccgacccggttaacaataatgccaaggagattcgttacagaggcgttaggaagaggccatggggccgttatgccgcggagatccgagatccgggtaagaaaacccgggtctggctcggtacttttgataccgccgaagaagcggcgcgtgcttacgatgcggcggcgcgtgatttccgtggggccaaggctaagaccaatttccccaattttctcgagctgagtgagaaggtgccggctgccggcggcgggttcgagcgtagccctagccagagcagcaccctcgattgcgcttctcctccggcggcggttacgccggcgagtgctgggattgctccgccgcagctcgagcttcgcctcggcaactatcagatcccgttggcgcgtcctgtttacttcttggacgttatgggagtaggcaacggaggtcgtgctccgcctccggtggcgtcggcttttaggttgccggtgatgcatgtggctacaaaggttgcttgtgtggctcagagcgactctgattcgtcgtcggttgttgatttcgaaggtgtgatggagaagagatctcagctgtttgatctagatctaaacttgtctcctccgtcggaacaggcctgaacttatcgaaggtggtcgtggtcgtgctcatttccgacgcgcatgcgttttttttgtttgtttgggagctgagagaattcgtattctcgtagttttttattctctctcactctagaataattattattatcggttttaagaaaaaaacttcaatcgggagagagaatataattttagctgacatggatcgttatgtacatattattacataactggagatctgaacttttgttgtgtgcttttttgcgacttggtttcaccttgttgttcctctatctgtagcctttaatttnttattgcaaattaattccactcacggagatctatcatct

SEQ ID NO: 1126 - DNA, 713 bp, Manihot esculenta
ggacggctgcagctgctgctcaggtctgtcatcttcatctgtttaattttgctctttgaagagttttaatcaatggctccagctaaagctgatgctaccaaaaagactgatcctaaggcacaagctgtgaaggctgccaaggcggtgaaatcagggccaacatttaagaagaaagctactaagatcaggacaaaggtcacgtttcaccgtccaaagacattgaagaaagagagaaacccaaagtatccacgcatcagtgcaccaccgagaaacaagttggaccactatcaaattctgaagtatccactgactaccgagtctgccatgaagaagattgaggacaacaacacgctcgtattcattgttgacattcgtgcagacaagaagaaaatcaaagatgcagttaaaaagatgtatgacatccagaccaagaaagtcaacactttgatcaggccggatggaactaagaaggcatatgttaggttgacgccagactatgatgccttggatgtagcgaacaagattggcatcatctaagtgttgctaacgtactttatgaacagttttgttagtaattctgtgttctagtgccacaacattttgtctgttttctttaacactttggggaaactatattttgtttattttagttaaagtttaattgttatggtcaatttttttcgatctttataaagcgattttgctcatttcaa

SEQ ID NO: 1127 - DNA, 761 bp, Manihot esculenta
gtcatctgagagttgatgaataacaatttctctttgttttagggtttcaggcaattagaaaggtctagttttattgtggattagtagcaatggcgccagctaaagctgacagttcaaaaaagcctgatgcaaaggcacaggctgtcaaggctgcaaaagcagtgaagtctggtccaaccttcaagaagaaggccagtaagatcagaactaaggttacatttcatcgcccaaagacattgaagaaggagaggaatcccaaataccctcgcattagtgctccacccaggaacaagcttgatcagtatcagattttgaaatttcctctcactactgagtcagctatgaaaaagattgaggacaacaatacccttgtattcatagttgatattcgtgctgacaagaaaaagatcaaggatgcagtcaagaagatgtatgatattcaggccaagaaagttaatacattgatcaggcctgatgggacgaagaaagcatatgtcagattgacaccggattttgatgccttggatgtggcaaacaaaatcggcatcatttaaattagttacaggctgtcgctttctagttctcatcattttgttttgtttcagagtaaggtatttttgctgtgacatcaagcagagagatttgctaaattgcagagagatttgctaaattacttcaaacttgtaaacttgtggtactgctttcttgttatgttccatcgtttttaatataattggggactttataggcttgaagttttc

SEQ ID NO: 1128 - DNA, 732 bp, Manihot esculenta
gttcttttcaattagggcttccatcgattggaaggttttagcgaagtttcttgtgggttagtagcaatggcgccagctaaagctgacagttcaaagaagcccgatccaaaagcacaggctatcaaggctgcaaaagcagtgaagtctggcccaacctttaagaaaaaggccaacaagatcaggacaaaggttacatttcatcgcccaaaaacattaaagaaggagagaaatcccaaataccctcgcataagtgctccaccaaggaacaagcttgatcattaccagattttgaaatttcctctcactactgagtcagctatgaaaaagattgaggacaacaatacacttgtatttatagttgatattcgtgctgacaagaaaaagatcaaggatgcagtcaagaagatgtatgatattcaggccaagaaagttaatacattggtcaggcctgatgggacaaagaaggcatatgtcaggctgacaccagattttgatgctctggacgtggcaaacaaaattggaatcatctaaattacttgctgtatttttctctccatttctcataattttttttgttccagattagggtaattttgttgtgctgtcaagcagtgagattttcaaaattacttcaaaaattgtagtactgtcttatggtttcattgtcattggatacattgtaggattgaagtaccatttacctgttctaatttgagccattggattacttgt

SEQ ID NO: 1129 - DNA, 685 bp, Ricinus communis
gctctcaaaccctacatacggctcagctgctgcttgcccgcccgcctgcccacagggtttcaagtgattaaaaaagggtttacttcaaagcttgttgtctattagcagcaatggcaccacctaaagattcgaagaagcctgatgccaaggcacaggcagtgaaggctgcgaaagcagtgaagtctggaccaatatttaagaagaagtccctgaagatcagaactaaggttacattccaccgcccaaagacattgaagaaggataggagtcccaagtatcctcgcatcagtgctccaccaagaaacaagcttgaccagtatcagattttgaagtatcctctcacaactgagtctgctatgaagaaaattgaggataacaacactttggtgttcattgttgatctccgtgctgacaagaaaaagattaaggatgcagtcaagaagatgtatgatattcaggccaagaaagtcaataccttgatcaggcctgatgggacaaagaaagcctatgtcagattgacaccagactacgatgccttggatgtggcaaacaaaattggaattatctaatttagttcctggttcttactagtttttttccttttgttttgttcgagagtaaggtatttttgttgtgacatcaaacaaggaaatttgctaaattactttaaactttgtggtactgc

SEQ ID NO: 1130 - DNA, 665 bp, Ricinus communis
tataatgcatcatttcatcttctccactgctgagccgcagatatctaggtttaggaagtttgtcatcaatggcacctaaaggtgatgctgccaagaaaactgatgccaagtcacaggctgtgaaggctgcaaaggctgtgaaatcaggtacaacatttaagaaagctaagaagatcaggacaaaggtcacatttcaccggcccaagacattgaagaaagatagaaacccaaaatatccacgcatcagtgcaaccccaagaaacaagttggaccagtatcaaattctgaagtatccactgaccactgaatctgctatgaagaagattgaggataacaacaccctcgttttcatagttgaccttcgggctgacaaaaagaaaattaaagatgcagttaagaagatgtacgacattcagaccaagaaagtgaatactttgatcaggcctgatggaactaagaaggcatatgttaggttgactccagactatgacgccttggatgtggcgaacaagattggtatcatataaaatacagttttgtagccattggtcttgagcaaagttatttttgaaagttttgttaggtgtactgcactgtgctaggattttattgttatgtttgtttttctccttaaatatatgtgaggatttatgtttttttttaca

SEQ ID NO: 1131 - DNA, 723 bp, Catharanthus roseus
aacccaaaccctaaacgcagcagcagccaccgcagaagtgacaggctacagcacggtaaggttttcgcggctgattaacaatggctccccctaaagctgttccgtcgaagaagtcagacccaaaggctcaagccgtaaaggctgctaaggctgtgaagtcagggtcaacagccttcaagaagaagcccacgaagatgaggacgaaagttaccttccatcgtccaaagacgcttaagaaagacaggaatcctaagtatccaagaatcagcgctcctcccagaaataaacttgatcaataccagattcttaagtatccccttacgactgaatctgctatgaagaagattgaagacaacaacacacttgtcttcatagttgacattcgtgctgacaagaaaaagatcaaggatgccgtcaagaaaatgtatgacatccagaccaagaaggtcaacactcttatcaggcccgatggaaccaaaaaggcctacgttaggttgacacctgattacgatgctttggatgtggcaaacaagattggaatcatctaaatattagtgttttgcaatttagagttgtatttgcttattattgggagttgagacatcttgaattagatattagatgcgaagatagatatcatttctattacaatgaatttgttgcaagttataaaacaattttgtctgttggcttacagtgctatattattatccatgttttctt

SEQ ID NO: 1132 - DNA, 754 bp, Catharanthus roseus
gctacagcacggtaaggttttcacggctgattaacaatggctccccctaaagctgttccatcgaagaagtcagacccaaaggctcaagccgtaaaggctgctaaggctgtgaagtcagggtcaacagccttcaagaagaagcccacaaagatgaggacaaaagtaaccttccatcgtccaaagacgctcaagaaagacaggaatcctaagtatccaagaatcagcgctcctcccagaaataaacttgatcaataccagattcttaagtatccccttacgactgaatctgctatgaagaagattgaagacaacaacacacttgtcttcatagttgacattcgtgctgacaagaaaaagatcaaggatgccgtcaagaaaatgtatgacatccagaccaagaaggtcaacactcttatcaggcctgatggaaccaaaaaggcctacgttaggttgacacctgattatgatgctttggatgtggcaaacaagattggaatcatctaaatattagtgttttgtaactttgagttgtgtgctcgagaacttggtttctagattattgggagttgagacatcttgaattagattttagacatgaagatagaaatcatttctgctacaatgtttttgttgaaagttataaaacaatcttgtctgttgacttactttttctcagtgctatatgttttcttccttaattgagttaagaaagactttcaaatgcaaaaaaaacctcgtgccgaattctttggat

SEQ ID NO: 1133 - DNA, 763 bp, Cenchrus ciliaris
  misc_feature (333)..(333): n is a, c, g, or t
  misc_feature (459)..(459): n is a, c, g, or t
  misc_feature (474)..(474): n is a, c, g, or t
  misc_feature (480)..(480): n is a, c, g, or t
cgcttcgcgtccgccgccgccaggagaggtaagtccaggaagcagttctgagaagctcaaatggcgcctaaagctgctcctgccaagaaggctgatgccaagacccaggccttgaaggttgccaaggctgtgaagtctgggacaatcaagaagaagaccaagaagatccgcacatctgtgacatttcaccgcccgaagaccctgaagaaggctagggacccgaagtacccaagagtcagtgctcctggaaggaacaagcttgatcagtaccaaatcctgaagtaccccctcaccactgaatcagcaatgaagaagattgaagataacaacacncttgtcttcatcgttgacctcaaggcggacaagaagaagatcaaggctgctgtcaagaagatgtatgacattcaggcaaagaaggtcaacaccctgatcaggcctgatgggaagaagaaggcttangtgaagctgacaccngactangatgctcttgatgtggccaacaaaatcggcatcatctaagttacatgctactgtgttaggcatctgtgtcctagttctctgtgaaacgagagttttgtagctattccttatcttgggccacagtggctccattaccatgtcttgatgcacacttatgaatttggtatcacccaagtgaccggttgagctaatttgagctttgcagtttgcacttgcttatactatcagtcctttatgagcagaccattatcttttcttgcataacaactggttttgtatgtca

SEQ ID NO: 1134 - DNA, 702 bp, Centaurea maculosa
  misc_feature (11)..(11): n is a, c, g, or t
tcgctgctgtnttcctatttctcttttgcagttgatcgatttggagcaggtaaggtcagcaatggctccccctaaaggtgatgttaagaaaggcgatgcaaaggctcaggccttgaaggcagccaaagctgtgaagacaggttcaacctttaaaaagaaggctaagaagatccgaaccaaggtcactttctttcgtccaaggacattgaagacagacagaaacccgaagtacccccgtatcagtgccccaccaagaaacaagcttgaccactaccagatactcaaatacccattgaccacggaatctgcaatgaagaagattgaagacaacaacactctggttttcattgttgacatccgtgctgacaaaaagaagatcaaggctgcagtgaagaagatgtacgacatccagaccaagaaagtcaacactttgatcagacctgatggaacaaagaaggcttatgtccggttaactccagactatgatgctttggatgtggcaaacaagattggaattatctaaggtaatgtgtttttttttcagtttaaaggaggaatgtatggcagttttgttagttttttttttgggtcttgaaatactacttttaagttaaatgcgattatattcaatttggattcaatgttgctaatggagcatgcttcagctgcttcttgcgttttttgttatgttgctgttctttc

SEQ ID NO: 1135 - DNA, 686 bp, Centaurea maculosa
  misc_feature (143)..(143): n is a, c, g, or t
cttggcgggggctccgcgcctcttcacgttttcaggttgatctatcatcggagtagcttctgttaacaatggcgcctaaagctgacagcacaaagaaaggtgatgcaaaggctcaggccttgaagacagccaaggctgtgaanaccggttcaaccttcaagaagaaggccaagaagatccgaaccaaggtcacctttttccgcccaaggacattgaagaccgacaggaaccccaagtatcctcgcatcagtgccccaccaaggaacaagttggaccactatcagattcttaagtacccattgaccacagaatctgcaatgaagaagatcgaagacaacaacacccttgttttcatcgttgacatccgtgctgacaagaagaagatcaaggctgccgtgaagaagatgtacgacatccagaccaagaaagtcaacacacttatcagacccgatggaacgaagaaggcttacgttcgattaactccagattatgatgctttggatgttgcaaacaagattggtatcatctaagctaaggtgctattgtttcagtgaggttttgtgttgtcattttgaccttattgttagttttgttgtcttgaatagcattctgaatttctttctgtgtttgccttaaattttggattcaaaaaatgcttaatggatcatacttcaatagttggagcc

SEQ ID NO: 1136 - DNA, 775 bp, Centaurea maculosa
  misc_feature (7)..(7): n is a, c, g, or t
  misc_feature (24)..(25): n is a, c, g, or t
  misc_feature (57)..(57): n is a, c, g, or t
  misc_feature (177)..(177): n is a, c, g, or t
  misc_feature (259)..(259): n is a, c, g, or t
  misc_feature (459)..(459): n is a, c, g, or t
  misc_feature (489)..(489): n is a, c, g, or t
gcggggngtgctcattttcttgcnngagtttatcagtctttggagcttggtttagcnatggcgcctgctaaagctgatgctacaaaaaaaggggatgcaaaagctaaggcgttaaagacagccaaggctgtgaagacaggttcaaccttcaaaaagaaagctaagaagatccgaacnaaagttactttctttcgtccaagaacattgaagacagataggaaccccaagtatcctcgtatcagtgccccaccaaggaacnaattggaccattatcagattctcaaatacccattgaccacagagtctgctatgaagaagatcgaggacaacaacactttagtcttcattgttgacatccgtgctgacaagaagaagatcaaagctgccgtgaagaagatgtatgacattcagaccaagaaagtgaacaccttgataagacctgatggaacgaagaaagcntatgttcggttaactcccgactatgatgcncttgatgtcgctaacaagattggaatcatctaagctagttggaacatttttgttagttgtgatgtcttgaatagtattccaatttcaaaaccttctaaagactcacatttgccaatttggtacggattttagttgatattttatctaatttggtttacggagtgaaacaagtcgttcatatttatatctttgtagaattaggtgctgattatgtacccttggtttttgccttagctcttaaggttcttgaacaatgcctatattcatctagtaaggtaatgtgact

SEQ ID NO: 1137 - DNA, 787 bp, Castanea mollissima
ttctctctctctctctctctctctcgcaggtaaggaagtgatttgggtagagttttcttcgttttgcaatggctcctgctaaagctgacagcacaaaaaagtctgatccaaaggctcaagccttgaaggctgccaaggctgtgaagtctggagcaacctttaagaagaaaactaagaagatcaggacatctgtcacatttcataggccaaggacattgaagaaggcaaggaaccccaagtatcctcgcatcagtgctccacctagaaataagttggaccattatcagattctcaagtttccattgactaccgagtctgcaatgaagaagattgaagacaacaacaccttggtcttcattgttgacatccgtgctgacaagaagaagatcaaggatgctgtgaagaagatgtatgatattcaggccaagaaagtgaacactttgatcaggcccgatggaactaagaaagcgtatgttaggttgacaccagactatgatgccttggacgtggcaaacaagattggcatcatctaagatattactttgtatccagtgtcttgagcaaagtgactctgtccttccttgctatgacagttttgatagtaatgaggcattctgttaggactacaaatatcagttggttatttaaatttgtattgggatctatatttttgttacaacttttgcaattggattctgattaggatgatgtgagttatttgtggtggtgatttgccattggttaccctatcttttctatttgcaatgccatttcttctgttttatag

SEQ ID NO: 1138 - DNA, 863 bp, Castanea mollissima
gtccctcctccgcttccctcttaacaccacagggttttcaggtaattgaaggggtctgaggccgagcttcttctgattcagaaatcaatggctcctgctaaagttgacagttcaaaaaaggctgatccaaaggctcaggccttgaaggctgctaaagcagtgaaatctggtgcaaccttcaagaagaagactaagaagatcagaacatcagttacatttcaccgtccaaggacattgaagaaggcaaggaatccaaagtatcctcgcattagtgctccaccaaggaacaagcttgatcattatcagatcctcaagtttccccttactaccgagtctgcaatgaagaagattgaagacaataacactttggttttcattgttgacattcgtgcggacaagaagaagatcaaggatgccgtaaagaagatgtacgatattcaggctaagaaagtgaatactttaatcaggcctgatggtaccaagaaggcatatgttagattgacaccagactatgatgccttggatgtggcaaacaaaattggtattatctaaattaatgtctggcatcctcattcaaagcagcccttccttttcttttttgtccttcaatttcagtctaaatagtaagacagttctgctaggactgtaagcacctagatttttcaaaactagtttaaaagttgtaatcttgtgttctctctttggtgttttttttgtttggtttaactgaaatttcaaccaatgagacttgaagttatgatttgggtgtgttagagagagatgtgttgaatcttttacattatgcaagctttaatgaaattaatgtgttaaacgaaatcctgaaaaaagttgataaaaaaaaa

SEQ ID NO: 1139 - DNA, 729 bp, Cicer arietinum
attcttgttcctcttcctccgacgcacagggttatttaacaggtagagtttctttcctccccgcaactcatggctcctaaagctgatgtttctaaaaagactgatccaaaggcacaggccttgaaaactgccaaggcagtcaagtcaggcccttcctttaagaagaaggccaagaagatccgtacctctgtcactttccatcgcccaaagacacagacaaaggataggaacccaaaataccctcgtattagtgccacaccaaggaacaagcttgatcactaccagattttgaagttcccacttaccaccgagtctgcaatgaagaaaattgaggataacaacaccttggttttcattgttgacttgcgcgctgataagaagaagataaaggatgcagtgaagaaaatgtatgacatccaggcaaagaaggttaacaccttgatcaggcctgatggtaccaaaaaggcctatgttaggttgactcctgattacgatgcattggatgttgcaaacaagattgggattatctaagtacctggcttttctctggttctatttagatgttagacagttttatggtgatcattgatggaaacttttggaaaagggataagttctataatttgtgctttgttgttttgtattttttgtttcaattgatgacacttatcagaccttgtgtttcaattttgactggagagttatttaaattgatgattgacatgaaca

SEQ ID NO: 1140 - DNA, 680 bp, Cicer arietinum
gattagcgtggtcgcggccgaggggcaggcagcgcccagggtttcgctcagatttcacatctagggtctatttttctccgccgatccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaaaggagaggaacccaaaataccctcgtattagtgctacaccaaggaataagcttgatcactatcagattctgaaatttcctctcactactgagtccgcaatgaagaagattgaagacaataacacattggttttcattgttgacttgcgagctgacaaaaagaaaatcaaggacgcagtgaagaaaatgtatgacatccaagccaagaaagttaacaccttgatcaggcctgatggcaccaagaaggcatatgtgaggttgacacctgattatgatgctttggatgtagcaaacaagattggaattatttaaggtaatgtctgctggcttcaccaaagacagtttttatttagatggtagtctttttgtggtactttttgaagtaatgttaagttctggatttcacgttgttatttggtgtattttagttcaatcgcaattag

SEQ ID NO: 1141 - DNA, 686 bp, Cichorium intybus
ggcgggggctccgcgcaactctccccttcccgttttgcaggttgatcagttgttggagtagaatctgtttacaatggcgcccaaagctgacgcaacaaagaaaggagatgcaaaggctcaagcattaaaagcagccaaggctgttaaaaccggttcaacattcaaaaagaaggcaaagaagatccgaaccaaggttacttttcatcgcccaagaacattgaagacagacagaaaccctaaatatccccgcatcagtgccccaccaagaaacaaattagaccactatcaaatccttaagtacccactcaccacagaatctgcaatgaagaagattgaagacaataatacccttgtcttcattgttgacatccgtgctgacaagaagaagatcaaagatgcagtcaagaaaatgtacgacatccagactaagaaagtcaacacattaatcaggcctgacggcacaaagaaggcttatgtgcggttaactccagattatgatgcattggatgttgcaaacaagattggaatcatctaagtgagtaattgtttttggtcaaaaggggcattttcgtcatttcaacaacattgttagttttattgtcttgaatagtgttttaaatttcttctgtttgctttgaattctggatttaaatatggtaatgcagcatacttcattagtcaaaaaa

SEQ ID NO: 1142 - DNA, 782 bp, Cichorium intybus
ggcgggggcgtcactcttcccatttcctttttgcaggtggattggagtaggttcggcaagcaatggcacccgctaaagctgatgttacaaagaaaggagatgcaaaggcacaggccctgaaggcagcgaaggcagtgaagacaggttcaactttcaagaagaaggccaagaagatccgcacaaaagtgacatttcaccgcccaagaacattgaagactgacagaaaccctaagtatccccgcatcagtgccccaccaagaaacaagcttgaccactatcagatattgaaatacccattgactactgaatctgcaatgaagaagattgaagacaacaacaccctggttttcattgttgacattcgtgctgacaagaagaagatcaaagatgcagtgaagaagatgtacgacatccagaccaagaaagtcaatactttgatcagacctgatggaacgaagaaggcttatgttaggttaactccagactatgatgcattggatgtagcaaacaagattggaataatctaaggtaaaatgtttcagtttaaagggaacgtgtatgctcattgtggcagttttgttagttttatcatcttgaatactacttcaagtttaatgcggttattttttatttggattcagcatatggtaatggagcgtacttttagctgctttaagttgttttgttatatttttgttacgtttttacttatgatttgattgagttacaatatctattgatgataatgatcataagcattggtccatggtgcttgaaaaaaa

SEQ ID NO: 1143 - DNA, 649 bp, Cichorium intybus
atcgtctcgctcatttctttgcacagttaatcagtcgtcggagtagcttcgttagcgatggcacctgctaaagctgacattacaaagaaaggtgatgcaaaggcacaggcattgaagacagcaaaggctgtgaaaacaggttcaacattcaaaaagaaagctaagaagatcagaacaaaagttacattccatcgtccaagaacattgaagacagatagaaaccctaagtatcctcgtatcagtgctccaccaagaaacaaattggaccactatcagattctgaaatatccattgactacagagtctgctatgaagaagattgaagacaacaacaccctggttttcattgttgacatccgtgctgacaagaagaaaatcaaagatgctgtcaagaagatgtatgacatccagaccaagaaagtcaacaccttgatcagaccggatggaacgaagaaagcgtatgtgcggttaactcctgattatgatgctttggatgttgctaacaagattggaatcatctaagttggtttgaatcggtttgtgtggaaagtgagacagttttgttagttgtgttgttttgaatagtattttgaattttaatacttttatggattcacttttgccaatgaaagattttcaatagtttgtt

SEQ ID NO: 1144 - DNA, 723 bp, Citrus sinensis
ctccggccgcagcaagcaacttacctctcgcaggattcagaggtgtttcgtaggacaagtccaatccaatggctcccaaagttgacagctcaaaaaagggtgatccaaaggcccaggctactaaggttgccaaggctgtgaaatcagggccgacttttaagaagaaggcgaagaagatgcggacctcagttacattccataggccaaagaccctgaagaaggacagaaaccccaagtatccccgcattagtgctccaccgaggaacaagttggaccactaccaaattctcaagtatcccttgactaccgagtcagctatgaagaagatcgaggacaataataccttggttttcattgttgacatccgtgctgataagaggaagatcaaggatgccgtcaagaaaatgtacgaaattcagaccaagaaagtcaacactttgatcagacctgatggaactaagaaggcatatgttaggctgactccggattatgatgcattggatgtggccaacaagattggaattatctaaggagtgagttcgtgtgtattgtcaacagttttgttaggactccaatttcgttttggttattttcaaatatgtactcagatctatcttttatattgagtttttgcattggatgcctattaagatcatcgttaaacttgttctgccattaactgcatctcattaaatcaaaatccttgcacttattgttggtttc

SEQ ID NO: 1145 - DNA, 727 bp, Citrus sinensis
tttataaaccctagtttcctcttcacaaagaccaaatcccacgagccggctcctctactgcccacttacaggtaagttctcatcatcgccggcgaacaatggctcctccaaaaggtgagacaaaaaaggctgatccaaaggttcaggccttgaagactgcgaaagcagtgaagtctggccgtacctttaagaaggccaagaagatccggacttcagttacatttcaccgtccaaagacattaaagaaggaccggaatcccaagtaccctcgcatcagcgctccacctaggaataagcttgaccattatcagattctcaagtacccactcaccactgaatcagcaatgaagaaaattgaagacaacaatactctggttttcattgttgacatacgggctgataagaaaaagataaaggatgcagttaagaagatgtatgatatccaggctaagaaagtgaataccttgatcaggcccgatggtacaaagaaggcttatgtcaggttgacaccagactctgatgctttggacgtagcaaacaagattggaatcatttaaacaattgatctttcattcacatttttgtgtattttttaatccaaaaagttagttatgttaagacctcaaacaaagatttccaaatttgttcctgttaactgtttatgaattttatcccctgcattaacaaattggtgggtgcatgaaataatgcactggtctgataatgc

SEQ ID NO: 1146 - DNA, 734 bp, Coffea canephora
  misc_feature (722)..(722): n is a, c, g, or t
ccaacactcagctcctcccgtcgacactgggctcctcccctcaggtaaaacatttgtgtggcagtttacagcaatggctcccaaagctgacaccacaaaaaaagttgatacaaaggctcaggcagccaaggttgccaaatttgtcaaatctgggacaactttcaagaagaaagccaagaagatccggaccaaagttaccttccatcgtcctaagacattgaaaaaggacaggaacccgaagtacccacgcatcagtgctcctcctaggaataagttggaccattatcagattctcaaatatccgttgactactgaatctgccatgaaaaagattgaagataacaataccttggttttcatagttgacatccgtgctgataagaagaaaatcaaagatgcagtgaagaagatgtacgacatacagaccaagaaagtgaatactttgatcaggcctgatggaacaaagaaagcgtatgttcggttgactccagactacgatgctttggatgtggcaaacaagattggaataatatgaatgaatgtagttattgttttgttccgatcaagatactgtcttttaagtgtgacaatttgctaggctcttttgtcctgaattttagttctgttttggtaactgaaaatcttaatcagcattttcctatactggagataccattagtttaatttcgaggaaactcatggtgtagtgaaaaattttgccntttgttcttcct

SEQ ID NO: 1147 - DNA, 770 bp, Gossypium hirsutum
ggcacgagctccagcaaaccctagagccgctcgcttccccatctacagggtttacaaagggattgaggcagctgtaaccaatggctcccaaggttgagaagaaggcagatgcaaaagcacaggccttgaaggctgcgaaagcagtgaaatctggagccacttttaagaagaaggccaagaagatccgaacaaaggttacgtttcacaggccaaggaccttgaagaaagataggaacccgaagtatccacgcattagtgccccaccgaggaacaagcttgaccattaccagattctcaagtttcccctcacaactgagtcagccatgaagaagattgaggacaataacactttagtatttattgttgacatccgtgcagacaagaagaagatcaaagatgctgtgaagaagatgtatgatattcaggccaagaaagtgaacaccttgatcaggcccgatggcacaaagaaggcatatgttaggttgacgccggattacgatgccttggatgttgcaaacaaaatcggaattatctaagcagttggcgactaccttgttttgaatgctttattttttgtgttttgttgcaaggtgagactgttattttcagattcagctggaagatttaagctttagtttttttgttttttaaggttgtaatcttgctttactgccacttaatcatctttggtataaacttaagtcagaaggtatttaacatgttttcatatttgtttaaatgggtgatgcttgaatttcgctattctactt

SEQ ID NO: 1148 - DNA, 825 bp, Gossypium hirsutum
ggcacgaggcccattggacattaaagtaagttcgagaaccctaatcgcctcatcttccccactcttcccatcgagagctaactctagacggctcattagcttctccattgtcagaatttagaagggtttgaggaagcagcaagcaatggccccaaaagtcgagaagaaaggagatccgaaggcacaagccttgaaagctgcaaaagcagtgaaatccggtgtcacttttaagaagaaagcaaagaagatccgaacaaaggttacattccataggccaaagaccttgaagaaagacaggaaccctaaatatcctcgcattagtgctccaccgaggaacaagcttgatcattatcagatcctcaaatttcccctcacaactgagtcagcaatgaagaagattgaagacaataacactttggttttcattgttgacattcgtgctgacaagaagaagataaaggatgctgtaaagaagatgtacgatattcaagccaagaaagtaaacaccttgatcaggcctgatggtacgaagaaggcatacgttaggttgacacctgattacgatgccttggacgtggcaaacaaaatcggaattatctaagcgtgttatcgttctgtatctagctgccttgtttcgagcatttaattttgtttttgttcaaaagagtaattatgcagttattttgagacttttgaacattgagttttagttttagctcttaaagattgtagccatgcttaaaatccaacttgatgagttttcacttttaattgacttgttttgacatatatatattggtaatgatgattcagtgctccaaaaaa

SEQ ID NO: 1149 - DNA, 787 bp, Gossypium hirsutum
  misc_feature (14)..(14): n is a, c, g, or t
  misc_feature (16)..(18): n is a, c, g, or t
  misc_feature (771)..(771): n is a, c, g, or t
aactagcaaacgcntnnnggctccgcttcttcatcgacagggtttacaagggtttgaggcagccgcaaccaatggcccccaaagttgagaagaaatcagatccaaaggcacaggccttgaaagcagcgaaagcagtgaaatctggagccacatttaagaagaaggccaagaagatccgaaccaaggttacattccacaggccaaggaccttgaagaaggataggaccccaaagtacccacgcattagtgctccaccaaggaacaagcttgatcattatcagattctcaagtttcccctcacgactgagtctgcaatgaagaagattgaagacaacaacactttggttttcattgttgacattcgtgctgataagaagaagattaaagatgctgtcaagaagatgtatgatattcaggccaagaaagttaacaccttgatcaggcctgatggaacaaagaaagcatatgttaggttgacacccgaatacgatgccttggacgttgcaaacaaaattggtattatctaggctagttggtagctaccttgttgagcatttattttccttttgtttgcaaagagaaattatttcgagacattgagcaggtatttttatttttattagcacttaaaagtttgtaatattgcattgttgttgccaattagccatctctggttcaacttaagacagaaggtgatttttgatttacatgctttggggcatttgtttaaaaatggttcactgcttgaatgttagctatttatacaaaatnttcccatttccttttc

SEQ ID NO: 1150 - DNA, 1987 bp, Gossypium hirsutum
gacgcctcctctgcttcttctttgacaactctatcggtagggtttagaagggtttgaggccagcagccaccaatggctcccaaagttgagaagaaggcagatccaaaggcacaggccttgaaggctgcgaaggctgtgaaatctggggccacttttaagaaggcggcaaagaagatccgaacaaaagttacattccacaggccaaagaccttgaagaaggataggaaccctaagtatccacgcattagtgctccaccgagaaacaaacttgatcattatcagattctcaagtttcccctcacaactgagtcagctatgaagaagattgaagacaacaataccttggttttcattgttgatattcgtgcagacaagaagaagataaaggatgctgtcaagaagatgtatgacattcaggccaagaaagtgaacaccttgatcaggcctgatggtacaaagaaggcatatgttaggttaacacccgactatgacgcattggatgtggcaaacaaaattggtattatctaagctagttggttgctacgttgttattttgagactttgagcaggaagatatatttttagctgttgaagttgtaatcttgctttactgccatttaaccttctgtggttaactgaagtatttttgtttaatatgttatttcaagaaaaaaattgtttgacattgttctgtgctgaaatgcacttattgcttcaaatatagagacttgatttctttagtgaaaaaaaaaaaaaaaaaaagaaatgatatatatatatataaagctaataagagttgcaaaggtaagcacaaattatgaatttgaaattactcacaaacaatcaatctattgaaccagatacttaaaacatcagagataacatgccaatgaaaaagagcaagaatcatatttttaacttcaacctaccagaatgaaacacccttggtagaaaacctagctgaccttgattatttgttgtcgctattgccaccatactgcgtagaatttccattccagaagggatttctatccgagaaacggctgtcatcctcatcgtgttttagtgtgtgaatattgctaccatattgggatgttgtgggtcgtctgttcctgctgtcggtcgaactgtgtctgtttgtcgagttaggtgaatatgtcctgtttgctccagccaagttattttgcagtgtagggtttggaccgtattcccagatgccactttgagattccggtccagtagttgaagagctggtaccagtaccaccaccaagataagaaaaaggattgaaataggacataaagcttctaacatatgcaaaatatcccccattgcttcctgcggtagcttcagaaggtgtagaatttctttggtcagcaaatgatctttgcccttggaagccagtgcttctctgacgtggaaccactatcagtgcttgtctgttaagcagacccaagtccaataaagatgtactcaaatcttgatcaccaaataacttgcgaggataaggaatggcaagatcataagatcccatgccacttgattggtttctatccacatagtcttttatcattctcagggtgttgcccacaggaaacttctcttgtaggctactgccatcaggtaatctgatatttaaataaacatcagttggtacatttgtggttgcagtattttcagacgcaccatcttgccttccatctattgatttatccttttcatgttgcatggctttctctggtgcactcccaccgggaaaacttgactgatgatcaatgcccttgactgagatgaaacaatcatctccaggataagaggatgtatcctcagatacaggaactgctggatttaaggtaacagaagtaccaaccgtcctggttgcttcattagaaacattacattgttcatccacaacattagtcaagttgtcagtgctaaatgattctgaagtacccaaggtcaaccaattctgaaattttctcctgaa

SEQ ID NO: 1151 - DNA, 855 bp, Gossypium hirsutum
  misc_feature (14)..(14): n is a, c, g, or t
  misc_feature (20)..(20): n is a, c, g, or t
  misc_feature (26)..(26): n is a, c, g, or t
  misc_feature (28)..(28): n is a, c, g, or t
  misc_feature (47)..(47): n is a, c, g, or t
  misc_feature (53)..(54): n is a, c, g, or t
ttccttagactggngactcncgccgncntgcggtcgacactagtggntccaannaattcggcacgaactctcaagcagccgcggctagaaaagggttattgaagtaagaaatttagcaatgtctcctgctaaagttgacagcaagaaaaaggccgatccgaaggctcaagcagtgaaggctgctaaggctgtaaaatcgggcgtggcatttaagaagaagtccaagaagatcaggacaaaggttacctttcatcggccaaggactttgaagaaggaccgtaaccctaagtatcctcgcatcagtgcaccaccaagaaataagttggatcaatatcaaattctcaagtatcctttaactactgagtctgcaatgaagaaaatcgaggacaacaacaccttggttttcattgttgacatccgtgctgacaagaagaagattaaagatgctgtgaagaagatgtatgacattcagacaaagaaagtgaatacgttgatcaggcctgatggaaccaagaaggcgtatgttaggttgactccggattatgatgctttggatgtggcaaacaagattggaattatctaagcagatcaaccaatgtcttccttgctttcaacagttttgttagaacgattaactatgttaggactctttattttcgtgtctgcattatatgtgtaaggaactatgtttttcctacttaaagtctgcatgggatttggtttaggattttacacacgatgtcctgaatgaatggattttactttttggttttaatcgagtcaaggttcaagtagtaaagaataagaagattagaaaggagagctcgaaagtacttctaaagcggccgcggggcc

SEQ ID NO: 1152 - DNA, 819 bp, Vigna unguiculata
  misc_feature (668)..(668): n is a, c, g, or t
ggatcagctgttcaaccctaaaccctaattttggcttctgcttctgcaaccctccgattttcaaggaggttgtgagaattgttggtgagtgattgatatggctcctactaaggtggtcaatgctaaaaaggctgatcccaaagctcaggccttgaagacggccaaggctgtaaaatctggtggccaagtttttaagaagaaaaccaaaaagatcaggacatctgttacatttcacaggccaaagacattgaagaaggacaggagccctaagtatcctcgcattagcgctccgcccagaaacaagttggaccattatcagatacttaaatttcctctaactacggaatctgcaatgaagaaaattgaggataataatacactggtttttatcgttgatcttcgtgctgacaaaaagaaaattaaagatgctgtcaagaagatgtatgacattcaggccaagaaagtaaacacattaatcaggccagacggaactaagaaagcctatgttaggttgactccagattatgatgccttggatgtagccaataaaattggtattatctaagttgtactcttggtgatatagcctattttgagttgagaacatttttaggaagtaggttttttatactggcataattattttctctgaccgattccctgctttnttagttaatgattactattgtagtatgtcgttatatatctcatatgaaagcagtttttacctcaaaattgtattccttcttaatccacaaggattaattgtgattttctgcgttactttttgtacaaatgcagagtttgtttctctgttca

SEQ ID NO: 1153 - DNA, 720 bp, Vigna unguiculata
ggagagccggtttgttcctctgcgcaggaattcggaatatttgacaggtagagtttcttcaatggctcccgctaaagttgatagttctaagaagggtgatccaaaggcacaggccttgaaaactgctaaggcagttaagtctggacctacctttaagaagaaggcgaagaagatccgaacttctgtgactttccacaggccaaagacattgaagaaggacaggaaccctaagtaccctcgcattagtgcgccaccaaggaacaagcttgatcattatcagatcctgaagttccctcttactactgagtctgctatgaagaagattgaggacaacaacaccttggttttcattgttgacctacgtgcagacaagaagaagatcaaggatgcagtgaagaaaatgtatgacatccaggccaagaaagttaacaccttgatcaggcctgatggcaccaagaaggcttatgtcaggttgacccctgattacgatgctttggacgtggcaaacaagatcggcatcatctaagatagtacatgggttttattaaatgttaggcagttctatggtgattcttgacggtaacttttcaaaaaaggataggttctatatttcgggtttttttattttgtatcttttggttcagttgacactaagcaaacaccgtgtttcaattttgactcttaaattgatgcttgaaatgagcatgttaaaattttata

SEQ ID NO: 1154 - DNA, 750 bp, Vigna unguiculata
ggaggttgccactgcatctcactcgcagggttttcgaagatttaagaactagggtttcttcccctttcgcgactcatggctcctaaagctgatagttcaaagaaggccgatgctaaggcacaagccttgaaaactgctaaggcagttaagtcaggtgctacctttaagaagaaggccaaaaagatccgaacttctgtcaccttccatcggccaaagactttgaaaaaggataggaaccccaaatacccccgcattagtgctccacccaggaataagcttgatcactatcagatactgaagtatcctctcacaactgagtccgcaatgaagaagattgaagacaacaacactttggtgttcattgttgacctgcgggctgacaagaagaagatcaaggacgcagtgaagaagatgtatgatattcaggccaagaaagtcaacaccttgatcaggcctgatgggaccaagaaggcttatgtcaggttgacacctgactatgatgccctggacgtagccaacaagattggaattatctaaattaataccaggcatcaccgaattcgatttctgtttagatggtagtttgttttgtggtgatctgaggtagacatttgaaacaaattaagttctaaattttgcggtttgttatctggtgtattttagttcaattggaattaaatttatctttgttacaatttccagtttgatgagtaaatgagttatcatgattcattcttcaaaaaaaaaaaa

SEQ ID NO: 1155 - DNA, 864 bp, Cryptomeria japonica
gcgggtttctcacgccttgggtgggaattaactgaacgttcgtcaccttaacgaacatcactgtaagcagaaggcgaagggagccaggtgagaggcaggttgaagaacagcacaggaaggaggagtcggagggaagcagaaggtgaaacgcagcaatggctcctcccaaaggtgctgcaaagaaggctgatcctaaaggacaggcacaaaaggctgctaaagctgtgaaagctggagcaattacattgaagaagagaacaaaaaagattagaacatcagtaacttttcatcgtccaaaaacactcaagacaccccggaatcccaaataccctcgtctcagtgcacctcacaggaacaagcttgatcaatatgaggttctcaagtaccctttgactacagaatctgcaatgaaaaagatagaagacaataatacacttgtcttcattgttgatgtacgggcagacaagaagaagattaaggatgcggtgaaaaaaatgtatgacattcaaaccaagaaggtcaacaccttaatcaggcctgatggattgaagaaggcatatgttaggttgaccccagattatgatgcgttggacgtagctaacaagattggcatcatctaaatctctaaaggcttgtctgtagtttaagttaaatttgtatttccaagtaatctgtgttttgtactttgttcctagtatagtaaagaccaaaacttgtatattgctggttggtatcactatcaccttttgcaggtggagcaatatacggtttagaattttgcagctacattttctttcgaatttcattatggtctttaagttcctatttttctatcatttttaatgagaagcataccaattgagt

SEQ ID NO: 1156 - DNA, 925 bp, Cryptomeria japonica
gagaggcaggtcgacgaacgccacaggaaatagaaggcaaagggaagcggaaggcgaaacgcagtaatggctcctcccaaagctgctgcaaagaaggctgatcctaaaggacaggcacataaggctgctaaagctgtgaaagctggagcaattacattgaagaaaagaaccaaaaagattcgaacatcggtaacttttcaccgaccaaagacactcaagacacctcgtaatcctaaataccctcgtctcagtgcacctcgcaggaacaagcttgaccagtatgaggttctcaagtaccctttgactacggaatctgcaatgaaaaagatagaagacaataatacacttgtcttcattgttgatgttcgggcagacaagaagaagattaaggatgcagtgaaaaaaatgtatgacattcagactaagaaagtcaacaccttaatcaggcctgatggattgaagaaggcatatgtaaggttgacccccgattatgatgcattggacgtagctaacaagattggcatcatctaaatctctacaggcttcatcttagtttaggttaactttgttgcatttctaagtaatctgtgttttgtactttgcccttagtatggtaaagaccaaaacttgtacattgctgcttagtatcactatcaccttctgcaggtggagcaatatgcagttttgaattttgcagcagcgtttcctttcaaatattattagtcttcaaattcttatttttctatcatttttaatgagaagcataccaattgagcaaaaaatgtaccttacatttgctgcgttgccttttcaaccatatgaattttgcagatacattgtattatgaatcaattatggtccttaatttccatttttctcttatttctaatgagaagtatacctattgcgaataagccataactcc

SEQ ID NO: 1157 - DNA, 483 bp, cucumber
tttatatttaatttgatggttttgcagctgacatgaccaaaaaggctgatcccaaagctcaagccttgaagactgccaaggcagtcaagtctgggccaacatttaagaaggctaagaaaatcagaacatcggtcacattccatcgcccaaagacattgaagaaggataggaatcccaagtatcctcgaatcagtgtgactcctaggaacaagttggatcagtatcaaattcttaaatatccactcaccactgagtctgccatgaagaagattgaggataataacacccttgtttttattgttgatattcgtgccgacaagaaaaagattaaagatgctgtcaagaagatgtatgacattcaaaccaagaaagtcaacactctaatcagacctgatggaacaaagaaggcctacgttaggttaaccccagactatgatgcattggacgtggcaaacaagatcggaattatctaaacttcctagg

SEQ ID NO: 1158 - DNA, 791 bp, cucumber
tcggccgcagccttccatctcgccattcctctcttcgcaggtaagtttttctggtcaaggatcttcagcaatggcacctaaagctgatagtagcaaaaaggctgatcccaaggctcaagccttgaagactgctaaggcagtcaagtctggcccaactttcaagaagaaggctaagaagattagaacttcagtcacattccataggccaaagacattgaagaaggataggaatcccaagtatcctcgaatcagtgtgactcctaggaacaagttggatcagtatcaaattctgaaatatccattgaccacagagtctgcaatgaagaagattgaggacaataacaccctcgtctttattgttgacattcgtgccaacaagaaaaatattaaagatgctgtgaagaagatgtatgatattcagaccaagaaagttaacactttaatcagacccgacggaacgaagaaggcatatgttaggttaactccagattatgatgctcttgatgtggcgaacaagattggtatcatctaaacttcagagcttggagccagcattttaattgcaatttgttacatgtttaaattttggagaggattttgtagtaggaggaccctagttttgttttagcttcctttttaatatgtattggtatttgtttgctcagatagactgggttcacaatacttggaatgttggaacatgcattccaaccattttcattatagtttgcttcagactccattacatcattactgaatttttggtctttacatcttctctttggttcttc

SEQ ID NO: 1159 - DNA, 892 bp, cucumber
ttgatatttctgtgtgtgtgtgtgttctttttctatcctgaacaggtcggagtagggattaggtagaggactctgcaatggctccaaaagctgacagcaccaagaagactgaccctaaggctcaagccttgaaaactgccaaggcagtaaaatcgggcccaacatttaagaagaaagccaagaaaatcaggacatccgtcacatttcaccgaccaaagacattgaagaaggacagaaatcccaagtatccacgcattagtgttactccacggaataagttggaccagtatcagattcttaaataccctctgactactgagtctgcaatgaaaaagattgaggacaacaatactttggttttcattgtggacattcgcgctgataagaaaaagatcaaggatgctgtgaaaaagatgtatgacatccagaccaagaaagtgaacacgttgatcagacctgatggaaccaagaaggcatacgttaggctgactcccgattatgatgctttggatgttgcaaacaagattggaatcatctaagttaattagcactcgttttttgtttgagaaaactgattatctttctgcaatgacaattttgatttatggaatgacctcgattttctccagcaaattagtaagatgttttctactaagctattgcaacgcatgttgactcgtgaaccgtagaatgtgttcttgaatgttttttgtagtttgtatttttttaactcaaatgacttcactcatttccattcacgatacaatctagtgtcgggtctggcctcgcatggttccaactaagcctgctaggtgtattttcttcaaaccaagaaattttcaccaatttttctcggtctctaccctgaattaataattttgacttccatttg

SEQ ID NO: 1160 - DNA, 680 bp, Cynara scolymus
tcctggtgtatcgtctcttcctcatttcccttttgcagttgatcgatttggaggaggtacggttagctatggctcccgctaaaggtgatgttacgaagaaaggtgatgcgaaggctcaggccttgaaggctgccaaagctgtgaagacaggttcaacctttaaaaagaaggctaagaagatccgtaccaaggtcacttttcatcgaccaaggacattgaagacagacagaaacccaaagtatcctcgtatcagtgccccaccaagaaacaagcttgaccactatcagatactcaaatacccattgaccacagaatctgcaatgaagaagatcgaagacaacaacactctggttttcattgttgacatccgtgctgacaaaaagaagatcaaggctgcagtgaagaagatgtatgacatccagaccaagaaagtcaacactttgatcagacctgatggaacaaagaaggcttatgtgcggttaactccagactatgatgcgttggatgtcgcaaacaagattggaataatctaaggtaacatgtcttttcagtttaaaggaggaatgtatggcagttttgttagttttattgttttggatactacttcaagtttaatgcgattatattcaatttggattcaacgttgctaatcgagcgtgatttagctgcttcatgcaaaa

SEQ ID NO: 1161 - DNA, 717 bp, Taraxacum officinale
tcggcgggggctgctgtgtcacaactctcctcctcatttcgtttttgcaggtggattggagtagcttctgctagcaatggcaccagctaaagctgatgttgcaaagaaaggagatgcaaaggcccaggccatgaaggcagcaaaggcagtgaagacaggttcaaccttcaagaagaaggccaagaagatccgcacaaaagtcacatttcaccgcccaagaacattgaaaaccgacagaaaccctaaatacccccgaatcagtgccccaccaaggaacaagcttgaccactaccagatcctcaagtacccattgaccactgaatctgcaatgaagaagattgaagacaacaacaccctggttttcattgttgacatccgtgctgacaagaagaagatcaaagatgctgtgaagaagatgtacgacatccagaccaagaaagtgaatactttgatcagacctgatggaactaagaaggcgtatgttaggttaactcctgactatgatgctttggatgttgcaaacaagattggaattatctaagctgagatgttttgggttaaagggaacgtgtatgctgattttggcagttttgttagttttattatcttgaacagtacttcgagattaatgtggttaattttgatttggattctgtgtttggtgttggagattgttttaactgcattaagttactttgttgttttgaggcaaaaaaa

SEQ ID NO: 1162 - DNA, 606 bp, Taraxacum officinale
gggcccactctcgctcacccgtcctcggtctcgctcatcaatcgtttcactagcttggtttagcgatggctcctgctaaagccgacactacaaagaaaggtgatgctaaagctcaagctttaaagacagcaaaggctgtgaaaacaggttcaacattcaaaaagaaagctaagaagatcaggacaaaagtaacattccatcgtccaagaactttgaagacagataggaaccctaagtatcctcgaatcagtgccccaccaagaaacaaattggaccattatcagattctcaagtacccattgactacagagtctgccatgaagaagattgaggacaacaacactttggtttttattgttgacattcgtgctgacaagaagaagatcaaagatgctgtcaagaagatgtatgacattcagaccaagaaagtcaataccttgatcagacctgatggaactaagaaggcttacgttcgattaactcctgattatgatgctttggatgttgccaacaagattggcatcatctaaattagtttgttgtgttttgaattttgaaatttttatgaattcacatttgccaatgaaggattttcaatagtttgtt

SEQ ID NO: 1163 - DNA, 720 bp, Eucalyptus gunnii
  misc_feature (688)..(688): n is a, c, g, or t
cggccggggaccctaggcgacctctctgaaccagtccaccggccgtagggttttcgcaggatccagagggtttcagaaggaccatatccagccgccatggcccctcctaaaggtgacaatgtgaagaagtctgatccgaaggctcaggccttgaaggctgcgaaggcagtcaagtcgggaccgacctttaagaagaaggcaaagaagatccggacttcagttacctttcacaggccaaggaccctgaagaaggacagaaaccccaagtatcctcgcatcagcgctccaccgaggaacaagctcgaccattatcagatcctcaagtatcccctcactacggagtctgcgatgaagaagattgaggataacaatactttggtattcattgtagacatccgagctgataagaagaagatcaaggatgcagtcaagaaaatgtatgatattcaggccaagaaagtcaacaccttgatcaggcctgatggtacgaagaaggcatatgttaggcttactccggactttgatgctctggatgtggcgaacaaaatcggcattatctaagttggaattgttttttcagtctgatcaccattcttctcttagtgctaagacaattttgttgaggagttgagaatggactcatttgtaatttgatgctactgttagttaaaatatttttggcgctctnaaaattaagatttgaagtggagtgattaaatt

SEQ ID NO: 1164 - DNA, 758 bp, Eucalyptus gunnii
  misc_feature (6)..(6): n is a, c, g, or t
  misc_feature (329)..(329): n is a, c, g, or t
  misc_feature (406)..(406): n is a, c, g, or t
  misc_feature (458)..(458): n is a, c, g, or t
  misc_feature (580)..(580): n is a, c, g, or t
  misc_feature (654)..(654): n is a, c, g, or t
  misc_feature (729)..(730): n is a, c, g, or t
cggggncgggggaagccgcggtggtgtctgagcggaactcactcggaggtttttaagctttgcttaggtaggatttcgtcgacggggaaatgtctccaattaaagctgaccctacgaaaaaggccgaccctaaggcccaggcactgaaggctgctaaggctgtcaaatcaggtgcggcaaccttcaaaaagaaggctaagaagatcaggacatccgtcacatttcatcgtccgaggacattgaagaaggaaagaaatccgaagtatcccagaatcagtgcacccccaaggaataagttggatcattatcaaattctgaagtatccactnactactgaatctgcaatgaagaagattgaggacaataacacgctagtcttcattgttgacattcgtgctgacaaganaaagatcaaagatgccgtcaagaagatgtatgaaattcagaccaaaaaagtnaacaccttgatcaggcccgatgggactaagaaggcatatgttaggttgacgccagattatgatgctttggatgttgccaacaagattggaattatctaaagctagaaaatgccagatgttcngccgagtggaatattttctgtttgtagcttccatagatttctcgagagttttgagttggcttgcagtatactcntttctcgttttccctctaatagatgtgcactttgaattgagttgtttcaatctctattctccaactgatgcttannatgaatggtcagaaaaggtttttgatag

SEQ ID NO: 1165 - DNA, 418 bp, Festuca arundinacea
  misc_feature (4)..(4): n is a, c, g, or t
  misc_feature (287)..(287): n is a, c, g, or t
tgcngttcaagaagctgtcctgagaagttcaaatggctcccaaagctgctgttgcgaagaagggcgatgccaaggcccaagccgtgaaggttgccaaggctgtgaagtctgggtcaatcaagaagacggcaaagaagatccgcacgtcagtgacgtttcaccgccccaggaccctgaagaaggccagggaccccaagtacccaagagtcagcactcctggaaggaacaagcttgatcagtaccagatccttaagtaccctctcaccactgagtctgcaatgaagaanattgaggacaacaacactcttgtcttcatcgtcgacctgaaggcagacaagaagaagatcaaggctgctgtcaagaagatgtatgacatccaggccaagaaggtcaacaccctgatcaggcctgatggcaa

SEQ ID NO: 1166 - DNA, 697 bp, Linum usitatissimum
ggaaccctagaagaagaagacggcgagcattccctgctgctgcatccgacgcccagtggttctatcgatttgctgcaatggctcctccaaaagataacaagccgaagccagatgccaaggcacaggcagtcaaagctgcaaaagcagtgaagtctggtccaacattcaagaagaatgtgaagaagatcaggaccaaggtcacattccaccgtccgaggacattgaagttggagaggaaccccaagtatccgaggattagtgcacctccaaggaacaagcttgatcattaccagatcttgaagttccctctgaccactgagtctgcgatgaagaagatcgaagacaacaacactctggtcttcattgtcgacatccttgctgacaagaagaagatcaaggatgccgtcaagaaaatgtatgatatccaggcaaagaaagtcaataccctcatcaggcctgatggaaccaagaaggcatacgttaggttgacgcctgactacgatgcattggacgtggcaaacaaaattgggatcatctaagctctgctagttcctgttcatttggttttttctctagggatttcctgataccattgtttcagagagtaagaagttttgttttgcatcacaaatcacttgtggacttacaatttggaaacgatgttaggcttgaattgtttttgggctcacttgcttcc

SEQ ID NO: 1167 - DNA, 659 bp, Gerbera hybrid cultivar
cagctcgcctcgtttccattttgcaggttaatcgatcggagtagcttcgtttagcaatggcgcctaaagctgatgtgacaaagaaaggtgatgcaaaggctcaagccttgaaagcagccaaggctgtgaaaacaggttcaaccttcaagaagaaggccaagaagatccgaaccaaggtcacttttcaccgtccgagaacactgaagacagatagaaaccctaagtatcctcgtataagtgccccaccaagaaacaagcttgaccactaccagattctcaaatacccgttgaccacagagtctgccatgaagaagattgaagataacaacaccctggtgttcatcgttgatatccgtgctgacaaaaagaagatcaaagctgcagtcaagaagatgtacgatatccagaccaagaaagtgaatactttgatcagacccgatggaacgaagaaagcttatgttcggttaactccagattatgatgctttggatgttgcaaacaaaatcgggattatttaagttaaagatgttgtttcagtttaaaagggtaatgtatttcaagttttgttagttttatcgtcttgaatagcatttcaagtttaatgcgaatgttttcaatttggattcgaacttgctaactgggtgtactctttttgctcg

SEQ ID NO: 1168 - DNA, 718 bp, Gerbera hybrid cultivar
tcttcctcatccccattttgcagtgatcggtcgttggagtagcttctgtcaacaatggcgcctaaagctgacaccacaaagaaaggtgatgcaaaggctcaggcctgaaggcagcaaaggctgtgaagacaggttcaacattcaaaaagaaagccaagaagatccgaactaaagttacctttcaccgccccaggactttgaagacagacaggaacccgaagtatcctcgcatcagtgccccaccaagaaacaaattggaccactatcagattctcaagtacccattgaccacagaatcagcaatgaagaagattgaagacaataacactcttgttttcattgttgatatccgtgctgacaagaagaagatcaaagatgcggtcaagaagatgtacgacattcagaccaagaaagtcaatactttgatcagacccgatggaacaaagaaagcttatgttcggttaactccagactatgatgccttggatgtcgcaaacaagatcggaatcatctaaggtaagctgtcatcatttcagtcgaagagggtattattgtcatttcaacacttttattagttttgtcagttctaatagtattccaaaatttattctgtttgttttgaattatggattcagcttcgcaaatggatcatacttcaatagttggagttagtttgttatgttttgatagttctttctaaaaaaaaaaaaaaaaaaac

SEQ ID NO: 1169 - DNA, 644 bp, Gerbera hybrid cultivar
tcaaagaaaggtgacgcaaaggctcaggccttgaaggcagccaaggctgtgaaaacaggatcaactttcaaaaagaaagctaagaagatccgaaccaaagtcacctttcatcgtccaagaacattgaagacagacaggaaccccaagtatcctcgtattagtgccccaccaagaaacaaattggaccattatcagatcctaaaatacccattaacaacagaatctgccatgaagaagatcgaggacaacaatactctggtttttattgttgatattcgtgctgacaagaagaagatcaaagctgccgttaagaagatgtatgacattcagaccaagaaagtcaataccctgatcagacccgatggaacgaagaaagcttatgttcggttaaccccagactacgacgccttggatgttgctaacaagattgggatcatctaaggttgttcgtatattgttttcttaggtgtgatatgttgaatagtattccaaatttaagttgttttatttgaatctttatttgctaatggggcatttttatttatgtaatactggtttttaggtaatgttttctgatttaatacttgcttaacatcatcattaatgatattatctatattgtattataatgttatctatttcgg

SEQ ID NO: 1170 - DNA, 702 bp, Zingiber officinale
  misc_feature (5)..(5): n is a, c, g, or t
  misc_feature (7)..(7): n is a, c, g, or t
  misc_feature (684)..(684): n is a, c, g, or t
gcacnanggttggccggagccgtcgcagcgatcgttcattgcttgtgaaactttttcattaagatcagatggctccaaaagctacttcaaagaaatctgatgagaaaacacaggctgagaaagccgccaaggctgtgaaatcaggaacaaccattaagaaagccaagaagatcaggacctcagttacttttcatcaacccaagacacttaaaaagcctagaaaccccaagtaccctagaattagcgccccgccaagaaataagttggatcactatcaaatcctaaagtatcccctgaccactgagtctgccatgaagaaaattgaagacaacaacacactagtcttcattgtcgaccttcgagctgacaagaagaagatcaaagctgctgtgaaaaaaatgtatgatattcaggccaagaaagttaatactctaatcaggcctgatggaactaagaaggcttatgtgagattgaccccagactatgatgctctggatgtggcaaacaagattggtatcatctaaatctgctgacagggactatttgttcgtagttaagttattaggtttcctaattgttggaagttgagttccattctaagaaaatatttgtggaccaagtgttttgaacttgacaatgttttgcttattattgtcttgactttattttttggaactaagaatnctgctgagattttccttc

SEQ ID NO: 1171 - DNA, 652 bp, Zingiber officinale
aagaaacctgatgataaagcacaggctgagaaagttgcgaaggccgtgaagactggatcaactctgaagaagaaaaccaagaagatccggacctctgtaacttttcatcggccaaagactcttcaaaagcccagaaacccaaaataccctagaattagtgctccaccaagaaacaagttggaccactatcaaattctcaagtatcccttgaccactgaatctgctatgaagaaaattgaagacaacaacactcttgtcttcattgttgatcttagagcagacaagaagaagatcaaggctgcagttaagaaaatgtatgatattcaggcgaagaaagtgaatactctgatcaggccggacggaactaagaaggcttatgtgagactaacacctgattatgatgcccttgacgttgcaaataagattggtatcatctaaaggcaactatgatggcaagcctcatgatcacagcagcttcgtcagtagttggagttgagagtttattctaagaacactttgaatattaccttaaatttttgtttggcgtgttgtgctctgtagaaacttttgataatcatgcaaaactctgattttaaaaaggtatttctcgtttggtttcatttttcattttctatttatcagacaatcaact

SEQ ID NO: 1172 - DNA, 804 bp, Vitis vinifera
ctactctgcagccgcatcaacccttcctctctcccaggtttggaagtgctttaagcagagtttttgcatcctgcaatggctcctgctaaagttgatcctacaaaaaaggcagatcctaagactcatgctgctaagactgccaaggctctgaaatcaggtacagccacttttaagaagaaagctaagaagatccgcacatcagtcacatttcatcggccaaggacattgaagaaggacaggaaccctaagtacccacgcattagtgctccttcaagaaataagctagaccagtatcaggttctcaagtatccactgactactgaatctgcaatgaagaagattgaggacaacaacaccctggttttcattgttgacatccgtgctgacaagaaaaagatcaaagatgcagtgaagaagatgtacgaaattcagaccaagaaagttaacactttgatcaggcctgatggaaccaagaaggcttatgttaggttgacaccggactatgatgccttggatgtggcaaacaagatcgggatcatctaaatctatattgcctttttgtctcaagtgaaagttttatgatttatcagtactattgacagttttgttaggaatgttttgctgagatttggctgcaatttcattttgttagttttggatatgtatggagaacttcagtttctgtttcaactttggcaatggaatgcaaattctgaggatttacattcttgaaatacttgatgaatggatattctgtgttatcgattcatgaaatctctctgttcattggaatgttgcccgtga

SEQ ID NO: 1173 - DNA, 663 bp, Vitis vinifera
acaggtagagttttagccttttaggtgacatttggtgggcaatggctccttcgaaagttgaatccacaaaaaagactgacccaaaagcccaggcccaaaaggctgccaagacagtgaaatcaggtggagggacttttaagaagaaagccaagaaaatacgaagatcagttacatttcaccggccaaggacactgaagaaggaaagaaatcccaagtaccctcgcattagtgcccctcccaggaacaagcttgaccagtaccagatcctcaaatatcccctcacaactgagtctgcaatgaagaaaattgaagacaacaacactcttgtcttcattgttgacatccgtgctgacaaaaagaagataaaggatgcaatgaagaaaatgtatgacattcagaccaagaaagtgaataccttgatcaggcctgatgggacaaagaaagcatatgttaggttgacgccagattatgatgctttggatgtggcaaacaagattggtattatttaaaatagtaaccaacctttctagattcgaattatgtctttgcttgaagtattttatattttaattacaatgttggttgagaaccttgatcggagagatgaggctataattacataaatgggtttctattgagttgcattttagctggatgtctaag

SEQ ID NO: 1174 - DNA, 884 bp, Vitis vinifera
gcacgccaccacaggtctctccatattcactccactacgtagatatttcatatggtttttcaataaaactgacttttatatatattttgaattttccttgttgattagggtttctatttgattgaaagggtgacagtttgttcagcaatcaatggctcctgctaaagctgatagttcaaaaaaggctgacccaaaggcacaagccgcaaaggctgctaaagcagtcaaatcgggtgcatcaactttcaagaagaaagcgaagaagattagaacgtcagttacctttcatcgaccaaagacattgaagaaggaaagaaatcccaagtatcctcgcatcagtgctccttcaaggaacaagcttgaccagtatcagattctcaaatatcctctcaccactgagtctgcaatgaagaaaattgaagacaacaacactttggttttcattgttgacattcgtgccaacaagaagaagataaaggatgctgttaaaaagatgtatgatattcagaccaagaaagtgaataccctgatcaggcctgatggtaccaagaaggcgtatgttaggttgaccccagactatgatgccttggatgtggccaacaaaattgggatcatctaaggtaggatctgtctacatttctggtgtcttcttgatcaatgctccagagtaggacagtcccactaggatttgaatcagcagggagggttgtgaagggttgtaatgttgtagtactgctggtaatattttggtgttctgcaggttctctgccagtgaaacagagtaggatctttgcatttttcttgaaatatggaattcacttaatatatcttagtttttactgatgcttccaaggaaggttggggtttgatattaaatcaaacca

SEQ ID NO: 1175 - DNA, 600 bp, Mesembryanthemum crystallinum
tgctgccgcagctccacttcctcctccagggtttcgttgcaggttgctacactttcaatggctcctcctgctaaagatggaaagaaggccgacccaaaggcacaggccttgaaagctgccaaggcagtgaaatcaggagcatcaaccattaagaagaaagccaagaagatcaggaccaaggtcactttccacaggccgaggacattgaagaaggagagaaaccccaaatatccacgcatcagtgcgactccaaggaacaagttggatcactatcaaatccttaagttcccattgaccactgaatctgcaatgaagaagatcgaggacaacaacaccttggtttttattgttgacattcgtgcggataagaagaagattaaggctgctgtgaagaagatgtacgacattcaggccaagaaagtcaacaccttgatcaggcccgatggcaccaagaaggcatatgttcgtttgacactcgattatgatgctttggacgtggcaaacaagatcggaatcatataaattgtatttctctacttcttttctcaagcggaatgttttagatctgacaattttgataggagcatcaatctatgatag

SEQ ID NO: 1176 - DNA, 685 bp, Ipomoea nil
gagcagcggcagtcccatcccctcttcttcgtcttccactcttcctctaggtaggctttgtgttcacgcagcaatagcaatggctccgaaagcagctgaaaagaaacctgaccctaaggcacaggctgcaaaagctgccaaggctgttaaaggtacaaccttcaagaagaagactaagaagatccgcacaaaggtcaccttccacaggcccaggacattgaagaaggacaggaacccaaaatatccccggatcagtgctccaccaaggaacaagttggatcattaccaaatcctcaagtatccattgaccactgagtcggcaatgaagaagattgaggataacaacaccttggtttttattgttgatatccgtgctgataagaagaagattaaggatgctgtcaagaagatgtatgagattcagaccaagaaagtcaatactttgatcaggcctgatggcacgaagaaggcatatgttcggttgaccccggactttgatgcattggatgttgcaaacaagatcggcatcatctaagcgcagtattatgcttttgtccagatattatgttgacaattttgttattgtttgttatcaatagatttgaattgttattctggcattctcttaatggtgttttaactagagtttatatcaattcctgctgtttcctactgtccatgagtt

SEQ ID NO: 1177 - DNA, 704 bp, Ipomoea nil
gctcttcagcaacctgttcagctcgtcttccgccaggtaggtgtatttgaagcaactccaatggctccgaaaggtgatagtactaaaaaggctgacccaaaggctcaggccgcaaaggttgccaaggctgtgaaaggtactaccttcaagaagaaggcgaagaagatccgcaccaaagttaccttccacaggcccaggacattgaagaaggagaggaaccccaagtacccccgtatcagtgctccaccaaggaacaagttggaccattaccaaatccttaaatatcccttgaccactgagtctgcaatgaaaaagattgaggataacaacaccctggttttcattgttgacatccgtgctgacaaaaagaaaattaaggatgctgttaagaaaatgtatgacattcagacgaagaaggtcaacactttgatcaggcctgatggtaccaagaaggcatacgtccggttgactccagactttgatgcattggatgttgcaaacaagattggaatcatctaaacataatgttgttcttttgcctaaggctgatgctagattgaaaattttgttacaccttgtttgtgttagtatttttacagttctggtagtattccagtggtgtttaatcagcttttatgtcaacttctactattatgttactttggagattatgaacttccatcaatacattctattttctctcc

SEQ ID NO: 1178 - DNA, 676 bp, Jatropha curcas
cggggaggtacagcccggctgctgttcgctaacagggtttcgagtgattagcaaactttttctggattagcagcaatggcaccaaaagatagttcaaaaaagcctgatgcaaaggcacaagctgtcaaggctgcaaaagctgtgaagtctggaccaacctttaagaagaaagctaagaagatcagaaccaaggtcacattccatcgcccaaagactctaaagaaggagaggaatcccaaatacccccgcattagtgctccaccaaggaacaagcttgatcattatcagattttgaaatatcctcttactactgagtcagctatgaagaagattgaagataacaataccttagttttcattgttgatcttcgtgctgacaagaaaaaaatcaaggatgcagtcaagaagatgtatgatattcaagccaagaaagtgaataccttgataaggcctgatggaacaaagaaagcatatgtaaggttgacaccagactacgatgcattggatgtggcaaacaaaattggcatcatctaaattagttcctggcttttttctaattttcttcattttgttttgttgaagagtaagttattattgttgtgacatcaagcaggaatatttcttaaattacgttaaaacttgtaaacctgtgttactgctgtttggttatgcttca

SEQ ID NO: 1179 - DNA, 757 bp, Actinidia deliciosa
aaagctgcgttcttcttcgtccaacccccatccctcgtctgaaggttggctttgttcagcaatggctcctaaagccgacagcacaaaaaagtccgatccaaaggggcaggccttgaaggctgccaaggctgtgaaatcgggttcagtagccttcaagaagaaagtaaagaagatccgaacatctgttacttttcacaggcccaggacattgaagaaggataggaaccccaaatatccgcgcattagtgcgcctccaagaaacaaattggaccattatcagatcctgaaatacccgctgactactgagtctgcaatgaagaagattgaggataacaacaccctggtttttattgttgacatccgtgctgacaagaaaaagatcaaggatgctgtgaagaagatgtatgacatccagaccaagaaagtcaacactttgatcaggcctgatggaaccaagaaggcatatgttcggttgactcctgactatgatgccctggatgtggcaaacaagattggaattatctaaagattgatttaattgcgctttaatctttagcgaagcctttcttgtcctctgatagttttgttagttgtgttggtcttgggtattaatgcagcagtgctttagtctggtctttcggatcttgtatttgaattttatcggttttcaactttgaaaatgagacatgatttaatcgtttgcttagattttgttgaaacagttttaatttgtactgcctttactttttaaaaaaaa

SEQ ID NO: 1180 - DNA, 740 bp, Actinidia deliciosa
  misc_feature (657)..(657): n is a, c, g, or t
tcagccgcagcaatctctcctctccctctccctcgcaagggtttcagggtgcatcaatggctcctaaagctgatggtacaaagaaggccgatccaaaggcacaggccttgaaagctgccaaggctgtgaaatcaacaaccttcaagaagaaagctaagaagatccgaacctcagttacctttcataggccaaggacattgaagaaggacaggaacccgaagtatccacgcattagtgcacccccaagaaacaaattggaccattatcaaattctgaaatatccactgactaccgagtccgcaatgaagaagattgaagataacaacaccctggttttcatcgttgacatccgtgctgacaagaaaaagataaaggatgcagtgaagaagatgtacgacattcagaccaaaaaagtgaacactttgatcaggcctgatgggacgaagaaggcttatgttcggttgactccagactacgatgccttggatgtggcaaataagattggaattatctaagagcaaatttaacatttcattttaatttgagcaatgttattttattggttctgtaacagttttgttaattgtattgaacttgaatggcaatgcagttttttcatcttgttatgctggatgagtactagaatctttatagtgnccaacttcaagaatgagacataatttcgtcactcgaattattgattttgttacgagtggttatgatttattattgccttcaac

SEQ ID NO: 1181 - DNA, 781 bp, Actinidia deliciosa
aattccgcacgagggccctcctcttcctcggttcgtaaaccctagcacagcactttgtagcagcaggaaaaaacgtagggttcattaggttctagggttattttactcaacaatggctcctgctaaagctgaccctactaagaagtccgacccaaaggcccaggccgtgaaagctgccaaggctgtgaaatccggttcattaacctttaagaagaaggccaagaagatacgaacatcagttacattccaccgaccaaggacattgaagaaggataggaaccccaagtaccctcggattagtgcaccccctaggaacaagcttgatcactaccaaatcctaaaatatccactcaccactgaatcagcaatgaaaaagattgaagataacaacaccttggttttcattgttgatatccgagctgacaagaagaagataaaggatgctgtcaagaagatgtacgacattcagaccaagaaagtgaatacattgattaggcctgatggaacaaaaaaggcttatgtgaggctgacaccagactacgatgctttggatgtggcaaacaagattggtattatctaagatagcagttgaccttacgtattcctgttgtattgttctacttgaagtattttcaacaaatttgaaacatttacccaaggattttctaccgagatagggtctcaatccctatctttgttaagagctgggtcgagttgagatgttctagacttggattgccgtggggttttactttctggttgttgttttttacgttatatt

SEQ ID NO: 1182 - DNA, 681 bp, Actinidia deliciosa
cagcaatctctcatctccctctccatcgcaagggtttcagggtgcatcaatggctcctaaagctgacggtacaaagaaggctgatccaaaggcacaggccttgaaagctgccaaggctgtgaaatcaacaaccttcaagaagaaagctaagaagatccgaacctcagttacctttcataggccaaggacattgaaaaaggacaggaacccgaagtatccacgcattagtgcacccccaagaaacaaattggaccattatcaaattctgaaatatccactgactaccgagtccgcaatgaagaagattgaagataacaacaccctggttttcattgttgacatccgtgctgacaagaaaaagattaaggatgcagtgaagaagatgtatgacattcagaccaaaaaagtgaacactttaatcaggcccgatgggacgaagaaggcttatgttcggttgactccagactacgatgccttggatgtggcaaataagattggaattatctaagaacaattttaacttttcattttaatttgagcaatgctattttattggtactgtaacagttttgttagttgtattgaacttgaatggcaatgcagttttttttgtcttgttatgttggatgtgtgctagaatctttagtggccaacttcaagaatgagacataatttcgtcac

SEQ ID NO: 1183 - DNA, 607 bp, Actinidia deliciosa
tcatctcccactccatcgcaagggtttcagggtgcatcaatggctcctaaagctgaaggtacaaagaaggccgatccaaaggcacaggccttgaaagctgccaaggctgtgaaatcaacaaccttcaagaagaaagctaagaagatccgaacctcagtcacctttcacaggccaaggacattgaagaaggacaggaacccaaagtatccacgcattagtgcacccccaagaaacaaattggaccattatcaaattctgaaatatcaacttactaccgagtccgcaatgaagaagattgaagataacaacacgcttgttttcattgttgacatccgtgctgacaagaaaaagataaaggatgcagtgaagaagatgtatgacattcagaccaaaaaagtgaacacgttgatcaggcctgatgggacgaagaaggcttatgttcggttgactccagactatgatgccttggatgtggcaaataagattggaattatctaaagagctaatttaacattttggcttgagcaatgttattttattggtactgtgacagttttgttagttgtgtgatcttgaatggcaatacagtttttttcggtcttgttat

SEQ ID NO: 1184 - DNA, 708 bp, Lactuca sativa
ggggaaccctagtactagctgccgcaagcaactcttcctcatttcttttttgcaggtggattgcagtaggttcggctagcaatgtcgcccgctaaagctgatgctacaaagaaaggagatgcaaaggcgcaggctctaaagacagcgaaagctgtgaagacaggatcaacattcaaaaagaaggccaagaagatccgaacaaaggtgacatttcatcgcccaagaacattgaagactgacagaaacccaaagtatcctcgtatcagtgccccaccaagaaacaagcttgaccactaccaaatcttgaagtaccctttgactactgaatctgcaatgaagaagatagaagacaacaacaccctggttttcattgttgatattcgtgctgacaagaagaaaatcaaagctgcagttaagaagatgtatgatatccagaccaagaaagtcaacactttgatcaggcctgatggaacaaagaaggcttatgttaggttaaccccagactatgatgctttggatgtagcaaacaagattggaataatctaagtgaggtaaggtgttgttttggtttaaacttgaaagggaaagtgtatgctcattgtggcagttttgttagttttaatatcttgaatgttacaagtttaatgtggttattttttatttggattcttcatttggtaatggaagcatactatagcctctgtttta

SEQ ID NO: 1185 - DNA, 721 bp, Lactuca sativa
ctcggcggggagtgctgccgcgcgtaactctgttcgtcactgttttgcaggttgatagcttgttggagttgcttctgttagcaatggcgcctaaaggtgatgcaacaaagaaaggtgatgcaaagtcacaagctttgaagacagccaaggctgtaaagactggctcaacattcaaaaagaaagccaagaagatcagaaccaaggttacctttcaccgcccaaggacactaaagacagacagaaatcccaagtacccacgcatcagtgctccaccaagaaacaaattagaccactaccagatcttgaaataccctttgaccacagaatctgcaatgaagaaaattgaagacaataatacccttgtcttcattgttgacatccgtgctgacaagaagaaaatcaaagatgcagtcaagaagatgtatgacatccagaccaagaaagtcaacaccttgatcagacctgatggaacaaagaaggcatatgttcggttaactccagattatgatgccttggatgttgcaaacaagattggaatcatctaagtaagttgttttaaagtcaaaaaggggattgtcgtatcaactctattgttagttttattgtcttgaataggtgaactaaatttatttttgtttgcttttaattctggattcaattttgttaatggatcatacttttatggttggagttattttgttatgttgatttccttgttact

SEQ ID NO: 1186 - DNA, 1696 bp, Lactuca sativa
agaatcacaggctctagaatgagaaatggttcccatcactataggagtcgataatatcgctttttgtgaaaccgaattcgcatactcttgtttgcatatcaccaattttggttcttgactccaagatttaaccgaaaaaggacttggattaggttcttgagcatttgaatccgattcttttgtggaaatttcatttgggattgaatctttttctcccttctccctttgttgtaacttctccttgagcatttcaacctcatgtttcaatgtgtcattgtgtttttgaagacaatcaaactctgatttgagtttatcatagcttgagttcaagatctcgtagtctttttcgagttgctttgttttgcatcttgctcgacgattttgaaaccagattgcgacttgtcgtggctgcaaattaagctcttttgcaagctgaatttttctctctggttcgagcttattctcttcctcaaaacttctttcaagaaactgaacttgatccaccgttagccttcttttcttctccggttgccggaaacatttctcgtagtcgtcgtcggagttttcctcgttttccggttgcttctttttatttgatttttcttcatgaaaggagttgggaacccaaggggagtgaaaagaaaggctttgatttttgagcaaagcttcaaacatcattccaccttccatttccattgctttatgagagtgatttaagaagttcctgtgtttgactttttttaaaagggttaaaattagatgatgattgggagatggggcttatgcctaaaaaagcaagtgattagaattacagtcatgtggtagcagagagagatgacacccatgaatcacaatttgatttgggttttgaaaaccatgcaaatttgtgtgtgttttagagagagagagaaagagagagaatcttgtgtggggagtagagcttgatggggtgtttataagagaacatcaaggatccccggccgtacggccgggggaaaccctagctactagctgcgtcaactcttcctcatttccttttgcaggtggattgcagtaggttcggctagcaatgtcgcccgctaaagctgatgctacaaagaaaggagatgcaaaggcgcaggctctaaagacagcgaaagctgtgaagacaggatcaacattcaaaaagaaggccaagaagatccgaacaaaggtgacatttcatcgcccaagaacattgaagactgacagaaacccaaagtatcctcgtatcagtgccccaccaagaaacaagcttgaccactaccaaatcttgaagtaccctttgactactgaatctgcaatgaagaagatcgaagacaacaacaccctggttttcattgttgatatccgagctgacaagaagaaaatcaaagctgcagttaagaagatgtatgatatccagaccaagaaagtcaacactttgatcaggcctgatggaacaaagaaggcttatgttaggttaactccagactatgatgctttggatgtagcaaacaagattggaataatctaagtgaggtaaggtgtttgttttggtttaaacttgaaagggaaagtgtatgctcattgtggcagttttgttagttttaatatcttgaatattacaagtttaatgtggttattttttatttggattcttcatttggtaatggaagcgtactatagcctctgcttt

SEQ ID NO: 1187 - DNA, 1141 bp, Lactuca sativa
ccaaaacattaggattttaattaagttaattctttccaattttaagacattttatgatttgtataataataaatgattttctacattaattttataacacaatatgtcacaaatattttattgaattaccacttaaacgaggcattttcatttataatagcagcagcttccaaactactgataaattcaatgtatgatgacttcttaaaaatgtgtactgttagtttgccacaatggtttttttcaaaattaatacaggagtccaaaatatccgaagtaaatggcctagcgatgatcgtattggcttcaagttgagtattattaggaatgaaatctcttaatgcacttaattggttcataagcacatctatcgaactatttattttttccttttcctctgaatttccgctcaattgttcaaaatcgactttatctacaagttgtaaacgtcttttattatcagacgggcagccatccagtaacaaaaggataaccggttcaccaaatccttccattatctttgcgagctctcgcccatttccatcgtttagccgatcaatcgttgtactagtttggtttagccatgtctcctgctaaagctgatactacaaagaaaggtgatgcaaaagctcaggctttgaagacagcaaaggctgtgaaaacaggatcaactttcaagaagaaagctaagaagatcagaacaaaagttacattccatcgtccaagaactttgaagacagataggaaccctaaatatccacgtatcagtgctccaccaagaaacaaattagaccattatcagattctcaagtatccattgactacagagtctgctatgaagaagattgaagacaacaacactctggttttcattgttgacattcgtgctgacaagaagaaaatcaaagctgcagttaagaagatgtatgacattcagaccaagaaagtcaataccttgatcagacctgatggaactaagaaagcgtatgttaggttaactcctgactatgatgcattggatgtggctaacaagattgggatcatctaagtttaagtgttagtttgaattggtttgtgttgaaagtgttcagttttgttagtgttttggattttaaaacttttatggattcacatttgacaa

SEQ ID NO: 1188 - DNA, 724 bp, Lactuca sativa
ctgtttgtcaccgttttgcagggcctaacctgtccgtttctctgatattcagttgatagcttgtcggagtagcttctgttagcaatggcccctaaaggtgacacaacaaagaaaggtgatgcaaaggcacaagctttgaagacagctaaggctgtaaagactggatcaacattcaaaaagaaggccaagaagatcagaaccaaggttacctttcatcgcccaagaaccctaaagacagacagaaatcccaagtacccccgaatcagtgctccaccaagaaacaaattagaccactaccagatcttgaaataccctttgaccacagaatctgcaatgaagaaaattgaagacaataatacccttgtcttcattgtcgacatccgtgctgacaagaagaaaatcaaagatgcagtcaagaagatgtatgacatccagaccaagaaagtcaacaccttgatcagacctgatggaacaaagaaggcttatgttaggttaactccagattatgatgcattggatgttgcaaacaagattggaatcatctaagtgagttgtgttagagtcaaagggggaattgtcgtttcaacactattgttagttctatcgtcttgaatagtgacctaaattttatttttatttgcttttaattctggattcaattttggtaatggatcatgtacttcagtttttggagttattctgttatgttgatttccttgctact

SEQ ID NO: 1189 - DNA, 800 bp, Lactuca sativa
ggggaacctagttatagctgcgtcgactcttcctcatttcctttttgcaggtggattggagtaggttcggctaacaatgtcgcccgctaaagttgatgctacaaagaaaggagatgcaaaggctcaagccctaaagacagcaaaggctgtgaagacaggatcaacattcaaaaagaaggccaagaagatccgaacaaaggtgacatttcatcgcccaagaacattgaagactgacagaaacccaaagtatcctcgcatcagtgctccaccaagaaacaagcttgaccactatcaaatcttgaaataccctttgactactgaatctgcaatgaagaagattgaggacaacaacaccctggttttcattgttgatatccgtgctgacaagaagaaaatcaaagctgcagttaagaagatgtatgatatccagaccaagaaagtcaacactttgatcaggcctgatggaacgaagaaggcttatgttaggttaactccagactatgatgctttggatgtagcaaacaagattggaataatctaagtaaggtaaggacgtaaggtgttgttttggtttaaagtgaaagtgtatgctcattgtggcagttttgttagttttaaaattttgaatattacaagtttaatccggttttttttatttggattcatcatttggtaatggaagcgtactatagctgctttaagttgtttttgttattttaccatggttttgtcatttgtgatttgattgttttggaacatgtataatgtattgatgatggcgaacacttttttatgttggc

SEQ ID NO: 1190 - DNA, 761 bp, Lactuca sativa
gcgggggctctcccccatttcatcgtttagctgattaatcgttgcactagcttggtttcgcgatgtctcctgctaaagctgatactacaaagaaaggcgatgctaaagctcaggctttgaagacagcgaaggctgtgaaaacaggttcaaccttcaaaaagaaagctaagaagatcagaacaaaagttacattccatcgtccaagaactttgaagacagataggaaccctaagtatccaagaatcagtgccccaccaagaaacaaattggaccattatcagattctcaagtatccattgactacagaatctgctatgaagaagattgaggacaacaacactctggttttcattgttgacattcgtgctgacaagaagaagatcaaagctgctgtgaagaaaatgtatgacattcagaccaagaaagtcaataccttgatcagacctgatggaactaagaaagcctatgtgaggttaactcctgactatgatgcattggatgtcgctaacaagattggcatcatctaagtttagtttgtgttgaaagtgttgagttttgttagtattttgaaattttaaacttttatggattctcatttgctaatggaggattttcaaatagtttgttacgtggtgttggttctttctgatatattatttgctattttggttcattgggttttaaagtttatttcttgttaaaaaaacaaacaatttaatcattttgtagtacatttactttttaattacgtgttatagttc

SEQ ID NO: 1191 - DNA, 705 bp, Lactuca sativa
cgggggaaacctagctactagctgcgtcaactcttcctcatttccttttgcagctggattgcagtaggttcggctagcaatgtcgcccgctaaagctgatgctacaaagaaaggagatgcaaaggcgcaggctctaaagacagcgaaagctgtgaagacaggatcaacattcaaaaagaaggccaagaagatccgtacaaaggtgacatttcatcgcccaagaacattgaagactgacagaaacccaaagtatcctcgtatcagtgccccaccaagaaacaagcttgaccactatcaaatcttgaaataccctttgactactgaatctgcaatgaagaagatagaagacaacaacaccctggttttcattgttgatatccgagctgacaagaagaaaatcaaagctgcagttaagaagatgtatgatatccagaccaagaaagtcaacactttgatcaggcctgatggaacaaagaaggcttatgttaggttaactccagactatgatgctttggatgtagcaaacaagattggaataatctaagtgaggtaaggagttgttttggtttaaactttaaagaggaagtgtatgctcattgtggcagttttgttagttttaatatcttgaatgttacaagtttaatgtggttattttttatttggattcttcatttggtaatggaagcgtactatagcctctgcttt

SEQ ID NO: 1192 - DNA, 546 bp, Leymus cinereus x Leymus triticoides
gcacgaggctcgcctcgcgcaccccaggaaggtaagttcaagaggctgtcctgagaagctcaaatggctcccaaagctgctgttgccaagaagggcgatgccaaggcccaggccgccaaggttgccaaggctgtgaagtctgggtcaatcaagaagaccgcaaagaagatccgcacgtctgtgacatttcaccgccccaagaccctgtccaagcccagggaccccaagtacccaaggatcagcacgcctgggaggaacaagcttgatcagtaccagatcctcaagtatcctcttaccactgaatccgcaatgaagaagatcgaggacaacaacaccctggtcttcatcgtcgacctcaaggcagacaagaagaagatcaaggctgctgtcaagaagatgtacgacattcaggccaataaggttaacaccctaatcaggcctgatgggaagaaaaaggcctacgtgaagctgacaccagactacgatgctcttgacgtggccaacaagattggcatcatataatcaagtcagagagagggtcctgca

SEQ ID NO: 1193 - DNA, 627 bp, Glycyrrhiza uralensis
gccaatccaaaaccctactttcggccgctgcagcagccattcgacctcgatcttcaaggagctcgtgagaagtgtaggtaagagtttgcaatggctcctacaaagggggacaaagctaaaaaagctgatcccaaggctcaggccttgaaggcagccaaggctgtgaaatcaggtggtcaattgataaaaaagaaagctaagaagatcagaacaacagtcacatttcaccggccaaagactttgacgaaggaaaggaaccccaagtatccccgcattagtgcgacaccaagaaacaagttggaccattatcaaatcctcaaatttcccctaactactgaatctgcaatgaagaagattgaagacaacaatacactggtttttattgttgacctccgtgccgacaaaaagaaaatcaaagatgctgtgaagaaaatgtatgacattcaggccaagaaagtgaatactttgatcaggccggatggtacaaagaaagcctatgttaggttgactccagattatgatgccttggatgtagccaacaaaattggtatcatctaagtggtactgcttatttaagcagaggcaatccatcgatgctatgatagttgttatacatatcctatgtta

SEQ ID NO: 1194 - DNA, 820 bp, Liriodendron tulipifera
gccgcacagaccctacgccgctagctctgcgtcttccaggaaaggggatagagtctctttagcaaccaatggctccccctactaaagctgcggctacaaagaaggctgacccaaaggcacaggccttgaaggctgccaaggcagtgaagtcaggtgcatcgaccctaaagaagaaggccaagaagatccggacgtcggtcacatttcatcggccgaagacattgaaaaaagaacgtaaccccaagtaccctcgcattagtgcacccccgaggaacaagctcgatcactatcagatactcaaatatccactcacgactgagtctgcaatgaagaagattgaagacaacaacactctggtgttcatcgtcgacctccgtgcagacaagaagaagatcaaggctgcagtcaagaagatgtacgacatccaaaccaagaaagtgaacaccttgatcaggcctgatgggaccaaaaaggcgtatgtgaggctgactccagactatgatgctttggacgtggcaaacaagatcggcataatctaagtcagagcagggacccttgattccctctacttaatctctggtaatttcttgccttaaagcatactattttgtcttgtgttgacaggtaggatcatgatttcttgcactagattttgttttagagaaacaacacttgtttttagagaacctttgatcatttgattgatccagatcactggaggatggaccttttttgaatgctggctggagcaaaatgtattgttattattgagctgaacgagttctgaagtcatgcaagtgtctgtctgatccaagccatt

SEQ ID NO: 1195 - DNA, 470 bp, Lolium multiflorum
gttcaaatggctcccaaagctgctgttgcgaagaagggcgatgccaaggcccaagctgtgaaggttgccaaggctgtgaagtctgggtcaatcaagaagacggcaaagaagatccgcacgtcagtgacgtttcaccgccccaggaccctgaagaaggccagggaccccaagtacccaagagtcagcactcctggaaggaacaagcttgatcagtaccagatccttaagtacccactcaccactgagtctgcaatgaagaagattgaggacaacaacactcttgtcttcatcgttgacctgaaggcagacaagaagaagatcaaggctgcggtcaagaagatgtacgacatccaggccaagaaggtcaacaccctgatcaggcctgatggcaagaagaaggcttacgtgaagctgacgccagactacgacgctcttgacgttgccaacaagattggcatcatctaagtgcg

SEQ ID NO: 1196 - DNA, 770 bp, Lotus japonicus
ggaccctagcaagctttgttcctcttcctcaggaattgacaggtagggtttcttttcctccagatagctatggcaccaaaagctgatagttctaagaagaatgatcccaaggcacaggccttgaaggctgcgaaagcagtcaagtctggcactaccattaagaagaagaccaagaagatcaggacaactgtcacattccacaggcccaagacattgacaaagaccaggaaccccaaataccctcgcatcagtgccacgcccaggaataagcttgaccactatcagattctgaagttccctctcaccaccgagtcggccatgaagaaaatcgaagacaacaacactttggttttcattgttgaccttcgtgctgacaagaagaagatcaaggctgccgtgaagaaaatgtatgacatccaggctaagaaggttaacacattgatcaggcctgatggcaccaagaaggcatatgttaggttgactcctgattatgatgcattggatgttgcaaacaagattgggattatctaagctagtacctgactctatctagatgttaggcagttctatggtgatcattggcagaaacttttgggaaaagatgacatgttctatattttgtgcttatttgtttgtatcttttgtttcaaatgacattaagcagacctcctgtttcaattttgacttgagaactattgaaatttattgttgaaatgagccacattaaacttttctcagctacttggattttactgaaatcactatttata

SEQ ID NO: 1197 - DNA, 760 bp, Lotus japonicus
ggcaatccaaaaccctaattttggccgcagcagcagcagtcccattttcaaggagcttggaagaagcgttgctgagagctcgcaatgtctccagcaaaggcggacacaactaaaaaggctgatgccaaagctcaggccttgaagacagccaaggctgtgaaatcaggtggcaaggtgatcaagaagaaagctaagaagatcaggacaaccgtcacatttcacaggcccaagacattgactaaggagaggaaccctaagtatcctcgcatcagtgcgaccccaagaaacaagttggaccactatcagattctcaagtttcctttgactactgaatctgcaatgaagaagattgaggataacaacaccctggtttttattgttgacatccgtgctgataaaaagaagattaaggctgctgtgaagaaaatgtatgacattcaggccaagaaagtgaatactttgatcaggcccgatggaacaaagaaagcatatgtgaggttgactccagattatgatgccttggatgtagccaataagattggtatcatctaaattattgtgctgcttcattagagcaaagtcaattcagcattattgagatagttttccatttcctttgttaggactcctttgctatcaccgtgtattaaaatattgtgcattcaattttgtttaccttttgctgaaatcagttcaataccagaagtaactcataattcataactgatttcacatttgctttataattagtatcatttta

SEQ ID NO: 1198 - DNA, 745 bp, Lotus japonicus
ggactgtctctgcttctcacctgcagcgctttacgcagatttgacagggtaggtttctgcttcttcgccgaacaatggcaccaaaagctgatggttcaaagaagactgatcccaaggcgcaagccttgaaaactgcgaaagcagtcaagtctggccctacctttaagaagaaggccaagaagatccgaacaactgttacattccatcgaccaaagactcaaacaaaggataggaaccctaagtaccctcggatcagtgctactccaaggaacaagcttgatcactatcagattctgaaattccccctcaccactgagtcggccatgaagaagattgaagacaacaacactttggttttcattgttgacttgcgtgctgacaagaagaagatcaaggctgcagtgaagaaaatgtatgacatccaagctaagaaagtgaacaccttgatcaggcctgatggcaccaagaaggcctatgttcggttgactccagactatgatgccttgaatgtagcaaacaagattggcattatctaaggtagtaaggttatacttggcttcactgaagtcaatttctatttagatgatagtctgttttacagtgatctctgacattaaccttttgaagcaaggttgagttctaaatttttcagttttttgtttggtgtattttttatctaatagaattgagtttgcttgcttatatttccgatttgatgagtgatgagcatgttttcgttgcccag

SEQ ID NO: 1199 - DNA, 767 bp, Eragrostis curvula
  misc_feature (31)..(31): n is a, c, g, or t
gagacaaaaagaacagaagaagaacgcgaantttggcgtagcgttcgcttgcgtcgccgccgcccgccgccacaggagagtcaatggggtgttctgagaagctcaaatggctcctaaagctgctgttgccaagaagggcgatggcaatgcccaggccatgaaggttgccaaggctgtcaagtctgggcaagtcaagaagaagaccaagaagatccgcacttctgtgacatttcaccgccccaagaccctgaagaagccgagggacccaaaatacccaagagtcagcgctcctggaaggaacaagcttgatcagtaccaaatcctcaagtacccccttaccactgaatctgcgatgaagaagattgaagataacaacactctggtcttcattgtggacctcaaggcagacaagaagaagatcaaggctgctgtcaagaagatgtacgacattcaggcgaagaaggtcaacaccctcatcaggcctgatggaaagaagaaggcttatgtgaagctgacgccagactacgatgctcttgatgtggccaacaaaatcggcatcatctaagttactggctactgcattaggcatctgtgttctggttttatgtgaaacgagagttttgtagctattctgtagcaaagggcctctggtggctcaattaccatctctcttgatgcacacttatgaatttgataccatccaagtgacctatattaagctagtatcagcttcgcacaaaaaaaaaaaaaaaaaaaaaaaaaaaaaa

SEQ ID NO: 1200 - DNA, 806 bp, Eragrostis curvula
gcggctcgctgcctctccccgcaggtagagcaggctgcgctgttgaggtcccaatggcgcctaaagctcccccgaagaaggctgatggcaagactcaggccttgaaggttgccaaggcagtcaagtctggggcggccaagaggaaagcgaagaagatccgcacatctgtgacgtttcaccggccgaagactctcaagaagcccagagaccccaagtacccaagagtcagtgcacctgggaggaacaagcttgaccagtaccaaatcctgaagtacccgcttacgactgaatctgcgatgaagaagattgaggataacaacactcttgtcttcatcgtcgacctcaaggcagacaagaagaagatcaaggctgccgttaagaagatgtatgacatccaggcaaagaaggtcaacactctgatcaggcctgatgggaagaagaaggcttacgtgaagcttacaccagactacgatgcccttgatgtggccaacaagattggcatcatctaaattgtgggttttggtgtctcagtgtgttgcagtttcaagttttggtgggttaggtcttatgtttggacagaactgcatgctaagcttaagtatctgttatgtacttgtgaaccagtcccaacgatggaaatttgcaatgttgaagttccgcatttgtaaaaaaaaaaaaaaaaaaaaaaaaaaaagggcctcggggttgaaaccccgggttaatcaaattcccgcggccccctggggggcggggaccttgcaacctcgggcccatttcgccctatagggggtcgaatacaattcacg

SEQ ID NO: 1201 - DNA, 929 bp, Zea mays
atgaaacctctgccccggggctagggtttcctcccagccgtcatcgcttcacgtccgctacataccggcgaggagacgaaaggagggagttttgagaagctcaaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaattctcaagtaccccctcaccacagaatctgcaatgaagaagattgaagataacaacactctggtctttattgttgacctcaaggcagacaagaaaaagatcaaggctgcggtcaagaagatgtatgacattcaagcaaagaaggtcaacaccctgatcaggcctgatgggaagaagaaggcttatgtgaaactgacacccgactacgatgcccttgatgtggccaacaaaattggcatcatctaagttaataggcaactggattcgacatctgtgtcctactagttctgagcataccaacagatttttctatgttactagtaattttgtttgtcatatttggtttttttgcaactaagtcttgttcgcagttgcagactacatatgcctgtattgagatcctggttgccaaattaaccatcttgaactggcattattccactttacgtataatggctgaatctgttgtggcgttgtgcgaacatgattgatcaccctgcatagtttagtggactattgctaaatacaatatctctgtttatttgctatcagtaaccaacctgtatagattgtagctgaattttgtcgaaatttgcagtcaaccttgatcta

SEQ ID NO: 1202 - DNA, 1135 bp, Zea mays
ggcgcgcattcctcatttagcccacaaggcccacctatattatgggagtgagttactcgggtccattcttaaaaacctctgctcgggcctagggtttcctcccagtcgtcatcgcttggcgtccgcctcagcccgccgccaggagagccggctcggtcggttcgtcgaagatcccggatctgctctgtcacgaggtctttcggcgggtgttgtctcgcgaggtgtagcgagccaagttcaggagagtttcgagaagctgaaatggctcctaaagctgctcctgccaagaagggtgatgccaagacccaggccttgaaggttgccaaggctgtgaagtctgggtcagtaaagaagaccaagaagatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactcttgtcttcattgtcgacctcaaggcagacaagaagaagatcaaggctgctgtcaagaagatgtatgacattcaggccaagaaggtcaacaccctgatcaggcctgatggaaagaagaaggcttacgtgaagcttatgcctgactatgatgctcttgatgtggccaacaaaatcggcatcatctaaagttactgcgtcaggcatctgctgtgctctatttccatgtgaaaccagagtttttgtagctatggctcagtggctccatgaccatgtcttatgcacacttacgaatttgatatcatccaagtcacaggttgtgctcatcaatacttggatactatcacttattcgtattgggttggtctttggctctcacatttctttgtattgggttggtgttttgatctcacctttcttcgcattgggttggtctttggaaattggaactcggcctgatagctgttggagtatagtgtatggatctgcgttcataatgcgagcagcagcgcatggaaattggttacggcaattgtgcatgcaattttctcgaagtgtgccgtgatggagccgcgctgcctgtacacgtgagcttttctcctattta

SEQ ID NO: 1203 - DNA, 441 bp, Zea mays
gctgctcctgccaagaagggtgatgccaagattcaggccttgaaggttgccaaggctgtgaagtctggggtaggaaagaagaagaccaagaagattcgtacgtccgtgacatttcaccaccccaagaccctgaagaaggctagggaccccaagtacccaagaattagcactacctgaaggaacaagcttgatcagtaccaaattctcaagtatcccctcaccacagaatcggcgatgaagaagattgaagataacaacactctggtcttcattgtcgacctcaaggcagacaagaagaagatcaaggctgctgccaagatgtatgacattcaggccaagaaggtcaacaccctgatcaagcctgatggaaagaagaaggcttacgtgaagcctatgcctgactatgatgctcttgatgtggcgaggtgcctgctagactcg

SEQ ID NO: 1204 - DNA, 1104 bp, Zea mays
gtgtttgattccgaggcggggatgacgagcccaatggtgggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaaggggaggtaagttcatgagacaccttcgagaagctgaaatggctcctaaagctgctcctgccaagaagggtgatgccaagacccaggccttgaaggttgccaaggctgtgaagtctggggcagccaagaagaccaagaagatccgcacatctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggaatcatctaagtgctgcattaggcatctgttgtttcctagttcaatctgttgtgtcctagttctatgtgaaaccagagttttgtagctatggatctcaatcgttccattaccatgtgttatgcacacttctgaatttgatatcatccaagtgaccttttgaactagtttgcgttctgcacttcattacacttggacaccgtcagtctttgtgaccagtaatttgtttgtcgtaatgggttggtttgcaactcgaccaaatagctgttttgagtataaccgtgtatgtgtgtgtatccgttgttggagaggctgaggctctctaacaatttctctgattttcccgcgccacccgattaaagtataaaaatcacaactttgatgt

SEQ ID NO: 1205 - DNA, 691 bp, Zea mays
gccgtcttcgcatcgcctcgcgcccgcaccccaggaaggtaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggaaggaacaaattagaccagtaccagatcctcaagtacccgcttaccactgagtctgcgatgaagaagattgaagacaacaacacccttgtcttcattgtcgacctcaaggccgacaagaagaaaataaaggctgctgtcaagaaaatgtatgacattcaggccaagaaggttaacaccctcatcaggcctgatggcaagaagaaggcgtacgtgaagctgacaccagactacgatgctcttgacgtggccaacaagatcggcatcatataagccagagggagggtcctgcagtaggcgcttgtgtcgtggtttcttatgttattggaattttgtagttgttacttagcaaagggccttagtggctccattgcctaccatatcgctgcacactttcatgaatttgatgcaatcgaagtgacgggtgttgatgct

SEQ ID NO: 1206 - DNA, 651 bp, Zea mays
tttcagcttcttagttagcatctctccaggttttgagtgggaagaatcatcttgagctatgtctccagctaaagttgataccacgaagaagactgaccccaaggccaaggccttgaaggctgcaaaagcagttaagtctggccaagccttcaagaagaaggacaagaagattaggactaaggtcaccttccacaggccaaagactttgaccaaggctagagatcccaagtacccaagaatcagtgctactccaaggaacaagttggaccattacggtatcctcaagtacccactcaccactgagtctgcaatgaagaagattgaagacaacaacactctggtcttcattgttgacattcgtgccgacaagaagaagatcaaggatgctgttaaaaagatgtatgacatccagacgaagaaggtcaacaccctcatcaggcctgatggaacgaagaaggcttacgttaggcttacaccagactacgatgctctagatgttgctaacaagattggcatcatctaagtttatcttacctctgctattataaaaaggacttgtggttttgtctctagtagtcaaaacgttgttttacaatacattcgtgttgcacttaattgttgaattcaagttctatgtttttttggcttctt

SEQ ID NO: 1207 - DNA, 783 bp, Zea mays
attctataaaacctctgcccgggggctagggtttcctcccagccgtcatcgtttcgcgtccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatctgttgtttcctagttcaatctgttgtgtcctagttctatgtgaaaccagagttttgtagctatggctctcaatcgttccattaccatgtgttatgcacacttctgaatttgatatcatccaagtgaccttttgaactagtttgcgttctgcacttcattacacttggacaccgtcagtctttgtgaccagt

SEQ ID NO: 1208 - DNA, 744 bp, Medicago truncatula
gccactgtctgcttccatcacacaagcttcacgcagatttcacatcttagggtttcttcatcttcaccgatttaatggctccaccaaaaggtgatggtgcaaagaagaccgatccaaaggcacaggccttgaaagctgcgaaagcagtgaagtcaggcactgccatcaagaaaaaggcaaagaagatcaggacaactgttacattccacaggccaaagactttatctagggataggaatccaaaataccctcggattagtgctacaccaaggaacaaacttgatcattatcagattttgaagtatccactcacaactgagtccgcaatgaagaagattgaagacaacaacactttggttttcattgttgacttgcgagctgacaaaaagaaaatcaaggatgccgtgaagaaaatgtatgacatccaggccaagaaagttaacaccttgatcaggcccgatggcaccaagaaggcctatgtaaggttgacacctgattatgatgctttggatgttgcaaacaagattgggattatttaaggtagtggttggtttcgccaaagacagtttttgtttagatgttagtcttttgatggtgatcactattgtggagacattttgacgcaaagttaaatttcagattgtgtttttgttattgtgtattttagttcaattgcaattaaattatgttgtttacaatttcgaatttgatgagtaaattagattatcctcgaagtgtgttttt

SEQ ID NO: 1209 - DNA, 820 bp, Medicago truncatula
ctagaacccgtttcttcctctgcatccaccgcgaagggtttatatcaggtagagtttcttttccatctgcaacaaatggccccaaaaggtgatgtttctaagaagaccgatccaaaggcacaggccttgaaagctgccaaggcagtcaagtcaggcactgctattaagaaggcaaagaagattagaacaactgtaactttccatcgcccaaagacacaaacaaaggataggaaccccaaatatcctcgcatcagtgccacaccaagaaacaagcttgaccactatcagattttgaagttcccactcaccactgagtccgcaatgaagaaaattgaggataacaacactttggttttcattgttgacttgcgtgctgataagaaaaagattaaggatgcagtgaagaaaatgtatgacatccaggcaaagaaggttaacaccttgatcaggcccgatggtaccaagaaggcctatgttaggttgacacctgattacgatgcattggatgtagcaaacaagattgggatcatctaagtcggtgcctgaatttacttgggttctatttagatgttagccagttctatggtagtcattgaaggcaacttttggacaagggttaaattctatattttgtgttctcttgttttctatattttgtttcaattgacgacacttatcagaccttgtgtttcaattttgactcaagtattacttaaattgacgattgaattgagtactccctatttttccaattttggaatttatttacgcaactcatagaatgttagcgtgacgaggcatctgaggttctgtttaaacc

SEQ ID NO: 1210 - DNA, 700 bp, Medicago truncatula
gggaaccctagttactgcagctgcaccaccccattcttccattttcaaggaacttgtaagattttcaatggctcctccaaagggggaaaatgcaaaaaaagctgatcccaaagctaaggccttgaagactgccaaggctgtgaaatctggtcaagtgattaagaagaaaactaagaagatcagaacaactgtcacattccaccggccaaagacattgtcgagggaaaggaaccctaagtatcctcgcattagtgcaacaccaagaaacaagttggaccattatcaaattcttaaatttcctctaactaccgagtctgcaatgaagaaaatcgaagataacaacacacttgtttttattgtcgaccttcgtgctgacaaaaagaaaattaaagatgctgtgaagaaatgtatgatattcaggccaagaaagttaacactttgatcaggcctgatggtactaagaaagcctatgttcggttgactccagattatgatgcattggatgttgccaacaaaattggtatcatctaagttgtattgcttatttgagcagtgggaatccatcacttttaagatagttgatagatatcctgtgttaggactcctttctcatccttatatatttgctcaggggtattcaatttggggaatattttcatgatatcagtttatattttgaaatttatatttcccaaaaaaa

SEQ ID NO: 1211 - DNA, 908 bp, Cucumis melo
aaaccctaatatataagcatcatcttctcccctaggtttcggatagcggcttcttactctggtcggagtagcgattaggtagaagggctctgcaatggctccaaaagctgacagcaccaagaaggctgaccctaaggctcaagccttgaaaactgctaaggcagtaaaatctggcccaacatttaagaagaaagccaagaaaatcaggacgtccgtcacatttcaccgtccaaagactttgaagaaggaaagaaatcctaagtatccacgcatcagtgttactccacggaataagttggaccagtatcagattcttaaataccctctgactactgagtctgcaatgaaaaagattgaggacaacaatactttggttttcattgtggacattcgtgctgataagaaaaagatcaaggatgctgtgaaaaagatgtatgacatccagaccaagaaagtgaacacgttgatcagacctgatggaaccaagaaggcatatgttaggctgactcccgattatgatgctttggatgttgcaaacaagatcggaatcatctaagttaattagaatttgttttttgtttgagaaaactgattatctttctgcaatgggaattttgatttatggaatgacctctattttctccagcaaattagtaagatgttttcttctaagctattgcaacacatgttgactcgtgaaccataggatgtgttcttgaatctcttctgtagtttgcaattttagctcaaatgacttcacttatttccatttacggcaaaatccagtgtcgagtctggcctctcttggttgctactaaacctgcttggtggtgtacccccttcaaaccaagaatttttaaccactttttctcggtctgtactcagaaattataattgactttcatttg

SEQ ID NO: 1212 - DNA, 820 bp, Cucumis melo
  misc_feature (2)..(2): n is a, c, g, or t
antgctcttaattttttgcatatttcttcctctcttttgttttgccttcccggtttgattgtttcttttcctctcttcgcaggtaagtttttctggtcaaggatcttcagcaatggcacctaaagccgacagtagcaaaaaggctgatcccaaggctcaggccttgaagactgctaaggcagtcaaatctggcccaactttcaagaagaaggctaagaagattagaacttcagtcacattccataggccaaagacattgaagaaggataggaatcccaagtaccctaggatcagtgttactccaaggaacaagttggatcagtatcaaattctgaaatatccattgaccacagagtctgcaatgaagaagattgaggacaataacacccttgtctttattgttgacattcgtgccaacaagaagaatattaaagatgctgtcaagaagatgtatgatattcagaccaagaaagttaacactttaatcagacccgacggaacgaagaaagcatatgttaggttgactccagattatgatgctcttgatgtggcaaacaagattggtatcatctaaacttcagagcttggagcgaacgttttcattgcaatttgttacatgtttaaattttggagaggattttgtagtaggaccctagttttattttagcttcctttttaatatgtattggtaattgtttgctcagatagactgggttcacaatacttggaatgttggaatatacattccaaccattttcattatagcttgcttcagactccattacatcattactgaatttttggtttttacatcttctgg

SEQ ID NO: 1213 - DNA, 950 bp, Pennisetum glaucum
agccgtcatcgcttcgcgcccgccgccgccccgccgccaggagaggtaagtccaggaggcagttctgagaagctcaaatggctcctaaagctgctcttgccaaaaagggtgatgccaaggcccaggccattaaggttgccaaggctgtaaagtctgggacaatcaagaagaagaccaagaagatccgcacatctgtgacatttcaccgccctaagaccctgaagaaggctagggacccgaagtacccaagagtcagcgctcctggaaggaacaagcttgatcagtaccaaatcctgaagtaccccctcaccaccgaatcagcaatgaagaagattgaagataacaacactcttgtcttcatcgttgacctcaaggcagacaagaagaagatcaaggctgctgtcaagaagatgtatgacattcaggcgaagaaggtcaacaccctgatcaggcctgatgggaagaagaaggcttacgtgaagctgacaccggactacgatgctcttgatgtggccaacaaaatcggcatcatctaagttacatgctactggtgttaggcatctaccggactacgatgctcttgatgtggccaacaaaatcggcatcatctaagttacatgctactggtgttaggcatctgtgtcctagatctatgtgaaacgagagttttgtagctattccttatcttgggccagtggctccattaccatgtcttgatgcacacttatgaatttggtatcgtccaagtgaacggttgagctaatttgagctttgcattcctttatgaacaggcccattaggttttctttcataaccattggttttgtgtggagtatgtcaatgggtatgttgtttccaactatcccttgctctgagctctgagcctgactgttactggattcggtttcagtttgtgggcgctgatgaaatagtttgaactgtgttaaaaa

SEQ ID NO: 1214 - DNA, 762 bp, Pennisetum glaucum
cagagtacgcgggggtccgccggcgtcgctccgctccgcatctccaagcaggttgagcagcctgccctgttgagaatccccgatggcgcctaaagctcccccaaagaaggctgatgccaaggctcaagccttgaaggttgccaaggctgtcaagtctggaaccaccaagacaaaggccaagaagatccgcacatctgtgacattccaccggccaaaaaccctcaagaagccaagggaccccaagtacccaagaatcagtgcacctgggaggaacaagcttgaccagtaccaaatcctcaagtaccccctcacgactgagtctgcgatgaagaagattgaagacaacaacacccttgtcttcattgtcgacattaaggcagacaagaagaagattaaggcagccgtcaagaagatgtatgacatccaggcgaagaaagtcaacactctgatcaggcctgatggcaagaagaaggcgtacgtgaagcttaccccagactatgatgctcttgatgtggccaacaagatcggcatcatctaaattttgtggttttgtgtcagtgtgttgcagtttctgagttttggtgttctaggtcttactgtatggacagaacgggcatagctaagcctgtgtaccccttttctgcttgtgaactggtaccaatgatgaaaatttgcaatgttcgagttctgcatttgaattctgtttttggatgttacatgttgatgttgtggattgtggtatactggtacaagttatattaa

SEQ ID NO: 1215 - DNA, 723 bp, Mimulus guttatus
agaaacggcactccgctcctcaggtaatactttcattagggttttagggttcgcatcttcctcaaatggctccagctaaagttgataatgccaagaagtcagacccaaaggcacaggccttgaagacagccaaagctgtcaaagcaggttcaacagccttcaagaagaagtcaaagaagatacgcactaaggttaccttttaccgaccgagaacattgaagaaggacaggacccccaaataccctcgcatcagtgctccaccgaggaacaagctcgaccactaccagattctgaaatacccactcaccaccgagtcggctatgaagaagattgaagacaacaacacccttgttttcattgttgacatccgtgctgacaagaagaagatcaaggctgctgtcaagaaaatgtacgacattcataccaagaaagtgaacactcttatcaggccggatggcacgaagaaggcatacgttaggttaacacccgactacgatgctttggatgtcgctaacaaaatcggaattatctaagtaatggaatctcgagttttgtgttttgctttttctcaagtattggactgtatgaactctgaattttgtactaaatacagaaccttgtttcatttcattttagacgtttgtggttcagaaactaaaactccccaatttatattattgttcgattagattggtttatattttaactttccttgccctcttt

SEQ ID NO: 1216 - DNA, 701 bp, Mimulus guttatus
aacggcactccgctcctcaggtaatactttcattggggttttagggttcgcatcttcctcaaatggctccagctaaagttgataatgcgaagaagtcagacccaaaggcgcaggccttgaagacagccaaagctgtcaaagcaggttcaacagccttcaagaagaagtcgaagaagatacgcactaaggttaccttttaccgaccaagaacattgaagaaggacaggtcccccaagtaccctcgcatcagtgctccaccgaggaacaagctcgaccactaccagattctgaagtacccactcaccaccgagtcggctatgaagaagattgaagacaacaacacccttgttttcattgttgacatccgtgctgacaagaagaagatcaaggctgctgtcaagaaaatgtacgacattcataccaagaaagtgaacactcttatcaggccggatggcacgaagaaggcatacgttaggttaacacccgactacgatgctttggacgtcgctaacaaaatcggaattatctaagtaatggaatttcgagttttgtgttttgctttttctcaagtactggactgtatgaactccgaattttgtactaaatacagaaccttgtttcatttcattttagacgtttgtgcttcagaaatgaaaactcccctatttatattattgttcgattagattggttgatatttt

SEQ ID NO: 1217 - DNA, 697 bp, Nicotiana benthamiana
ttacggccggggggcagagcagcttctctcaggtaagccggttgatttttcgtagggtttcacactgtacttaaccaaatggctccagctaaagctgatccgtccaaaaaatctgaccccaaagcacaggcagctaaggttgccaaggccgtcaagtcaggatcaaccttcaagaagaagtcacaaaagataaggacaaaagttacattccaccgacccaagactttgaagaaagatagaaaccccaagtaccctcgtatcagtgcacctggaaggaacaaacttgatcagtatgggattctaaagtatcccctcaccaccgaatctgcgatgaagaagattgaggacaacaacacccttgttttcatcgtggacatcaaggctgataaaaagaagattaaggatgccgtgaagaagatgtatgacatccagacaaagaaagtcaataccttgattaggcctgatgggacgaagaaagcatatgtgaggttgactcctgactacgatgcattggacgttgccaacaaaattggaatcatctaaactagttacctgtttagaattttacgagaatttaaaatcttggatttgggtttttagatacacttgaatggaagtgccttctatttttcattttcattttgtgttttagagacatgttttgttctgtataagagaaatcaactttaagctgcac

SEQ ID NO: 1218 - DNA, 708 bp, Nuphar advena
ttttggtgagagctcgagggagaacgttttccggcggccaaggagcttctccggcaagagattaacggacttttcagaaaagctgatttgcaagaccaatggctcctcctgcaaaagctcctgctaagaagtctgatgccaagtctcaagccttaaaggcagccaaggcagtgaagtcgggatcattgacgctgaagaagaaggcaaagaagatccggacttctgtcactttccatcgacccaagacactgaagagagagcgtaatcccaagtatcctcgtatcagtgcaccgccaagaaacaagctcgaccactatcagatcctcaagtatccgctcaccactgaatctgccatgaagaagattgaggacaacaacacccttgttttcgttgtggacctcagggcagacaagaagaagatcaaggcagccgtgaagaagatgtatgacatccaggcaaagaaagtcaacacattgatcagacctgatgggaccaagaaggcatacgtgaggctaacaccagattatgatgctctggatgttgcgaataagattggcatcatctaaaccagaggtatctcttgctcctgctctttgcatctggaaattttttgcatttacgtactggaaacttggatacaatggaaaatgggttaaaacagttttgttaactggaatttattagggtattgagtgctttctcattaaa

SEQ ID NO: 1219 - DNA, 732 bp, Quercus alba
gacggtccctcctccgcttccctctaacaccacagggttttcaggtaattgaaggggtctgaggcagagcttcttctgattcagaaatcaatggctcctgctaaagttgatagttcaaaaaaggctgatccaaaggctcaggccttgaaggctgctaaagcagtgaaatctggtgcaacctttaagaagaagactaagaagatcagaacatcagttacatttcaccgtccaaggacattgaagaaggcaaggaatccaaagtatcctcgcattagtgctccaccaaggaacaagcttgatcattatcagatcctcaagtttccccttactactgagtctgcaatgaagaagattgaagacaataacactttggttttcattgttgacattcgtgcagacaagaagaagatcaaggatgccgtaaagaagatgtatgatattcaggctaagaaagtgaataccttaatcaggcctgatggtactaagaaggcatatgttagattgacaccagactatgatgccttggatgtggcaaacaaaattggtattatctaaattagtgtctggcatcctcattcaaagcagcccttccttttcttttttgtccttcaatttcagtctaaatagtaagacagttctgctaggactgtaagcacctagatttttcaaaactagtttaaaagttataatcttgtgttctctttttggtgtttttttttatttgtttggttt

SEQ ID NO: 1220 - DNA, 748 bp, Quercus alba
ctccctctctctctctcactcaggtaaggaagtgattttgggtagagttttcttcattttgcaatggctcctgctaaagctgacagcacaaaaaagtctgatccaaaggctcaagccttgaaggctgccaaggctgtgaagtctggagcaacctttaagaagaagactaagaagatcaggacatctgtcacatttcatcggccaaggacattgaagaaggcaaggaaccccaagtatcctcgcatcagtgctccacctagaaataagttggaccattatcagattctcaagtttccattgactaccgagtctgcaatgaagaagattgaagacaacaacaccctggttttcattgttgacatccgtgctgacaagaagaagatcaaggatgctgtgaagaagatgtatgatattcaggccaagaaagtgaacactttgatcaggcccgatggaactaagaaggcatatgttaggttgacaccagactacgatgccttggacgtggcaaacaagattggcatcatctaagatataactttgtatccagtgtcttgagcaaagtgactctgtccttccttgctatgacagttttgatagtaatgaggcattctgttaggactacaaatatcagttggttatttaaatttgtattgggatctatattttttttacaacttttgcaattggatgctgattaggatgatgtgagttatttgtggtggtgattttccattggttaaaaaaaaaa

SEQ ID NO: 1221 - DNA, 648 bp, Avena sativa
cctgatagttcaaggagctgtcctgagaagctcaaatggctcccaaagctgcggttgccaagaagggtgatgccaaggcccaagccatgaaggttgccaaggctgtgaagtctgggtcaatcatgaagacggcaaagaagatccgcacatctgtgacgtttcaccgccccaagaccctgaagaaggccagggaccccaagtatcccagaatcagcacgcctgggaggaacaagctcgatcagtaccagatcctcaagtatcctctgaccactgaatctgcaatgaagaagattgaggacaacaacactcttgtcttcatcgtcgacctcaaggcagacaagaagaagatcaaggctgccgttaagaagatgtatgacatccaggccaagaaggtcaacaccctgatcaggcctgatggcaagaagaaggcttacgtgaagctgacgccagactatgacgctcttgacgtagccaacaagattggcatcatctaagttagaggatcctgctataggcgtttgtgttgtgtcctggtttcttgtgttaccggagttttgtactagctgttgcttagcaaaggccctcggtggctccattgccccccaccatatcactgcacactttcatgaattatgcaatccaagtgac

SEQ ID NO: 1222 - DNA, 786 bp, Elaeis guineensis
ctggttgcgcagcggcgcgagagggggagccgcagaaagatctcctcggaaacgttagtttacttacagaagtaattctgcattactaaatggccccaccagctaaagcagctactgcaaagaagcctgatggcaaagctcaggctttgaaggttgccaaggctgtgaagtcaggggcttcttccctgaaaaagaagaccaagaagatccgtacttctgtaacttttcatcgtcccaagacattaaagaaggagagaaatccaaaatatcccagaatcagtgcccctcccagaaacaagctagaccagtatcaaattctcaagtatcccctcaccactgaatctgcaatgaagaagattgaagacaacaacacacttgtcttcattgttgatatccgtgcagacaaaaaaaagattaaagcggctgtaaagaagatgtatgacattcaagcaaagaaagttaataccctgatcaggcctgacgggacaaagaaggcgtatgtgagattgactccagattatgatgccctggatgttgcaaacaagattggtatcatttaagcctgagattcagccgttaaccaatatgttttgctttcagctttgcattttgtattagtgtttaaaaagcttgacttcaaatcctcagttttgtttgcataacttcactttctagttgttttgaacattctaaagacaaaacttgaaagtgtattctagagtaactacttttttacttgaatcccttttttggcagcagtattattgaagtgtttctctctgcttt

SEQ ID NO: 1223 - DNA, 863 bp, Elaeis guineensis
attgttattgggaggctcggggagagacagcgggaagctcttggagaagctttgcagaagcgttgatattctgaagttatatattcacattgccagatggctccacctgctaaagctacctccaagaagcctgatggcaaaacacaggctctgaaggttgccaaggctgtgaaatcaggagcatcgtctctgaaaaggaagaccaagaagatccgcacttctgttacttttcaccggcccaagaccctcaagaaagagaggaatccaaaatatcctaggatcagtgctccaccaagaaacaagctcgaccactatcaaattctcaaatatcccctgaccactgaatctgccatgaagaagattgaagataacaacacgcttgtattcatagttgacatccgagctgacaagaaaaagatcaaagcagctgtgaagaagatgtatgacattcaggcaaagaaagtcaatactttgatcaggcctgatggcacgaaaaaggcatatgtgagattgaccccggattatgatgctctggatgttgcaaacaaaattggcataatctagacatgtagtagttagcaatccagtcctgtgctgaatcacatttaaggttggtgtttcaggtctcagactctaattttgtgtcctctttgattttcttgctttagtagttcgttggcatcagatgctagttgaaagttattctgaatactttcttaactgtactactaggattcgttgttgattatggtggacatcccttaattttaagggaggccccgcattagataaatgtgctgcaggtatccttgtctttgtggttgctccaaaacattaagcaatgaaagcttgcatatttgctg

SEQ ID NO: 1224 - DNA, 631 bp, Allium cepa
gttttaagcgaagtgaagaagagttggagatggcaccacctactaaggctaccaccaagaaggctgatgccaaagcacaagctctgaaagctgctaaggctattaagtccggagactcgagcattaagaagaaggccaagaagatccgaacttcagtgacatttcatcgccctaagacattgaagcttccccgtaacccgaaatacccaagaattagtgctccaccaaggaacaagcttgaccattatcagattctcaagtaccctttgactaccgagtctgccatgaagaaaatcgaagacaacaatacccttgtttttatcgttgatattcgagctgacaagaagaaaatcaaggctgctgtgaagaagatgtacgacattcaggcgaagaaggtcaatactctaatcaggcctgatggtacaaagaaggcctatgtgaggctgacaccggattatgatgctttggatgttgccaacaaaatcggtatcatataattgccggagcgctaatagattttagcttttgtttcagctttatgtggttgatgttccttattcgtattttaaaacatgtactagtttgagttttgtatgcgaacaattttttgctgaatctaccttttgtggcc

SEQ ID NO: 1225 - DNA, 850 bp, Carica papaya
ataaacccaatttcgtcttcctcaaaccctagaacggttgctctcgcacgcttcgtgttttgcagggtttcagctggttagaagggtcaggggcttcgccaattttgccatagaaaatgcctcctcctaagggtgacagttccaaaaaggctgacccaaaggcacaggccatgaaggctgccaaagtagtgaaatcaggacctacctttaagaagaaggcaaagaagatccgaacgtctgtcacatttcatcggccaaagacattgaagaaggacaggaatcctaagtaccctcgcatcagtgctccaggtcgaaacaagcttgatcattatcagattcttaaatacccactgacaactgaatctgctatgaagaaaattgaagacaacaacacattggtgtttatcgttgacattcgtgctgataagaagaaaataaaagctgcagtcaagaaaatgtatgatattcagaccaagaaagtgaataccttgatcaggcctgatggcacaaagaaggcatatgtgaggttgacacccgattacgatgctttggatgttgcaaacaaaattggaattatttaagtcagtatcccgcatcctttaaagccttcatttttccattttggtttggaggacctgagagattcagggattagtttaagagctgtaattttgtatttctttttttcggctgccagttcatattttgcttcagcttgtttagttggactgggatggttcaagttctgattcactttcttttgttttaatggttagctatctttgatttaatgacacttctttcaatttcttcttgaaacgttcaaataaattataatttattttaataa

SEQ ID NO: 1226 - DNA, 723 bp, Carica papaya
ggcagcaaaaccctaattcaccagccgcagctctccaggtaagggtttttcgtgaggcagggttgagatggctccaaaggctgacggtacgaaaaaggccgacccaaaggcacaagcagtgaaagctgccaaggttgtgaaatcaggcccaacattcaagaagaaagctaagaagatcaggactaaggtcacttttcacaggccgaagacattgacaaaggaaaggaacccaaagtaccctcgtatcagtgctcctggcaggaataagttggaccattaccaaattctcaaataccctttgactactgagtctgcaatgaagaagattgaggataataacaccctagttttcattgttgacatccgtgctgacaagaagaagattaaggatgcagtgaagaagatgtatgacattcagaccaagaaggtgaatactctgatcaggcctgatggaaccaagaaagcttatgttaggttgactcctgattacgatgctttggatgtggccaacaaaattggaatcatctaagttaaaattttgctgttacttttcatgaacaaattaatgtcatctataccaagacagttctgttaggaatgattcacccttgggtgttcaagttttcagtagtttgtattgagaaccttttcttttcctacttttgttttattatttacattatccaagattttttatgaatggtttcaagtcttgtcttccca

SEQ ID NO: 1227 - DNA, 727 bp, Arachis hypogaea
attcaaaccctagctactacttgcagggttccaccacaggtaaggttcgttcatcttccgcagaaccatggccccagctaaagttgatagttcaaagaaggctgatccaaaggctcaggccttgaaaactgctaaggcagtgaagtcaggtgctacctttaagaagaaggccaagaagatcagaacaaaggtcacattccatcgccctaagactttgaagaaggataggaaccccaaatacccccgcattagtgccccaccaaggaacaagcttgaccattatcaaattctgaaataccctctcacaaccgagtcggcaatgaagaagattgaagacaacaacactttggttttcattgttgacttgcgtgctgacaagaagaagatcaaggatgcagtgaagaaaatgtatgacatccaggccaagaaagtaaacactttgatcaggcctgatggaaccaagaaggcttatgttaggttgacacctgattatgatgccttggatgtagcaaacaagattggaatcatctaaggtgtttcctggctttacccggatcactttttatttagatattagctatggtggtaattgatggatactattgaaacaaaacctagttctaaatttttgctgcttgttatttggtgtactttgttccagtttgaattaagttactcgttacaatatcaattccgatgagtaaatgagcagggatcattttccaac

SEQ ID NO: 1228 - DNA, 710 bp, Arachis hypogaea
gaatcttcagcagctgcaccagctcttccaactgagcttgttagaagggtagctgagcgtttgcaatggctcccgctaaggctgataataccaaaaaggctgatcccaaagctcaggctttgaaggcagccaaggctgttaaatcaggtggcaaagtctttaaaaagaaagctaataagatcaggaccaaagtcacatttcaccgaccaaagacactcaagaaggacaggaaccctaagtatcctcgcatcagtgcaccaccaagaaacaagttggaccattatcagattcttaagtttcctcttaccacagagtctgcaatgaagaagattgaggataacaacacactggttttcattgttgacctccgtgctgacaaaaagaagattaaagatgccgtcaagaaaatgtatgatattcaggccaagaaagttaatactttgatcaggccggacggaacgaagaaagcctatgtgaggttgactccggattacgacgctttggatgtagccaacaaaattggcataatctaagttgtgctgctttatttgagaaaagtccatcaatggttgcttagatagttgttcttgttatacatgccccttttgctaggactttgttatccatatgtatcaactaaagaattgtctattcaattttgggagttgttttatgaactcaattttataccatggcaatctgtttttgat

SEQ ID NO: 1229 - DNA, 774 bp, Arachis hypogaea
cggtaacggcattacggccggggctcagcctctgtagcgcgcaggtttgtgaatctctccaccaaaaaccctaatggctccagctaaagttgataattcgaagaagaatgatccgaaggcgcaggcattgaaaaccgcgaaggcggtgaaatcaggttctacgttcaagaagaaggcgaagaagatcagaacaaaggttacgttccaccgaccgaagacactgaagaaggataggaaccctaagtaccctcgcatcagtgcgccgccgaggaacaagctcgaccattaccagatcctcaagtaccctctcactaccgaatcagccatgaagaaaatcgaggacaacaacactcttgtcttcatcgttgacctgcgcgctgataagaagaagatcaaggatgccgtgaagaagatgtacgatattcaggccaagaaggtcaacaccctgatcaggcctgatggcaccaagaaagcatatgttaggttgacgccagattatgatgcattggacgtagctaacaagattgggatcatttaaattggtgcttgacttcaccattgtcaatttgctatttttatattttaggtagtttgtggttattgttgacgggaacatttgaaagaaaggtaagttctgtattttcttccttggtagttggtgtcctttgctgtaattgacactgaacgaacctagtggttcaattttgagtggaggaatatttaaattgattaaatgagcatctcgtcgagcccgatttttgggtaaaaaagaga

SEQ ID NO: 1230 - DNA, 706 bp, Pisum sativum
ggtcatttaccaggtagagtttcttccccctctgcatcaaatggctcctccaaaaggtgagaagaagactgatccaaaggcacaagccttgaaagctgccaaggcagtcaagtcaggctctgccatcaagaagaaggcgaagaagatccgaacaactgtcactttccaccgcccaaagacccaaactaaggatagaaaccccaaataccctaggattagtgccaccccaaggaataaacttgatcactaccagatcttgaagttcccactcaccactgaatcagccatgaagaaaattgaggataacaacactttggtcttcattgttgacttgcgtgctgataagaaaaagattaaggatgcagtgaagaaaatgtatgacatccaggcaaagaaggttaacaccttgatcaggcctgatggcaccaagaaggcctatgtaaggttgactcctgattacgacgcacttgatgtagcaaacaagattgggattatctaagttagtatctggttttgcttgggttctatttagattttagacagttctttggtgaactttgaagggaacttttgaaaaacggttgagttctatattttgtgttctgtggcttgtcatattttatttcattttacaacacttcttgaacctatttcaattttgacttgagcattattaatgattggaatgagtcctcaaatttttagt

SEQ ID NO: 1231 - DNA, 698 bp, Capsicum annuum
cgaggcagcttcttccttctctcaggtaagttggtgaatttattgtagggttcagaatttctacctatccaaatggctcctaaaggtgattcaaccaaaaaaactgaccctaaggctcaagccgtcaaggctgccaaggctgtcaagtcaggatcaacctctaagaagaagtcacaaaagataaggacaaaagtcacattccaccgtcctagaactttgaagaaggatagaaaccccaagtatcctcgtgttagtgcacctggaaggaacaagcttgatcagtatgccattctcaagtatcctctcaccaccgagtctgcgatgaagaagattgaagacaacaacactcttgttttcattgtggacctcaaagctgataaaaagaagataaaggatgctgtgaagaagatgtacgacattcagacaaagaaaatcaacacattgatcaggcctgatggtacaaagaaggcatatgtgaggttgactcctgactatgatgctttggatgtcgccaacaagattgggatcatctaaattaatggcctgtttagtattttaagagaatttagaatatttgatttttgtttctttgaacacttgaatgcaagtgccttgtgttttggattctaaattttgcatttcagagacgtatttgctccatatataagggaatttcaaccttgtcctcgatttttctt

SEQ ID NO: 1232 - DNA, 822 bp, Capsicum annuum
ggacgaggcttcttcgtgttgagttttggtcaccgtattcagctatggctccagctaaagcggatttgaccaaaaaaaatgatcccaaagctcaggctgtcaaggtttccagggctgttaagtcaggatcaacctttaagaagaagtcaaataagataaggacaaaagttactttccatagacctaagacattgaagaaggataggaatcccaagtaccctcgcattagtgcacctggaaggaacaggcttgatcagtaccagattctaaaacatcctcttactactgagtctgcaatgaagaagatcgaggacaacaatacccttgttttcattgttgatatccattctgacaagaagaagattaaagacgcggtgaagaaaatgtatgatatccagataaagaaagtcaataccttgatcaggcccgatgggacaaagaaggcttatgtgaggttgacacccgactatgatgctttggatgtggccaacaagattggaatcatctaaattgcttacctagttttgaatttttctgtcagccttaagatcttgcatatgagctctttagaaagttttgaactaaagttccttggtttattaattttgaatgttgagtttcgatatgtattttgtttcatgtaagtcaggcaagcttatggtttattaattttgaatgctatgtttcagatatgtattttgttccatgttagtcaggcaacaactactactaagtttctaagttaagggatcgtttggtatgtgggataagaacaataatctttggataaatttgctattaattctgtctcatgtttggtgt

SEQ ID NO: 1233 - DNA, 695 bp, Petunia hybrida
cgggggatctcggcaagcagcttctctcggtaagctggtatatttcttcttgggtttaaaactgtacttaaccaaatggctcctaaagccgattcatccaaaaaatctgatcctaaagctcaggctgccaaggttgccaaggctgtaaagtcgggatcaaccttcaagaagaagtctcaaaagattaggacaaaagttacattccaccgacctaagactttgaagaaggatagaaatcccaagtaccctcgtgttagtgcacctggaaggaacaagcttgaccagtatgggattctgaagtttccactaaccactgaatctgcaatgaagaagatcgaggataacaacacccttgttttcatcgtggacattaaagctaataaaaagatgattaaggatgccgtgaagaagatgtatgacattcagacaaagaaggtcaacaccttgatcaggcctaatgggactaagaaggcatatgtgaggttgacccctgattatgatgctttggatgtcgccaacaagatcggaatcatctaaattagttttactcagtttagaattttatgaatacttgagaatcttggatattgaatttctgaaaacacttctacggaagtgccctgtgttattcattttgaattttgcgtttctgagatgtgttttattcagtgcagagaattcactttatgctttca

SEQ ID NO: 1234 - DNA, 689 bp, Petunia hybrida
cctatattctcagtggcggctgcattaacttccctctcttccccctccaggtaaagttcgtgttgcaggaaatcttcaatggctcccaaagctgacacaaaaaaggctgacccaaaagctcaggctgcaaaggttgccaaggctgtgaaatctggttcaaccttcaagaagaagtcacagaagatccgcacaaaagtcacttttcacaggcctaagacattgaagaaggataggaacccaaagtatccccgtattagtgcaaccccaaggaacaagttggatcaatatgcaattctcaagtatcctttaaccactgagtccgctatgaagaagattgaagataataacaccttggttttcattgttgatatcaaagctgacaagaagaagattaaggatgccgtgaagaagatgtatgacattcagaccaagaaaatcaacactttgatcaggcctaatggaaccaagaaggcttacgtccgactgactccagactatgatgctttggatgtggccaacaagatcgggatcatctaaagagaaactagttgtgttctggcaaagatagctcctttgacaattttgttagctttgttgccttcgaatagtttgagtggtattcctgcagttgtgactattagttagagaagtcaatctatttgtactctatagaacaacgtcagcacctt

SEQ ID NO: 1235 - DNA, 679 bp, Petunia hybrida
ggggaattgagcgggtcctaatcccctaatccgccccagtgtgtatgtttcgtctttcagctttggagtaatcatcaatggctccccctaaagctgatagcaccaaaaaggctgaccctaaggctcaggcggcaaaggttgctaaggcggtcaaaagtggtgcaatgttcaagaagaagtcaaagaagatccgcacaaaggttacctttcacaggcccaggacattgaggaaagagagaaatcctaagtatccccggataagcgcaactccaaggaacaagttggatcattaccaaattctcaagtatcctttgaccactgagtctgcgatgaagaagattgaggataataataccctggttttcattgtcgatattcatgctgacaagaagaagattaaggatgcagtgaagaaaatgtacgacattcagaccaagaaagtgaacactctgatcaggccggatggaacaaagaaggcttatgttcgattgactccagactacgatgcactagatgtggcaaacaagattggaatcatctagtaaggagaaactagttttatttttggtaaacctcattcaccattttgttagctgtattggcttccaatagtggcaaactaatattctactcttgattagatattgctactttacggaacgatttgtgcattttgctt

SEQ ID NO: 1236 - DNA, 681 bp, Populus trichocarpa
gggaaaaaccctagttcacagccgcagaagcagcagcagcagcagcagctaaggtttagtggtgcttaggaagtggttgctacaatgtctccagctagagctgatgcttccaaaaagcctgatgcaaaggcacaagcccagaaggctgccagggctgtgaaatcagggccaacatttaagaaaacaaagaagatccggacaaaggttacatttcaccgtccccggacattgaaaaaggagagaaaccccaagtatccacgcatcagtgcaactcctagaaataagttggaccactatcagattctgaagtacccacttactactgagtctgcaatgaaaaagattgaggacaacaataccctggtgttcattgttgacattcgtgctgacaagaagaaaatcaaagctgcagtcaagaagatgtatgacattcagaccaagaaagtgaacactttgatcaggcctgatggaactaagaaggcgtatgtcaggttgactcctgattatgatgcattggatgtggcaaacaagattggcatcatataaatttatggttttgtagttatttgatttgatgagcaaagtactgttgacagttttgttaggagcaatgcagtctgatagtactccaatgttatgtttattttttttcaatatatgctgagaactgttttcctatta

SEQ ID NO: 1237 - DNA, 753 bp, Populus trichocarpa
accctaacagcagttttgtgagtggccattccccagctccgcaatggctcctaaagatgtaaagaaggctgatgcaaagacacaggctcagaaagctgccaaggccttgaaatcgggtgcaccggctttcaagaagtccaagaagatacgaactaaggtgacatttcatcgtcccaggacattgaagaaggaaaggaaccccaagtaccctcgcattagtgcaactccaaggaacaagcttgatcattatcagatcctaaagtatcctctcacaactgagtcagcgatgaagaagattgaggacaacaacactttagttttcattgttgacattcgagctgataagaagaagattaaggatgctgtgaagaagatgtatgacattcaaaccaagaaagtgaataccttaatcaggccggatgggacaaagaaggcgtatgttagattgacaccagattacgatgctttggatgtggcaaacaagatcggaataatctaaattagttgccatttccatttgtatgccttttttttttaagcatttcaattttcaagttcgaactgagaagttatttaagaacctcgagcagagttgggtcagcaatttcagtttgatacattgcatttgattagctttggttgatgttttgatgtcgtcgtgctatgtcttgtttgactgtcaaagattgcgatcaatgttaacagatggtagaaatctatgccattttttctctcatttcttcaacataaaaa

SEQ ID NO: 1238 - DNA, 907 bp, Populus trichocarpa
accatccacaggtcccccctcttatctctctccataccgaacgcacgtatatttcaaaacgaaaattattaacccttttgtttagggtttcgagttgttgattggcagcaatggcaccagccaaagacagtttgaaaaaggctgacgcaaaggcacaggctgtgaaggctgcaagagcagtaaagtcaggtccaaccttcaagaagaccaagaagatcagaactaaagttacatttcatcgacctaggacattgaagaaggagaggaatcctaagtatcctcgcattagtgctacaccaaggaacaagcttgatcattatcagattttgaaatatcctctcacaactgagtctgcaatgaaaaagattgaagacaacaacaccctggtatttatagttgatttgcgtgctgacaagaaaaaaaatcaaggatgctgtcaagaagatgtatgacattcagactaagaaagtgaataccctgatcaggcccgatggtaccaagaaggcatatgttaggttgacaccagactatgatgccttggatgtggcaaacaagattggaatcatttaagtgcttgccctctgcttcctaagttatttttttgcttttgtattccagagtagggcagttttgttgtgacattacggagtgagatctgcaaaattagtttaaagttgtgaacctgtgcaactcatggttttgactggcattgggatccagcgaccttgtaggcttgaagtttgattcatcgattttgaactatgcattcaacgagttaccatactttcagatattagatcatttcaatgtttagtttatataactgcttgtgtgatcgggattttcattcaggtatagcctccaagttaattataggaggcagggttgtttcatcggctggtatcca

SEQ ID NO: 1239 - DNA, 688 bp, Papaver somniferum
cttccttcttatcaatcgaaaaccagtctgaaagaagattcagtagctaacaatggctcctccatctaaagttgctacaaagaaggccgacccaaaggtacaggctttgaaatctgccaaggcagtcaaagctggagcatcaacgttaaagaagaagattaagaagatccgtacatcagtcacctttcacaggccaaagacattgaagacagcgaggaaacccaagtaccctcgtatcagtgcaccaccaaggaacaagcttgaccattaccagattttgaaatacccactcacaactgaatcagcaatgaagaagattgaagacaacaacaccctggtgttcattgttgatatccgtgctgataagaagaaaattaaggctgcagtcaagaagatgtacgatatccagactaagaaagtgaacacccttatcaggcctgatggaacgaagaaggcttacgtgagattaactccagattatgatgctttggacgttgcaaacaagattggtattatatagattgtagctgtgttataagcagttttggcagtaaactttcaatagatattagactcggtgatgtttaaatttatgcagggtaaatttggttctgtttaatctctgtagctatcgccttggttctgtttaatttttatactcaaggccttgttattttgctttaatgag

SEQ ID NO: 1240 - DNA, 702 bp, Papaver somniferum
ctcaaacaaaaaatacccagtttgaaaagaagattcagtgagtagctaacaatggctcctccagctaaagttacatcaaagaaggtcgaccccaaggtgcaggctaacaaagctgccaaggctgtcaaagctggagcatcaaccattaagaagaaggctaagaagatccgcacatcagtaacatttcacaggccaaagacattgcagaaggcaaggaaccccaagtacccacgtattagtgcaccaccaaggaacaagcttgaccattaccagatcctgaaatacccactcaccaccgagtccgcaatgaagaagattgaagacaacaacaccctggtattcattgttgatatccgtgctgacaagaagaaaatcaaggatgctgtcaagaagatgtatgacatccagacaaagaaagtgaacacccttatcaggcctgatggaacgaagaaggcttacgtgagattgactccagattatgatgctttggacgtagcaaacaagattggtatcatatagactctagtctgtttatgttatttccatagagctattttgtcaccagcagttttggtagtaaacttgcttcagatattagactcactttttgttagtaaagtttgattcagggtacatttggttctgtttaatctttaacctgaagaccttgttactctgctttaatgagataatgttttgtct

SEQ ID NO: 1241 - DNA, 692 bp, Solanum tuberosum
aggtaagctggtgtttttttcctagggtttcagaactatacataaccaaatggctcctaaagctgattcgaccaaaaaatctgaccctaaggctcaagccgtcaaggctgccaaggctgtcaagtctggatcaaccttcaagaagaagtcacagaagataaggacaaaagttacattccaccgtcctaggactttgaagaaggatagaagccctaagtatcctcgtgttagtgcacctggaaggaacaaacttgatcagtatgctattctaaagtatcctctcaccactgagtctgcaatgaagaagattgaagacaacaacacccttgttttcattgtggacatcaaagctgataagaagaagatcaaggctgccgtgaagaagatgtatgacattcagacaaagaaaatcaataccttgatcaggcctgatggaactaagaaggcatatgtgaggttgactccagattatgatgctttggatgtggccaacaaaattggaatcatctaaattagtttcctgtttagaattttgatgagaatttagaatttcatgaaacactttaattgaagtgccttgtgttttgaattttgaattttgctttccagagacgtgttttgttccatatttttgttataagagaattcaaccttatgctcctagttagtacgtggcgtatttgatttgcctc

SEQ ID NO: 1242 - DNA, 684 bp, Solanum tuberosum
ggcagcttcttctctctctcaggtaagctggtgtttttttctgctagggtttcagaactatacctaaccaaatggctcctaaagctgattcgaccaaaaaatctgaccctaaggctcaagccgtcaaggctgccaaggctgtgaagtcaggatcaaccttcaagaagaagtcacagaagataaggacaaaggttacattccaccgtcctaggactttgaagaaggatagaagccccaagtatcctcgtgttagtgcacctggaaggaacaaacttgatcagtatgcgattctaaagtatcctctcaccactgagtctgcaatgaagaagattgaagacaacaacacccttgttttcattgtggacatcaaagctgataagaagaagatcaaggctgccgtgaagaagatgtatgacattcagacaaagaaaatcaataccttgatcaggcctgatgggactaagaaggcatatgtgaggttgactccagactatgatgctttggatgtggccaacaaaatcgggatcatctaaattagtttcctgtttagaattttgacgagaatttagaatttcatgaaacacttcaatggaagtgccttgtgttttgaattttgaattttgctttccagagacgtgttttgttccatatttttattataagagaattcaaccttgtgctcct

SEQ ID NO: 1243 - DNA, 667 bp, Solanum tuberosum
gatttttcgcaccatattcagctatggccccagctaaagcggacttaacaaaaaagaaagaccccaaagcccaggctgtcaaggctgccaaggctgttaagtcgggatcaacctttaagaagaagtcaagtaagataaggacaaaagttactttccatcgacctaagacattgaagaaagataggaatcccaagtaccctcgcattagtgcacctggaaggaacagacttgatcagtaccaggttctaaaatgtcctcttaccaccgagtctgcaatgaagaagattgaggacaacaatacccttgttttcattgttgacattcatgctgacaagaagaagataaaagatgcagtgaagaaaatgtatgacatccagataaagaaagtcaataccttgatcaggcccgatgggacaaagaaggcttatgtgaggttgacacccgactatgatgctttggatgtggccaacaaaattggaattatctaaatcgattacctagttttgaatatttctgtcagccttgagtctttatatgagttctatggaaacttttgaacggaagttccttggtttattcattttgaatattgagtttcagctatgtactctgtttccatatagttggattagcttctgttcacatttttattttaagcgttttgact

SEQ ID NO: 1244 - DNA, 708 bp, Solanum tuberosum
cttctctcagctcgtgttggatttttcgcaccatattcagctatggctccagctaaagcggacttaacaaaaaagaaagaccccaaagcccaggctgtcaaggctgccaaggctgttaagtcgggatcaacctttaagaagaagtcaagtaagataaggacaaaagttactttccatcgacctaagacattgaagaaggataggaatcccaagtaccctcgcattagtgcacctggaaggaacagacttgatcagtaccaggttctaaaatgtcctctcactaccgagtctgcaatgaagaagattgaggacaacaatacccttgttttcattgttgacattcatgctgacaagaagaagataaaagatgcagtgaagaaaatgtatgacatccagataaagaaagtcaataccttgatcaggcccgatggaacaaagaaggcttatgtgaggttgacacccgactatgatgctttggatgtggccaacaaaattggaattatctaaatcgattccctagttttgaatatttctgtcagccttaagtctttatatgagttctatggaaacttttgatcggaagttccttggtttattcattttgaatattgagtttcagctatttactttgttccatatagtcaggcaagcttctgttcacatttttattttaagcgttttaactaaggttttttgggaaaaaaaaaa

SEQ ID NO: 1245 - DNA, 814 bp, Prunus persica
ctccactcgaaaaccctacacttcggccgcagctgctcctcatctacaggtaggtttgtttctcgttgagctcagagcaatggctcctgctaaagctgacaacacgaagaagagtgatccaaaggcccaagccttgaagactgccaaggctgtgaaatccggccctactttcaagaagaaggccaagaagatcaggacatcagtcacatttcataggccaaggacattgaagaaggaaaggaaccccaagtatccccgcattagtgcaccaccaagaaacaagttggaccattatcaaattctcaagtatccattgactactgagtctgcaatgaagaagattgaggacaacaacacacttgttttcattgttgacatccgagctgataagaagaagattaaagatgcagtgaagaagatgtacgatattcagaccaagaaagtgaacaccttgatcaggcccgatggaacgaagaaggcatatgttaggttgacaccagactatgatgccttggatgtggccaacaagattgggataatctaaattaatgttgtattgtctttttattttgaagccaagtgatttccgttcttgctatgacagttttgttagtattgcgctatgttagtcctcctggagtagtttggttttcttcaatttgtatttgatgctatattcatcgtttcctttttcttatggcaatgggatgcgattaaaatttagttcggtgttaatgccttaatatacaccgtcttttatcatgttttgaattttgttttaaacataagcaaccatttatttaaaaaagaaaaa

SEQ ID NO: 1246 - DNA, 1153 bp, Prunus persica
tttaataaaataagaatcattgtttatttgtagatgaacaagagaatacagaagtaacgcattttgttactgagaggattttatctcaaactcgtaccataatacatccaaacttgtaaaaggatattgggaaaaaccaaaaacaaaaacaaaaaagaaacagctgatctatggcatgaaggctttttctcttttccttttctgatcaacacaatgccaggtgagacccagaaatatttgtgacaataataaaaatattggttacccaagcctaatccttgtacttcatttcggacatgacgaaaccgggcatctcaaatgaggctgagaacttttcaacatcagccttgagttcttcaatgtccttgttgttcaccaaacccttgttgaagtccttcagtagtttcccatgctccttctggattttcaagtcacgccggcagggtttcctagtggttacaagggcttataagcagaccttcttcgtcggcaaccaatggctccaactaaagctgatgtttcaaaaaaagctgatccaaagtcacaagccgtgaaagctgcaaaggctttgaaatcgggccccatccttaagaagaaggccaagaagatccgaacttcagttacatttcatcggcccaggacattgaaaaaggagaggaaccctaagtatcctcgtatcagtgctccaccaaggaacaagctcgatcattatcaaattttgaagtatcctcttactactgaatctgcaatgaagaagattgaagacaacaacactttggtgtttattgttgacatacgtgctgacaagaagaaaattaaggatgcagtcaagaagatgtatgacattcagtccaagaaagtgaataccttgatcaggcctgatggtaccaaaaaggcttatgttaggctgaccccggattatgatgctttggatgtggcaaacaaaattggtatcatctaagggtagtgacagagctacgtagtaagagagcattgtgactctttgagctcactcagatctagttttgaagttgtaacagtttttgctactgatttaaaatgacgtctttgtcttttgtggttatacctgcagttctgactttgtagacttgaaattttaatctattttgaaacatcatttgaatgctcgttc

SEQ ID NO: 1247 - DNA, 732 bp, Pseudoroegneria spicata
  misc_feature (159)..(159): n is a, c, g, or t
  misc_feature (177)..(177): n is a, c, g, or t
  misc_feature (186)..(186): n is a, c, g, or t
  misc_feature (273)..(273): n is a, c, g, or t
ctggaagaattcgcgcccgcaccccaggaaggtaagttcaagaggccgcccttagaagctcaaatggctcccaaagttgctgttgccaagaagggcgatgccaaggcccaggccgccaaggttgccaaggctgtgaagtctgggtcaatcaagaagacngcaaagaagatccgcacntctgtgacntttcaccgccccaagaccctgtccaagcccagggaccccaagtaccccaggatcagcacccctgggaggaacaagcttgaccagtancagatcctgaagtaccctcttaccactgagtcggcaatgaagaagatcgaggacaacaacacccttgtcttcatcgtcgacctcaaggcagacaagaagaaaatcaaggctgctgtgaaaaaaatgtacgacatccaggccaagaaggttaacaccctgatcaggccggacggcaagaagaaggcctacgtgaagctgacaccggactacgatgctcttgacgtggccaacaagatcggcatcatataagtcgggagggtcctgcagtaggcgcttgtgtcgtggtttcttatgttatcggagttttgtagttgttacttagcaaaggggctcagtggctccattgcctaccatatctctgcacactttcatgaatttgatgcaatccaagtgactcgtgttgctaattcgagctttgcgtttggtcttaccatattggttggttgctttaccatccta

SEQ ID NO: 1248 - DNA, 735 bp, Raphanus sativus
gccgctcagagaggttttgtggaaaaggatctcactttgagcaatgtctccagctaaagttgatgtaactaagaaggttgacccaaaggccaaggccttgaaagctgccaaggccgtgaagtcaggccaagtcattaaaaagaaggcgaagacgatcagaacaaaggtgacattccacaggccaaagacattgacaaaggctagagacccaaagtacccacgcatcagtgcaactccgaggaacaagttggaccactacggaatcctcaagtacccactcacaaccgagtccgcaatgaagaagatcgaagacaacaacaccttggtcttcatcgtcgacatccgtgctgacaagaagaagatcaaggatgctgtcaagaaaatgtacgacattcagaccaagaaagtcaacacactcattaggcctgatggaacgaagaaagcgtacgtgagattgacccctgattacgatgctttggatgtggctaacaaaatcgggatcatctaatccttatatcgtcactttttttttcttttggagttttgaaacagacttcttgtttctgtcttctttagtctgagttttgttagagaaatttaatgatactactacatctctttggtgtgctttatggttggtctcgaagataatgttttggtaccactggtcggttatactagtctcattgtcttgttaccctctctgctaccggtttaatcgggtattcttctaat

SEQ ID NO: 1249 - DNA, 709 bp, Raphanus sativus
ggcaagtaatctagggttttcttggctttcataatataagtgcccgccgctgcgaaatgaattagggtttcagctgcttcaacatctctccagatttagtgtcggaaggatcgttcagaagcaatgtctccggctaaagttgataccactaagaaggccgacccaaaggccaaggccttgaaggctgcgaaggcagtgaagtctggccaagccttcaagaagaaggacaagaagatcaggacaaaggtcaccttccacaggccgaagaccttgaccaaggctagagaccccaagtacccgagaatcagtgctactcccaggaacaagttggaccattacggtatcctcaagtacccactcaccactgagtctgcgatgaagaagatcgaggacaacaacactcttgtcttcattgttgacattcgtgccgacaagaagaagatcaaagatgctgttaaaaagatgtacgacattcagaccaagaaagttaacaccctcatcaggcctgatggaacgaagaaggcttacgttaggcttacaccggactatgatgctttggatgttgctaacaagattggcatcatctaagttttatctacctctactattgtgaaaccagtgtttttgtcacttgcttgtagactccagttttgcattgagatattattatctaccatcatcgtttaatgttgaattcaagttctatgtt

SEQ ID NO: 1250 - DNA, 733 bp, Raphanus sativus
gggcactaataaaactgtctgccgctgcaaaagtgaccttagagtttcagctgcttcacctcaccagattttgagcgggaaggaatcgttcagagcaatgtctccggctaaagttgatacgacgaagaaggctgacccaaaagccaaggccttgaaggctgcaaaggcagtgaagtcaggccaagctttcaagaagaaggacaagaagatcaggactaaggtcaccttccacaggccaaagactttgaccaaggctagagatcccaagtacccgaggatcagcgctactccgaggaacaagttggaccattacggtatcctcaagtacccactcaccactgagtctgcaatgaagaagattgaagacaacaacactcttgtcttcattgttgacattcgtgctgacaagaagaagatcaaggatgctgttaagaaaatgtatgacatccagaccaagaaggtcaacaccctcatcaggcctgatggaacgaagaaggcttacgttaggcttacaccggactatgatgctttggatgttgctaacaagatcggcatcatctaagttttatctatctctgctattataaaaatagacttgtggttggttttgtttctctggtagtttctggttttacaatacattcttgtttctctggttttgattctatcttacaacaaaacactcttgtgaacttccaaaatgcaaactattctgccaatggacgatctcttg

SEQ ID NO: 1251 - DNA, 677 bp, Raphanus sativus
agagtttcagctgcttcacctcaccagattttgagcgggaaggaatcgtttcagagaaatgtctccggctaaagttgatacgacgaagaaggctgacccaaaagccaaggccttgaaggctgcaaaggcagtgaagtctgggcaagctttcaagaagaaggacaagaagatcaggactaaggtcaccttccacaggccaaagactttgaccaaggccagagatcccaagtacccgaggatcagcgctactccgaggaacaagttggaccattacggtatcctcaagtacccactcaccactgagtctgcaatgaagaagattgaagacaacaacactcttgtcttcatcgttgacattcgtgccgacaagaagaagatcaaggatgctgttaagaaaatgtatgacatccagaccaagaaggtcaacaccctcatcaggcctgatggaacgaagaaggcttacgttaggcttacaccggactatgatgctttggatgttgctaacaagatcggcatcatctaagttttatctatctctgctattataaaaacagacatgtggttttgtttctctggtagtttctgttttttttacaaaacattcttgttacatgttgaattcaagttctccgtttttgaatttgcttctcgacaatcttacaacaaacactcttata

SEQ ID NO: 1252 - DNA, 764 bp, Raphanus sativus
gccgctcagagaggttttgtggaaaaggatctcactttgagcaatgtctccagctaaagttgatgtaactaagaaggctgatccaaaggctaaggccttgaaagctgccaaggcagtgaagtcagggcaaatcatcaagaagaaggcgaagaagatcagaacaaaggtgacattccacaggccaaagacattgactaaggctagagacccaaagtacccacgcatcagtgcaactccgaggaacaagttggaccactacggaatcctcaagtacccactcaccactgagtccgcaatgaagaagatcgaagacaacaataccttggtcttcatcgtcgacatccgtgccgacaagaagaagatcaaggatgctgtcaagaaaatgtatgacattcagaccaagaaagtcaacaccctcattaggcctgatggaacgaagaaggcgtacgtgagattgactcctgattacgatgctttggacgtagctaacaaaatcgggatcatctaatctcattttctttttttggtgtttgaaaacgggcttcttgtttctgtcttctttattctgagttttgctagagaaatttaatggtcttatcgtttagactcgaagattttttttttttttgggtacgagtgcgtaataattttcctattgctcgttccctctcttataccggttaaatcgggttagttagtaccggccgtttatgttctatagctttaaaacgatctcctgagtttatctttttcagatgtcaaga

SEQ ID NO: 1253 - DNA, 733 bp, Raphanus sativus
  misc_feature (712)..(712): n is a, c, g, or t
ggccactaataaaactgtctgccgctgcaaaagtgaccttagagtttcagctgcttcacctcaccagattttgagcgggaaggaatcgttcagagcaatgtctccggctaaagttgatacgacgaagaaggctgacccaaaagccaaggccttgaaggctgcaaaggcggtgaagtcaggccaagctttcaagaagaaggacaagaagatcaggactaaggtcaccttccacaggccaaagactttgaccaaggctagagatcccaagtacccgaggatcagcgctactccgaggaacaagttggaccattacggtatcctcaagtacccactcaccactgagtctgcgatgaagaagattgaagacaacaacactcttgtcttcattgttgacattcgtgctgacaagaagaagatcaaggatgctgttaagaagatgtatgacatccagaccaagaaggtcaacaccctcatcaggcctgatggaacgaagaaggcttacgttaggcttacaccggactatgatgctttggatgttgctaacaagatcggcatcatctaagttttatctatctctgctattataaaaacagacttgtggttggttttgtttctctggtagtttctgtttttacaatacattcttgtttctctgcttttgaatcttacaacaaaacactcttgtgaacttacaaaatgcaaactattctgncaatggacgatctcttgaatg

SEQ ID NO: 1254 - DNA, 652 bp, Raphanus sativus
agggtattcagcttcttttaacacctctccagatatcaagtgggaataatcatcttgagctatgtctccagctaaagttgataccacgaagaaggctgaccccaaggccaaggccttgaaggctgcgaaggcagttaagtctggccaagccttcaagaagaaggacaagaagatcaggaccaaggttaccttccacaggccaaagactttgaccaaggctagagatcccaagtacccaagaatcagtgctactccaaggaacaagttggatcactatggtatcctcaagtacccactcaccaccgagtctgcaatgaagaagattgaagacaacaacacccttgtcttcattgttgacattcgtgctgacaagaagaagattaaggatgctgttaaaaagatgtatgacattcagaccaagaaggtcaacaccctcatcaggcctgatggaacgaagaaggcttacgttaggcttacaccagactacgatgctttagatgttgctaacaagattggcatcatctaagttcgtctacctctcctattataaaaaggacttgtggttttgtctctagtcgtcaaaactttgttttacaatacattcgtgttgcagttaattgttgaattcaaattctatgttttttggcttctc

SEQ ID NO: 1255 - DNA, 708 bp, Raphanus sativus
gtctgcggctactaacaattttagtttagggttttcagcttctttaacacctctccagatatcaagtgggaataatcatcttgagctatgtctccagctaaagttgataccacgaagaaggctgatcctaaggccaaggccttgaaggctgcgaaagcagttaagtctggccaagccttcaagaagaaggacaagaagatcaggactaaggttaccttccacaggccaaagactttgaccaaggctagagatcccaagtacccaagaatcagcgctactccaaggaacaagttggatcactatggtatccttaagtacccactcaccaccgagtctgcaatgaagaagattgaagacaacaacactcttgtcttcattgttgacattcgtgccgacaagaagaagattaaggatgctgttaaaaagatgtatgacattcagaccaagaaggtcaacaccctcatcaggcctgatggaacgaagaaggcttacgttaggcttacaccagactacgatgctttagatgttgctaacaagattggcatcatctaagttcgtctacctctcctattataaaaaggacttgtggttttgtctctagtggtcaaaactttgttttacaatacattcgtgttgcagttaattgttgaattcaaattctatgttttttggcttctcaacaatcttatcatataccactctataacc

SEQ ID NO: 1256 - DNA, 683 bp, Raphanus sativus
tttttcgccgctccagattttgtggaaaggatctgacttttgagtaatggctccagctaaagttgatgtaactaagaaggctgacccaaaggccaaggccttgaaagctgcgaaagcggtgaaatcagggcaaatcattaagaagaaggtgaagaagatcaggacgaaggtgacattccacaggccaaagacattgacaaaggctagagaccccaagtacccacgcatcagtgcaactccaaggaacaagttggaccactacggaatcctcaagtacccactcaccaccgagtctgccatgaagaagatcgaagacaacaacaccttggtctttattgttgatatccgtgctgacaagaagaagatcaaagatgctgtcaagaagatgtatgacattcagaccaagaaagtcaacacactcatcaggcctgatggaacgaagaaggcgtacgtgagattgactcctgattatgatgctttggatgttgctaacaaaattggaatcatctaagttaattattataccatctgagctgtcattttacatttggagtttgaaaacagggtcttgtcttagtctcagttttgctagaaaaaaggataatctctttgttgtgctttatcgttgggattctaagctatgttttggtatttatttctcatcttgttccccaattcgattt

SEQ ID NO: 1257 - DNA, 664 bp, Raphanus sativus
  misc_feature (19)..(19): n is a, c, g, or t
  misc_feature (21)..(21): n is a, c, g, or t
agggtttcagctgcttcancntctctccagatttagtgtcggaaggatcgttcagaagcaatgtctccggctaaagttgataccactaagaaggccgacccaaaggccaaggccttgaaggctgcgaaggcagtgaagtctggtcaggccttcaagaagaaggacaagaagatcaggacaaaggtcaccttccacaggccgaagaccttgaccaaggctagagaccccaagtacccgagaatcagtgctactccaaggaacaagttggaccattacggtatcctcaagtacccactcaccactgagtctgcgatgaagaagatcgaggacaacaacactcttgtcttcattgttgacattcgtgccgataagaagaagatcaaagatgctgttaagaaaatgtacgacattcagaccaagaaagttaacaccctcatcaggcctgatggaacgaagaaggcttacgttaggcttacaccggactatgatgctttggatgttgctaacaagattggcatcatctaagttttatctacctctctctactattgtgaaacagtgtttttgtcactttcttgtagactccagttttgcattgagatatttattatctaccatcgtcgtttaatgttgaattcaagttctatgtttcttttgcttctca

SEQ ID NO: 1258 - DNA, 748 bp, Raphanus sativus
gatcatcgtcgtcacttccacaataaaactgtctgcggctactaacaattttagtttagggtattcagcttcttttaacacctctccagatttcgagtgggaagaatcatctagagctatgtctccagctaaagttgataccacgaagaaggctgatcctaaggccaaggccttgaaggctgcgaaagcagttaagtctggccaagccttcaagaagaaggacaagaagatcaggactaaggttaccttccacaggccaaagactttgaccaaggctagagatcccaagtacccaagaatcagcgctactccaaggaacaagttggatcactatggtatcctcaagtacccactcaccaccgagtctgcaatgaagaagattgaagacaacaacactcttgtcttcatcgttgacattcgtgccgacaagaagaagattaaggatgctgttaaaaagatgtatgacattcagaccaagaaggtcaacactctcatcaggcctgatggaacgaagaaggcttacgttaggcttacaccagactacgatgctttagatgttgctaacaagattggcatcatctaagttcgtctacctctcctattataaaaaggacttgtggttttgtctctagtcgtcaaaactttgttttacaatacattcgtgttgcagttaattgttgaattcaaaattctatgttttttggcttctcaacaatcttatcatataccactttataaccaaaaaaaa

SEQ ID NO: 1259 - DNA, 685 bp, Raphanus sativus
gaccttagagtttcagctgcttcaccttcaccagatttcgagcgggaaggaatcgttcaaagcaatgtctccggctaaagttgatacgacgaaggctgacccaaaagccaaggccttgaaggctgcaaaggcagtgaagtctggccaagctttcaagaagaaggacaagaagatcaggactaaggtcaccttccacaggccaaagactttgaccaaggctagagatcccaagtacccgaggatcagtgctactccgaggaacaagttggaccattacggtatcctcaagtacccactcaccactgagtctgcaatgaagaagattgaagacaacaacactcttgtcttcattgttgacattcgtgctgacaagaagaagatcaaggatgctgttaagaaaatgtatgacatccagaccaagaaggtcaacaccctcatcaggcctgatggaacgaagaaggcttacgttaggcttacaccggactatgatgctttggatgttgctaacaagatcggcatcatctaagttttatctatctctgctattataaaaacagatttgtggttttgtttcgctggtagtttctgtttttaaaatacattcttgtttctctggttttgattctatcttacaacaaaacactcttgtgaacttccaaaatgaaactattctgtcaatggacga

SEQ ID NO: 1260 - DNA, 939 bp, Raphanus sativus
  misc_feature (413)..(413): n is a, c, g, or t
tttttcgccgctcaggctcatggtgattgcttcctaactgatttacttctatgggttttaagcagattttgtggaaaggatctgacttttgagtaatggctccagctaaagttgatgtaactaagaaggctgacccaaaggccaaggccttgaaagctgcgaaagcggtgaaatcagggcaaatcattaagaagaaggcgaagaagatcaggacaaaggtgacattccacaggccaaagacattgacaaaggctagagaccccaagtacccacgcatcagtgcaactccaaggaacaagttggaccactacggaatcctcaagtacccactcaccaccgagtctgccatgaagaagatcgaagacaacaacaccttggtcttcattgttgatatccgtgctgacaagaagaanatcaaagatgctgtcaagaagatgtatgacattcagaccaagaaagtcaacacactcatcaggcctgatggaacgaagaaggcgtacgtgagattgactcctgattatgatgctttggatgttgctaataaaattggaatcatctaagctattataatatcatctgagcagtcattttacttttggagttaaaaacagacttttgtcttagtctcagttttgctagaaaaagataccctttgttgtgctttatccgtggattcgaagctctgttttggtttttgtttctctcttgtttccccaatttctatttgctgcctattttataccggttagatcgtgttaaatgttgttaaatcggttagttctagttgaagcgcaccaatattaaatccaactagaatttgatccgagttctgacgattatgtttccacatctatacgaatagaataggatactcctattaatcaagtgtcctatttgagtttatcttagaatattaccctatttgaagtttatcttgca

SEQ ID NO: 1261 - DNA, 669 bp, Raphanus sativus
agggtttcagctgcttcaacctctctccagatttagtgtcggaaggatcgttcagaagcaatgtctccggctaaagttgatgccacgaagaaggccgacccaaaggccaaggccttgaaggctgcgaaggcagtgaagtctggccaagccttcaagaagaaggacaagaagatcaggacaaaggtcaccttccacaggccaaagaccttgaccaaggccagagaccccaagtacccaaggatcagtgctactcccaggaacaagttggaccattacggtatcctcaagtacccactcaccactgagtctgcgatgaagaagattgaggacaacaacactcttgtcttcattgttgacattcgtgccgacaagaagaagatcaaagatgctgttaaaaagatgtatgacattcagaccaagaaggttaacaccctcatcaggcctgatggaacgaagaaggcttacgttaggcttacaccggactatgatgctttggatgttgctaacaagattggcattatctaagttttatctacctctactattgttaaaccagtgtttttgtcacttgcttgtagactccagttttgcattgagatattattatctaccatcatcgtttaatgttgaattcaagttctctgtttcttttgcttcttaacaatctta

SEQ ID NO: 1262 - DNA, 842 bp, Oryza sativa
gccgcaaccctccactactacgaatcgccagccgccacaccgagctccgccgccgccaaccccaccgcggcgagctccgccttccgccggccgcgatggctcccaaggccgctgtaaagaaggctgatggaaagactcaacaagccttgaaggttgccaaggcagtgaagtctgggtcaatcaagagaaagtcaaagaagatccgcacttcggtgacatttcacagaccaaagaccctgaagaaggcgagagaccctaagtacccaagagtcagtgcacctggcaggaacaagcttgatcagtaccaaatcctcaagtacccccttacgaccgaatctgccatgaagaagattgaagacaacaacacccttgtcttcatcgtcgacctcaaggcagacaagaagaagatcaaggcagctgtcaagaagatgtatgacatccaggcaaagaaagttaacactctgatcaggcctgacggcaagaagaaggcttacgtgaagctcactccagactatgatgctcttgatgtggccaacaaaattggcatcatttaagttagggcgctttttttcatcatgttgaacgtaagattttggttggctagttcttaatgttgaacagaaccttataacttgcaaaagaacatcttgagttttgttgagcgaatatcatctgtgtgagcgcacatttactgaatcagtatatcaatgtcagttgtgcatcttcttccaacatgaggctactcttctctgttggtcgaactgtatggagctaaatgttgtgctctggtttcacatgattggcagctctcttacacaaccatgagtcgataacaaaaccaa

SEQ ID NO: 1263 - DNA, 739 bp, Oryza sativa
agggttttctcctcagccgtcgtctccctcctcgcttcgcgtccgccgccgccgtcccggagaggtaagttcaagaggcagccctgtgaagctccaatggctcctaaagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagctattatatgctttgcagttgatcacttgattgt

SEQ ID NO: 1264 - DNA, 665 bp, Secale cereale
agtcgcgcccgcaccccaggaaggtaagttcaagcggctgtcctgagaagctcaaatggctcccaaagctgctgttgccaagaagggcgatgccaaggcccaggccgccaaggttgccaaggctgtgaagtctgggtcaatcaagaagaccgcaaagaagatccgcacgtctgtgacatttcaccgccccaagaccctatccaaggccagggaccccaagtaccccaggatcagcacccctggcaggaacaagcttgaccaataccaaatcctcaagtacccgctgaccaccgagtcggcaatgaagaaaattgaggacaacaacacccttgtcttcatcgttgacctcaaggccgacaagaagaaaattaaggctgctgttaaaaagatgtacgacatccaggccaagaaggttaacaccctcatcaggccggatggcaagaagaaggcgtacgtgaagctgacaccagactacgatgctcttgacgtggccaacaagataggcatcatataagtcagtgggagggtcctgcagtaggcgcttgtgtcgtggtttcttatgttatcggagttttgtagttgttacttagcaaaggggctcagtggctccattgccttctatatcgcttcaaactttcatgaatttgatgcaatccaagtgaatc

SEQ ID NO: 1265 - DNA, 682 bp, Carthamus tinctorius
gctgcgcgcctcttcacgttttgcaggttgatccatcatcggagtagcttctgttatcaatggcgcctaaagctgacagcacaaagaaaggtgatgcaaaggctcaggctttgaggacaaccaaggctgttaaaaccggttcgaccttcaaaaagaaggccaagaagatccgaaccaaggtcacctttttccgcccaaggacattgaagaccgacaggaaccccaagtatcctcgcatcagtgccccaccaagaaacaagttggaccactatcagattcttaagtacccattgaccacagaatctgcaatgaagaagatcgaagacaacaacacgcttgttttcatcgttgacatccgtgctgacaagaagaagatcaaagctgccatgaagaagatgtatgacatacagaccaagaaggtcaacacacttatcagacccgatggaacgaagaaggcatacgttcgattaactccagattatgatgctttggatgttgcaaacaagattggaatcatctaagttaaggtgctattgtttcagtgagttggtgttgtcattttgacccttttattagttttgttgtcttgaatagcattctgaatttctttctgtgtttgtcttaaattttggatctaaaaaatgcttaaatggatcatacttcaatagttggagcgaaaaaa

SEQ ID NO: 1266 - DNA, 717 bp, Carthamus tinctorius
  misc_feature (33)..(33): n is a, c, g, or t
ctgctgtattcctcatttcccttttgcagttgntcgatttggagtaggtaaggttagcaatggctcccgctaaaggtgatgttacgaagaaaggtgatgcaaaggctcaggccttgaaggcagccaaagctgtgaagaccggttcaacctttaaaaagaaggctaagaagatccgcaccaaggtcactttctttcgtccaaggacattgaagacagacagaaacccgaagtaccctcgaatcagtgccccaccaagaaacaagcttgaccattaccagattctcaaatacccattgaccacagaatctgcaatgaagaagattgaagacaacaacactctggttttcattgttgacatccgtgctgacaaaaagaagatcaaggctgcggtgaagaagatgtatgacatccagaccaaaaaagtcaacactttgatcagacctgatggaacaaagaaggcttatgtccggttaactccagactatgatgctttggatgtcgcaaacaagattggaattatctaaggtaatgtgttttttttaagtttaaaggaggaatgtatggcagttttgttagttttttatgtcttgaatactactttaagttcaatgcgattattttcgatttggattcagcgttgccaatgtagcaggctttagctgcttcatgcaatactttttatgttactgtttttttttaccatgagttctatttatt

SEQ ID NO: 1267 - DNA, 657 bp, Carthamus tinctorius
ttgctccttttcatcgccgaggtagtattttatcactcgtcggagcttgggtttagcaatggcgcctgctaaagccgatgctacaaaaaaaaggggatgcaaaagctcaggcattaaaggcagccaaggctgtgaagacaggttcaaccttcaaaaagaaagctaagaagatccgaaccaaagttactttccatcgtccaagaacattgaagacagacaggaaccctaagtatcctcgtatcagtgccccaccaaggaacaaattggaccattatcagattctcaaatacccattgacgacagagtctgctatgaagaagatcgaggacaacaacactctagttttcattgttgacatccgtgctgacaagaaaaagatcaaagctgccgtgaagaagatgtatgacattcagaccaagaaggtcaataccttgataagacctgatggaacgaagaaagcctatgttcggttaactcctgactatgatgcccttgatgtcgctaacaagattggaatcatctaagctagttggaacagttttgttagttgtgatgtgttgaatagtattccaatttcaaaccttttaaaaactcacatttgccaatttgttacggatttcagttgatattttatctaatctggtttaccgagacaaa

SEQ ID NO: 1268 - DNA, 675 bp, Senecio madagascariensis
cagctgttcttcattttccaggttatcgatttaattaggctcggttagcaatggccccagctaaagtatgctacaaagaaaggagatgttaaggctcaagccatgaaggcagcaaaggctgtgaaaaccggttcaactttcaaaaagaaggctaagaagatcagaaccaaggttacctttcaccgtccaaggacattgaagactgacagaaaccctaagtaccctcgtatcagtgccccaccaagaaacaagcttgaccattatcagattcttaagtacccgttgaccactgaatctgcaatgaagaagattgaagacaacaacaccttggtgtttattgttgacatccgtgctgacaagaaaaagatcaaggctgcagtcaagaagatgtacgatatccagaccaagaaagtcaacactttgatcagacctgatggaacgaagaaagcttacgttaggttaactccagactatgatgctttggatgtcgcaaacaagattggaataatctaagctaaaatgtttttcagtttaaatggaaaatgtatgttgatccttgtggcagttttgttagttttcatgtctcgaatagtatttcaactttaatgagattattttcaatttggattaaactccattaacggagcatgcttcacctgctttaagtaatttctt

SEQ ID NO: 1269 - DNA, 758 bp, Solanum phureja
tgtcatcttcatctccaaaaccctaaaccagcagcttctctcagttcgtgttggatttttcgcaccatattcagctatggctccagctaaagcggacttaacaaaaaagaaagaccccaaagcccaggctgtcaaggctgccaaggctgttaagtcgggatcaacctttaagaagaagtcaagtaagataaggacaaaagttactttccatcgacctaagacattgaagaaggataggaatcccaagtaccctcgcattagtgcacctggaaggaacagacttgatcagtaccaggttctaaaatgtcctctcaccaccgagtctgcaatgaagaagattgaggacaacaatacccttgttttcattgttgacattcatgctgacaagaagaagataaaagatgcagtgaagaaaatgtatgacatccagataaagaaagtcaataccttgatcaggcccgatggaacaaagaaggcttatgtgaggttgacacccgactatgatgctttggatgtggccaacaaaattggaattatctaaatcgattccctagttttgaatatttctgtcagccttaagtctttatatgagttctatggaaacttttgatcggaagttccttggtttattcattttgaatattgagtttcagctatgtactttgttccatatagtcaggcaagcttctgttcacatttttattttaagcgttttaactaagtaaggtcttttggaaacaacctctttacctcgacaa

SEQ ID NO: 1270 - DNA, 812 bp, Solanum phureja
gcgttaaccgcaatgatgtgactttttaggtttgactgtaaattcaggtgttagatttatatcgtttactagtactgtttatctacctggaatctcgtgatgcaacagaaaccgaagtgatgcgagttgaagtatcaaaactgatttgcatgagaaaatttgatcaatgaatttctgttgcatatattcctgctagtagagatacctgatctgttttacttagtctggacttggaattgccaatgcagcagatgtggtaaaaaaaggtgaccccaaagctcaagctgtcaaggcagccaaggctgtgaagtcgggatcaacctttaagaagacgtcaaaaaagatacgaacaaaagttacatttcatcggcctaagacattgaagaaggacagaaatcccaagtatcccaggattagtgcacctggaaggaacaaacttgatcaggcaaaaccctaacaaattcttcaatgtcctcttaccaccgagtctgcaatgaagaaaattgaggataacaatacacttgtatttattgttgacattcacgctgacaagaagaagattaaggatgcggtgaagaaaatgtatgacatccaggcaaagaaagtcaatacgttgatcaggcctgatggaacgaagaaggcctacgtgaggttgacgcccgactatgatgctttagatgtggcaaataaaattggaattatctaaacgcgttaaatagttcgtattttctgagtatgagagttaacaacttgtgaattgaaggtacccaaatattgttcagttttgacagttgagttagaaaatgtactgt

SEQ ID NO: 1271 - DNA, 714 bp, Solanum phureja
aaaaccctaatcggcagaagcagcttcttctctctctcaggtaagctggtgtttttttctgctagggtttcagaactatacctaacgaaatggctcctaaagctgattcgaccaaaaaatctgaccctaaggctcaagccgtcaaggctgccaaggctgtgaagtcaggatcaaccttcaagaagaagtcacagaagataaggacaaaggttacattccaccgtcctaggactttgaagaaggatagaagccccaagtatcctcgtgtaagtgcacctggaaggaacaaacttgatcagtatgctattctaaagtatcctctcaccactgagtctgcaatgaagaagattgaagacaacaacacccttgttttcattgtggacatcaaagctgataagaagaagatcaaggctgccgtgaagaagatgtatgacattcagacaaagaaaatcaataccttgatcaggcctgatgggactaagaaggcatatgtgaggttgactccagactatgatgctttggatgtggccaacaaaattggaatcatctaaattagtttcctgtttagaattttgatgagaatttagaatttcatgaaacactttaatggaagtgccttgtgttttgaattttgaattttgctttccagagacgtgttttgttccatatttttgttataagagaattcaaccttatgctcctagttagtacttg

SEQ ID NO: 1272 - DNA, 1009 bp, Sorghum bicolor
ggcgcgcattcctcgttcagcccactaggcccacctatcccatgggagtgagtcactcgggtccattctataaaacctctgccccgggggctagggtttcctcccagccgtcatcccttcgcgtccgcctcagcccgccgccagcagaggtaaggtcaggagagagtttcaagaagctgacatggctcctaaagctgctccggccaagaagggtgatgccaagacccaggccttgaaggttgccaaggctgtgaagtctgggtctgtcaagaagaagaccaagaagatccgcacgtccgtgacatttcaccgccccaagaccctgaagaaggctagggacccgaagtacccaagaatcagcactaccggaaggaacaagctcgatcaataccaaatcctcaagtaccccctcaccacagaatcagcaatgaagaagattgaagataacaacactctggtgttcattgttgacctcaaggcagacaagaagaagatcaaggctgctgtcaagaagatgtatgacattcaggcaaagaaggtcaacaccctgatcaggcccgatgggaagaagaaggcttacgtgaagctgacgcccgactacgatgctcttgatgtggccaacaaaatcggcatcatctaagttactgcattaggcatctgtgtcctagttctttgtgaaaccagagtttttgtagctatggctctcagtggctccattaccatgtcttgatgcagacttatgaatttgatatcatccaagtgaccggttgagctagtttgagctctgcactaagttatacttggatactatctgtttttctttatgtcaccagtaatattgtttgtcatattgggtttgtcttgcaactaatccttgctctgagcctccgaccaagtagctgttttgcgtataatgtcatctgttgctggaactggaacctgcatgctgtgaggtcctaatgccaaataggccatcactgtttaattgctgtcaaattgaaaagtttaa

SEQ ID NO: 1273 - DNA, 581 bp, Sorghum bicolor
gacccagcgcgcattatgaaacctctgccccggggctagggttttcctccccgccgccatcgcttcgcgtccgccgccaggagaggagaggagaggtaaggagggagttttgagaagctcaaatggctcctaaagccgctcctgccaagaaggctgacgccaaggcccaggccttgaaggttgccaaggctgtgaagtctggggcaggcaagaagaagaccaagaagatccgcacttcggtgacatttcaccgccccaagaccctgaagaaggccagggacccgaagtacccaagaatcagcactaccggaagaaacaagcttgatcagtaccaaatcctcaagtacccactcaccacagaatcagcaatgaagaagattgaagataacaacactctggtgttcatcgtcgacctcaaggcagacaagaagaagatcaaggccgctgtcaagaagatgtatgacattcaggcaaagaaggtcaacaccctgatcaggcctgatgggaagaagaaggcttatgtgaagctgacccccgactacgatgctcttgatgtggccaacaaaattggcatcatctaa

SEQ ID NO: 1274 - DNA, 800 bp, Glycine max
ctagagccggcttctccctctgcgcaggaattgggaacattcgacaggtagagtttcttcaatggctcctaaagttgataagaagaacgacccaaaggcacaggccttgaagactgctaaggcagttaagtctggtgctacctttaagaagaaggcaaagaagatccgaacttctgtcactttccacagaccgaggacattgaagaaggataggaaccccaagtaccctcgcattagcgcgcctccaagaaataagcttgatcattatcagatcctgaaataccctctgaccactgaatccgccatgaagaagattgaggacaacaacactttggttttcattgtcgacctgcgtgccgacaagaagaagatcaaggatgccgtgaagaaaatgtatgacatccaggccaagaaagttaacaccttgatcaggcctgatggaaccaagaaggcttatgtccggttgacccctgattacgatgcattggatgtggcaaacaagattgggattatctaaggtagtacctaggcagttctatggttattcttggcggaaactttttaaaaaaatgataggttctatattttgtgttttgttattttgtatgttttggttccgttgacactaagcagacctcgtgtttcaattttgactagagagttgtttaaattgatgattggaatgatcatgttaaaattttctaattagtgattatgctacacggaatgtgaggttgatgagtgtaccgatgctaattgcatatttgcttaaatcgctgtggcattaagcgaaattgtgc

SEQ ID NO: 1275 - DNA, 700 bp, Glycine max
gccgttgcctctgcctctcacccgcagggtttagagaaaatttaacaattagggttgcttctcctttgccgacccatggctcccaaagctgatagttcaaagaaggctgatccaaaggcacaggccttgaaaactgccaaggcagttaagtccggtgctaactttaagaagaagaccaagaagatccgaacatctgttaccttccatcgaccaaggactttgaaaaaggataggaaccccaaatatccacgcattagtgctccacccaggaacaagcttgatcactatcagatattgaagtttcctctcacgactgagtctgcaatgaagaagattgaagacaacaacactttggttttcattgttgacttgcgggccgacaagaagaagatcaaggatgcagtcaagaagatgtatgatattcaggccaagaaagtaaacaccttgatcaggcctgatggaaccaagaaggcctatgtcaggttgacacctgattatgacgccctggatgtggccaacaagattggaattatctaaactaatatatggcctcaccaaagtagatttctgtttagatggtagtttgttatggggtgttgaggggagacatttgaagcaacattaagttataaattttcggtttgttatctggtgtattttagttcaattggaattatatttacttttgttacaattttca

SEQ ID NO: 1276 - DNA, 684 bp, Glycine max
agagccggcttcttcctctgcgcaggaattaggaatatttgacaggtagagtttcttcaatggctcctaaagttgataagaagaatgatccaaaggcccaggccttgaagactgctaaggcagttaagtcaggtgctacctttaagaagaaggtaaagaagatccgaacttctgtcactttccacaggccgaagaccttgaagaaggacaggaaccccaagtaccctcgcattagcgccccgccgaggaacaagcttgatcattatcagatcctgaaataccccctcaccactgagtctgccatgaagaagattgaggacaacaacactttggttttcattgtcgacctgcgtgccgacaagaagaagatcaaggatgcggtgaagaaaatgtatgacatccaggccaaaaaagtgaacaccttgatcaggcctgatggcaccaagaaggcatatgtcaggttgacacctgattacgatgcattggatgtggcaaacaagattgggattatctagggtagtactagtacttaggcagctctatggttattcttgaagaaaacttttttaaaaagcatagattctatattttgtgttttgttattttgtatcttttgtctcagttgacactaagcagaccttgtgtttcaattttgactagagagttgtttaaattgaagattta

SEQ ID NO: 1277 - DNA, 774 bp, Glycine max
aacctaaaaccctaattctacagcagccctccgatttttaaggaggttgtgtgaattgctggtgagtgatttaaatggctcctactaaggtggacaatgccaaaagggctgatcccaaagctcaggccttgaagacagctaaggctgtcaaatcaagtggtcaagtgtttaggaagaaagctaaaaagatcaggacatcggttacatttcacaggccaaggaccttgaagaaggaaaggaaccctaagtaccctcgcattagtgctccacccagaaacaagttggaccattatcagatacttaaatttcctctaactactgagtctgctatgaagaaaattgaggataacaacacgctggtttttattgttgaccttcgtgcaaacaagaaaaagattaaggatgctgtgaagaagatgtatgacattcaggcaaagaaagtcaatacattaatcaggccggatgggacaaagaaagcctatgttaggttgactccagattatgatgccttggatgtagctaacaagattggtatcatctaagttgtactcttgattttagcgaagctaatccttcattgttaagatagttgttctacatgttctgagttaggactctttgttttccatatgtattgactattgttcattcaattttgagttgagaacatgaattcagttttatactagtataattaatagtataaaagtagtttactgactccattgtttccaaggtttgatcaatgtccatttccttatatgccaaggtata

SEQ ID NO: 1278 - DNA, 688 bp, Glycine max
aggaggttgtaagaattgccggtgagtgattacaatggctcctgctaaggcggacaatgccaaaaaggctgatcccaaagctcaggctttgaagacagcaaaggctgtcaaatcaggtggccaagtgtttaagaagaaagctaaaaagatcaggacatctgttacatttcacaggccaaggacattgaagaaagaaaggaaccctaagtaccctcgtattagtgctccacccagaaacaagttggaccattaccagatacttaaatttcctctaactactgagtctgcaatgaagaaaattgaggataacaacacactggtttttattgttgacctccgtgctgacaaaaagaagattaaagatgctgtgaagaagatgtatgacattcaggcgaagaaagtgaatactttaatcaggcctgatggaacaaagaaagcctatgttaggttgactccagactatgatgccttggatgtagctaacaagattggtatcatctaagttgtactcttgatttttgcaaagccaatccttcattgttaagatagttgttctacatgtcctgagttaggactctttgttttccatatgtattaactattgtttattcaattttgagttcagaacatttttatgaattcagttttatactagtataattaataattaatctgtgactgattgctt

SEQ ID NO: 1279 - DNA, 755 bp, Glycine max
ggtgcctctgcttcctacacgcagggtttcccgaagatttaacacctatggctcctaaagctgatagtttaaagaaggctgatccaaaggcacaagccttgaaaactgctaaggctgttaagtcaggtgctactttaaagaaaaagaccaagaagatccgaacatctgttaccttccatcgaccaaagaccttgaaaaaggataggaaccctaaatacccacgcattagtgctccacccaggaacaagcttgatcactatcagatattgaagtatcctctcacaactgagtctgcaatgaagaagattgaagacaacaacactttggttttcatagtcgacttgcgggctgacaagaagaagatcaaggatgcagtcaagaagatgtatgatattcagaccaagaaagtaaacaccttaatcaggcccgacggcaccaagaaggcttatgtcaggttgacacctgattatgacgccctggatgtggccaacaagattggaattatctaaactaattcctggcctcaccaaagtcgatttctgtttagatggtagtttgttttgtgaacattgaggggagacatttgaaggtttttttttttttttttgaaagggagacatttgaaggttaagttctaaattttgcggtttgttatttggtgtattttagttcaattggaattatatttacattgttacaatttcaaatttgatgagtaaatgggccgttattattatccaatgtaagtttttgag

SEQ ID NO: 1280 - DNA, 692 bp, Euphorbia esula
  misc_feature (9)..(12): n is a, c, g, or t
  misc_feature (117)..(117): n is a, c, g, or t
  misc_feature (402)..(402): n is a, c, g, or t
  misc_feature (405)..(405): n is a, c, g, or t
  misc_feature (462)..(462): n is a, c, g, or t
  misc_feature (583)..(583): n is a, c, g, or t
gctgctctnnnnctcagggtttcaggtaatttcgaaaaggtaggtgaagcttgagaagtagcagcaatggcaccagctaaagctgatggttcaaaaaagcctgatgcaaaggctcangcagttaaggcggcaaaggcagtgaagtctggaccaaccttcaagaagaagggaaagaagatcagaactaaggttacattccatcgcccaaggaccttaaagaaggagaggaatcccaaatatcctcggattagtgctcccccaagaaacaagcttgaccagtaccagattttgaaatacccactcactaccgagtctgcaatgaaaaagatcgaggataacaataccttggtatttattgttgatatccgtgctgacaagaaaaagatcaaggatgctgttaanaanatgtatgatatccaggccaagaaagtcaacaccttgatcaggcccgatggaactaanaaggcttatgtcaggttgaccccggactttgatgcgttggatgttgcaaacaaaatcgggatcatctaaattagttgtcggcaacaagttttctagttatgatagttttgtttaattccanattaaagtatttttgttgttaaattaagcagagagatttgatactttattttaagtttgtaaacttgttcaactgctgtctgattatttcattttcaatccctttttag

SEQ ID NO: 1281 - DNA, 674 bp, Fragaria vesca
  misc_feature (1)..(1): n is a, c, g, or t
  misc_feature (38)..(38): n is a, c, g, or t
ngccgcagctctctcacctcaggtaggactgtttcagncagaggtttgagcaatggctcctaaagttgacagtaagaaggctgatcccaaggctcaggccttgaaggctgccaaggctgttaagtcagggcaaaccttcaagaagaaggccaagaagatcaggacatcagtgacattccacaggccaaggacattgaagaaggaaagaaaccccaaatacccccgcattagcgcaccaccaagaaacaagttggaccattaccagatcctcaagtatccattgaccaccgagtctgccatgaaaaagattgaggacaacaacacccttgtcttcattgttgacatccgtgctgataagaagaaaatcaaggatgcagtgaagaagatgtacgacattcagaccaagaaagtgaatactctgatcaggcctgatggaaccaagaaggcatatgttaggttgacacctgattacgatgcattggatgtggctaacaagatcggtatcatttaagccatcgttgtgttatttagatggagccaaagggattttgttattgctttgacatttttgttagtagtactgtactggtttcatactcttttctttaatgtgtttgagaaccatgttgttttgcatatggcaatgtgatgctattaaaatttagtacttgcaa

SEQ ID NO: 1282 - DNA, 571 bp, Fragaria vesca
ccgccggctggcagctcttcttcttctgcttccaatggctccacctaaaggtgatgtttccaaaaagggtgacccaaagtcgcaagccttgaaggctgccaaagctttgaaatctggacctgctgttaagaaaacagggaagaagatccgaacatcagtgacgtttcatcagcctaagacattgaaaaaagagaggaaccctaagtaccctcgtattagtgctccaccaaggaacaagcttgatcattatcaaattttgaagtatcctcttactactgaatcagcaatgaaaaagattgaagataacaacaccttggtatttattgttgacattcgggctgacaagaagaaaataaaggatgcagtcaagaaaatgtacgacattcagacaaagaaagtgaataccttgatcaggcctgatggtactaaaaaggcttatgttaggttgaccccggattttgatgcactggatgtggcaaacaaaattggtatcatctaaggtagtgtgtctggcatcctcagagagtggcaggtcttgttagtccttgagctgtcgaagatttagtttttt

SEQ ID NO: 1283 - DNA, 819 bp, Saccharum officinarum
cgcttcgcgttcgcctcagcccgccgccaggagaggtaaggtcaggagagagtttcaagaggctgaaatggctcctaaagctgctcctgccaagaagggtgatgccaagacccaggccttgaaggttgccaaggctgtgaagtctgggtctgtcaagaagaagaccaagaagatccgcacgtccgttacatttcaccgccccaagaccctgaagaaggctagggacccgaagtacccaagaatcagcactactggaaggaacaagcttgatcagtaccaaatcctcaagtaccccctcaccacagaatcagcgatgaagaagattgaagataacaacactctggtcttcattgtcgacctcaaggcagacaagaagaagatcaaggccgctgtcaagaagatgtatgacattcaggcaaagaaggtcaacaccctgatcaggcctgatggcaagaagaaggcttacgtgaagctgacgcccgactacgatgctcttgatgtggccaacaaaatcggcatcatctaagttactgcattaggcatcggtgtcctagttctatgtgaaaccagagttttttgtagctatggctctcagtggctccattaatgtcttgatgcagacttatgaatttgatgtcatccaagtgaccggttgcgccagtttgacctctgcatttcattatacttggataccatcagtttttattatgtcaccagtaatattgtttctcatcttcggttggtttttgaactaagtcgggttggtttttgcaactaagtcttactctgagcctccgacaaaatatcagttttgagtat

SEQ ID NO: 1284 - DNA, 798 bp, Saccharum officinarum
  misc_feature (741)..(741): n is a, c, g, or t
gcttcgcgtccccctcagaggttcagaccgccgccaggagaggtaaggagggagttttgacaagctcaaatggctcctaaagccactcctgccaagaaggctgatgccaaggcccaggccttgaaggttgccaaggctgtgaagtctggggcaggcaagaagaagaccaagaagatccgcacgtccgtgacatttcaccgccccaagaccctgaagaaggccagggacccgaagtacccaagaatcagcaccactggaagaaacaagcttgatcagtaccaaatcctcaagtaccccctcaccacagaatcggcaatgaagaagattgaagataacaacactctggtcttcatcgtcgacctcaaggcagacaagaagaagatcaagtccgctgtcaagaagatgtatgacattcaggcaaagaaggtcaacaccctgatcaggcctgatgggaagaagaaggcttatgtgaagctgacgcccgactacgatgctcttgatgtggccaacaaaattggcatcatctaagttacaggcaactggattcggcatctgagccctactagttctatgtgagacgagagtttttgtcgctattcctttctatggcactcagtggctccattaccgtgtcttgatgcacgcttatgatttctatatcatccaagtgaccggttgtgctaattttagctttgagcatactgtcagattttccaatgttacgagtaattttgttgtgtngggttggtttttcaactaagctttgttctgaacctcagactacctatgcctgtattg

SEQ ID NO: 1285 - DNA, 770 bp, Saccharum officinarum
cgcttcgcgtccgcctcaggccgccgccaggagaggtaaggtcaggagagagtttcaagaggctgaaatgtctcctaaagctgctcctgccaagaagggtgatgccaagacccaggccttgaaggttgccaaggctgtgaagtctgggtctgtcaagaagaagaccaagaagatccgcacgtccgttacatttcaccgccccaagaccctgaagaaggctagggacccgaagtacccaagaatcagcactactggaaggaacaagcttgatcagtaccaaatcctcaagtaccccctcaccacagaatcagcgatgaagaagattgaagataacaacactctggtcttcattgtcgacctcaaggcagacaagaagaagatcaaggccgctgtcaagaagatgtatgacattcaggcaaagaaggtcaacaccctgatcaggcctgatggcaagaagaaggcttacgtgaagctgacgcccgactacgatgctcttgatgtggccaacaaaatcggcatcatctaagttactgcattaggcatctgtgttctagttctatgtgaaaccagagtttttgtagctatggctctcagtggctccattactatgtcttgatgcagacttatgaatttgatgtcatccaagggaccggttgcgccagtttgagctctgcatttcattatacttggataccatcagtttttattatgtcaccagtaatattgtttctcatattgggttggtttttgaaccaagtcgggttggtttt

SEQ ID NO: 1286 - DNA, 739 bp, Saccharum officinarum
  misc_feature (80)..(80): n is a, c, g, or t
gtactgcactgcacgcgaccgcggactgaactggccgggaccgacccacgcgtacggtttcctcccagccgtcatcgctncgcgtccccctcagaggttcagaccgccgccaggagaggagggagttttgagaagctcaaatggctcctaaagccgctcctgccaagaaggctgatgccaaggcccaggccttgaaggttgccaaggctgtgaagtctggggcagccaagaagaagaccaagaagatccgcacgtccgtgacatttcaccgccccaagaccctgaagaaggccagggacccgaagtacccaagaatcagcaccactggaagaaacaagcttgatcagtaccaaatcctcaagtaccccctcaccacagaatcggcaatgaagaagattgaagataacaacactctggtcttcatcgtcgacctcaaggcagacaagaagaagatcaagtccgctgtcaagaagatgtatgacattcaggcaaagaaggtcaacaccctgatcaggcctgatgggaagaagaaggcttatgtgaagctgacgcccgactacgatgctcttgatgtggccaacaaaattggcatcatctaagtaggcaactggattcggcatctgagccctactagttctatgtgagacgagagtttttgtcgctattcctttctatggcactcagtggctccattaccgtgtcttgatgcacgcttatgatttctatatcatccaagtga

SEQ ID NO: 1287 - DNA, 701 bp, Saccharum officinarum
  misc_feature (26)..(26): n is a, c, g, or t
  misc_feature (655)..(655): n is a, c, g, or t
  misc_feature (676)..(676): n is a, c, g, or t
cgaacgcgtggcgaaacgcgtggcgnaacgcgtgggcgcttcgcgtccgccttagcccgccgccaggagaggtaaggtcaggagagagtttcaagaggctgaaatggctcctaaagctgctcctgccaagaagggtgatgccaagacccaggccttgaaggttgccaaggctgtgaagtctgggtctgtcaagaagaagaccaagaagatccgcacgtccgttacatttcaccgccccaagaccctgaagaaggctagggacccgaagtacccaagaatcagcactactggaaggaacaagcttgatcagtaccaaatcctcaagtaccccctcaccacagaatcagcgatgaagaagattgaagataacaacactctggtcttcattgtcgacctcaaggcagacaagaagaagatcaaggccgctgtcaagaagatgtatgacattcaggcaaagaaggtcaacaccctgatcaggcctgatggcaagaagaaggcttacgtgaagctgacgcccgactacgatgctcttgatgtggccaacaaaatcggcatcatctaagttactgcattaggcatcggtgtcctagttctttgtgaaaccagagtttttgtagctatggctctctgtggctccattaatgtcttgatgcanacttatgaatttgatgtcatncaagtgacccgttggcgcaagtttg

SEQ ID NO: 1288 - DNA, 795 bp, Saccharum officinarum
  misc_feature (717)..(717): n is a, c, g, or t
tcgcgtccccctcagaggttcagaccgccgccaggagaggtaaggagggagttttgagaagctcaaatggctcctaaagccgctcctgccaagaaggctgatgccaaggcccaggccttgaaggttgccaaggccgtgaagtctggggcaggcaagaagaagaccaagaagatccgcacgtccgtgacatttcaccgccccaagaccctgaagaaggccagggacccgaagtacccaagaatcagcaccactggaagaaacaagcttgatcagtaccaaatcctcaagtaccccctcaccacagaatcggcaatgaagaagattgaagataacaacactctggtcttcatcgtcgacctcaaggcagacaagaagaagatcaagtccgctgtcaagaagatgtatgacattcaggcaaagaaggtcaacaccctgatcaggcctgatgggaagaagaaggcttatgtgaagctgacgcccgactacgatgctcttgatgtggccaacaaaattggcatcatctaagttacaggcaactggattcagcatctgagccctactagttctatgtgagacgagagtttttgtcgctattcctttctatggcactcagtggctccattaccgtgtcttgatgcacgcttatgatttctatatcatccaagtgaccggttgtgctaattttagctttgagcatactgtcagattttcctatgntactagtaattttgttatattgggttggtttttcaactaagccttgttctgaacctcagactacctatgcctgtattg

SEQ ID NO: 1289 - DNA, 687 bp, Saccharum officinarum
cttcgcgttcgcctcagcccgccgccaggagaggtcaggagagagtttcaagaggctgaaatggctcctaaagctgctcctgccaagaagggtgatgccaagacccaggccttgaaggttgccaaggctgtgaagtctgggtctgtcaagaagaagaccaagaagatccgcacgtccgttacatttcaccgccccaagaccctgaagaaggctagggacccgaagtacccaagaatcagcactactggaaggaacaagcttgatcagtaccaaatcctcaagtaccccctcaccacagaatcagcgatgaagaagattgaagataacaacactctggtcttcattgtcgacctcaacgcagacaagaagaagatcaaagccgctgtcaagaagatgtatgacatttcaggccaagaaggtcaacaccctgatcaggcctgatggcaagaaaaaggcttacgtgaagctgacgcccgaatacaatgctctggatgtgggcaacaaaatcggcatcatctaaattactgcattaggcatcggtgtcctaattctatgtgaaaacacggttttggtagctatggctcccacgggtccattaatgtcttgatgccaactattaattatgctgtcatccaagtgaaccggtggcccaacattgaccttcggctttccttatacttggatacc

SEQ ID NO: 1290 - DNA, 664 bp, Helianthus annuus
ttcttcatcaccgttttgcagttgttcggttattggagtagcaatggcgcctaaagctgacaacgcaaagaagactgatgcaaagtctcaggctttaaaggcagccaaagctgtgaaaacaggttcaacattcaaaaagaaggccaagaagatccgaactaaggtcacctttcaccgcccaaggactttgaagacagacaggaacccgaagtatccccgcatcagtgctccaccaaggaacaagttggatcactatcagattcttaagtatcctttgacaactgaatctgcaatgaagaagatcgaagacaacaacactcttgttttcattgttgacatccgtgctgacaagaagaagatcaaggccgcagtcaagaagatgtatgacatccagaccaagaaagtcaacaccctaatcagacctgatggaacgaaaaaagcttatgtgcggctgactccggattatgatgctttggatgttgctaacaagattggaatcatctaagcttaagctgttattgcttcagtcgaaaggtgtattgtcatttttgacattattgttagttttgttgtctggaatagagtttgaaatttcttatgtttgatcaaagatgttaatggatcatattttaatagttggagttgctgtttcaatttttgagag

SEQ ID NO: 1291 - DNA, 746 bp, Helianthus annuus
  misc_feature (674)..(674): n is a, c, g, or t
  misc_feature (689)..(689): n is a, c, g, or t
cattcccgaaaccctagttgccgccgcatctccgttttgcaggtacatcggctattggagtagcttcagtcaacaatggcgcctaaagctgatacaacaaagaaaggtgatggaaaggctcaggctttgaaggcagccaaagccgtgaagacaggatcaactttcaagaagaaggccaagaagatccgaaccaaggtcacctttcaccgcccaaggactttgaagaccgacaggaaccctaagtatccccgcatcagtgctccaccaagaaacaagttggatcattaccagattcttaagtatccgttgaccaccgaatctgcaatgaagaagatcgaagacaacaacactcttgttttcattgtcgacattcgtgccgacaagaagaagatcaaagctgcagtcaagaagatgtacgacatccagacaaagaaagtcaacaccttaatcagacctgatggaacgaaaaaggcttacgtccggttgactccagattatgatgctttggatgttgcaaacaagattggaatcatctaaattctaaagtgatgttattgctgcttcagttgttattttcaaacgttattgttagttttgtcgacttgaatagagtttcaaatttcttgtgttttttttattatggatttaaatatgcgaatgaatcatatttcaanttttgggtgcttttntatttcttttgccattctatattgtatgatccaagtcatctaacatttgctgaaaaa

SEQ ID NO: 1292 - DNA, 725 bp, Helianthus annuus
  misc_feature (665)..(665): n is a, c, g, or t
gcggggctcctatttcactttacggttatcgattggagtaggttcggttagcaatggcccctaaagctgatgttgcaaagaaagctgacgctaaagcacaggctttgaagacagcgaaggccgtgaagaccggttcaacctttaaaaagaaggccaagaagatccgcaccaaggttacctttcatcgtccgaggacattgaagactgacagaaaccctaagtacccgcgtatcagtgctccaccacgaaataagcttgaccactatcagattctcaagtacccgttgaccacagaatctgcaatgaagaagattgaagacaacaacactctggttttcattgttgacattcgggctgataagaaaaagatcaaagctgcagtgaagaaaatgtatgatatccagaccaagaaagtcaatactttgatcagacctgatggaacaaagaaagcttatgttcggttaactccagactatgatgctttggatgttgcaaacaagattggaataatataaggtaaaatgtcattttatttgaaagtggaaatgtatgctcattgttgcagttttgttagttttgttttcttttgtagcacttcaaatttcatgtcattgttttaaatttggattcaattttgctaattgagctactgtatacctgcttcngttatgtttgttattttggggtgtttttctttattatactttttagttgatggaaaaaaa

SEQ ID NO: 1293 - DNA, 659 bp, Helianthus annuus
  misc_feature (522)..(523): n is a, c, g, or t
ttttttccatctgcaggttcacttcacaatgtcgcccgctaaagttgctgctacaaagaaaggtgatgcgaaagctcaagcattgaagacagcgaaggctgtgaaaaccggatcaacgttcaagaagaaggcgaagaagatcaggacgaaggttacgtttcaccgtccgagaacattgaagactgatagaaaccctaagtaccctcgcatcagtgctccaccgagaaacaagcttgatcattaccagattttgaagtatcctttgactactgagtctgcaatgaagaagattgaggataataatactttggtgtttattgttgatattcgtgctgataagaagaagattaaagctgctgttaagaagatgtatgatattcagactaagaaggttaatactttgatcagacctgatggaacgaagaaagcctacgttaggttaactccagactatgatgctttggatgttgctaacaagattggaataatctaaggtaaaatgtcgtgtcagtttaaagggannatgtatgctcaccgtgacagttttgttagcttccttttcttgaatactaattcaagtttaatgtgagtattttcaatctggattcaacttttgttatagttgctgttttaattattgtttttatggagctcttgcc

SEQ ID NO: 1294 - DNA, 779 bp, Panicum virgatum
ccagccgtcgtcgcttcccgtccgccgcagcccgccgccaggagaggtaaggagggagttctgagaagcccaaaatggctcctaaagctgctcctgcgaagaaggatgccaagacccaggccttgaaggttgccaaggcggtgaagtctggggcagtcaagaagaagaccaagaagatccgcacgtcggtgacatttcaccgccccaagaccctgaagaaggctagggacccgaagtacccaagagtcagcgctcctggaaggaacaaacttgatcagtaccaaatcctcaagtatcccctcaccacggaatcagcaatgaagaagatcgaagataacaacactctggtcttcatcgttgacctcaaggcggacaagaagaagatcaaggctgctgtcaagaagatgtatgacatccaggcaaagaaggtcaacactctgatcaggcccgatggtaagaagaaggcatatgtgaagctgacaccggactacgatgctcttgatgtggccaacaaaatcggcatcatctaagttacaggctactttgttaggcatctgtgtcctagttctatgtgaaacgagagttttgtagctattccttatctagggccacagtggctccattaccatgccttgatgcacacttatgattttggtaccgtccaagtgaccagttgagccaatttgagctttgcacttgcttgtactatcagttactttattagcattaccagtagttttgtgtcacttgatatgttgttgcaagttttccatatgcct

SEQ ID NO: 1295 - DNA, 789 bp, Panicum virgatum
gctagctttgcctctcctctcccgcgccgccgcctcctctttcgcccacctcgcggtccagccgtccgtcgaggttgagcaacctgaaactacaatggcgcctaaagctcccccgaaaaaggctgatagcaaggctcaagccttgaaggttgccaaggctgttaagtctggatccaccaagaggaagaccaagaagatccgcacatctgtgacatttcacaggccgaagaccctcaagaagccaagggaccccaagtacccaagagtcagtgcacctgggaggaacaagcttgatcagtaccaaatcctcaaatacccacttacgaccgagtctgcaatgaagaagattgaagacaacaacacccttgtcttcatcgtcgacctcaaggcggacaagaagaagatcaaggcagccgttaagaagatgtatgacatccaggcgaagaaggtcaacactctgatcaggcctgatggcaagaagaaggcttacgtgaagcttacaccagactatgatgctcttgatgtggccaacaagatcggcatcatctaaattttgtagttctgtgtgccagtgtgttgcagtttcagagttctgtgggggtagggtcttatctgtagctaagcctgagtaccctttttctgcttgtgaactggtaccaatgatggaaatttgcaatgttcaagttctgcatttgaatttttctgttggatgttagcacttattgcgatatgaggctacatcatgttgcaggttcgtgattttgggtttggctatttatttcctagtaa

SEQ ID NO: 1296 - DNA, 808 bp, Panicum virgatum
gcgcccctcgcccaccacacttctctataaaggcaaaacagcagccgctagggtttctctagtccgccggcgtcgctccgcatcccgcagcaggttgagcagcctgccctgttgagaaactgcaatggcgcctaaagctccccctaagaaggctgatagcaaggctcaagccttgaaggttgccaaggctgttaagtctggaaccaccaagaggaaggccaagaagatccgcacatctgtgacgtttcaccggcccaagaccctcaagaagccaagggaccccaagtacccaagaatcagtgcacctgggaggaacaagcttgatcagtaccaaatcctcaaatacccccttacgactgagtctgcgatgaagaagattgaagacaacaacacccttgtcttcatcgttgacctcaaggcggacaagaagaagatcaaggcagccgttaagaagatgtatgacatccaggcgaagaaggtcaacactctgatcaggcccgatggcaagaagaaggcttacgtgaagcttacaccagactatgacgctcttgatgtggccaacaagatcggcatcatctaaattttgtagttttgtgtgccagcgtgttgcagtttcagagttttggtgtgctaggtcttgtatctgtttggacagaaccgcatagctaagcctgtgaactggtactgatgatggaaatttgcaatgttctgcattttaattttgttgttggatgttagtggttattgcgatatgaggctactggtattttatcatggtcaaatcaagcaaaagtcagttcaaactccc

SEQ ID NO: 1297 - DNA, 748 bp, Panicum virgatum
cccagccgtcatcacttcccgtccgccgcagcctgccgccaggaggggtaagtccaggagggagttttgagaagcgcaaaatggctcctaaagctgctcctgcgaagaaggatgccaagacccaggccttgaaggttgccaaggctgtgaagtctggggcagtgaagaagaagaccaagaagatcaggacgtcggtgacatttcaccgccccaagaccctgaagaaggctagggacccgaagtacccaagagtcagcgctcctggaaggaacaagcttgatcagtaccaaatcctgaagtatccccttaccacggaatcagcaatgaagaagatcgaagataacaacactctggtcttcatcgtggacctcaaggcggacaagaagaagatcaaggctgctgtcaagaagatgtatgacatccaggcaaagaaggtcaataccctgatcaggcctgatggtaagaagaaggcatatgtgaagctgacaccggactacgatgctcttgatgtggccaacaaaatcggcatcatctaaggctactttgttaggcatctgtgtcctagttctatgtgaaacgagagttttgtagctattccttatctagggccgcagtggctccattaccttgtcttgatgcacacttatgaatttggtaccgtccaagtgaccagttgagctaatttgagctttgcacttgcttatactatcagttactttattagcaataccgtaaggtttctttacac

SEQ ID NO: 1298 - DNA, 829 bp, Camellia sinensis
tatcggccattacggccgggggcttgcaaaccctagacggcagttcgtatcaggggtattaggtagtttttttagggtttagggttacctcacttaacaatggctcctgctaaagctgacccggctaaaaagtctgatgcgaaggcccaggcctcgaaggctgccaaagctgtgaaatctggttcatcaacctttaagaagaaggccaagaagataagaacaacagtcaccttccatcgaccaaggacgttgaagaaggataggaaccccaagtaccctcgcattagtgcgaccccaaggaacaaacttgatcagtaccaaatcctaaaatatccactcaccactgaatcagcaatgaagaagattgaagataacaacaccttggtttttcattgttgatatccgtgctgacaagaagaagatcaaggatgcagtcaagaagatgtatgacatccagaccaagaaagtgaataccttgattaggcctgatgggacgaagaaagcctatgtgaggttgacaccagactatgatgctttggacgtggcaaacaagattgggataatctaagatagtagtcaacctttcatattccagttgtatgattttatttgaagtattttaattaaaatctcccacattttggctgagaattttgtactgagatttggtttcaatccgttttatagttaagtactgggctgtggtggattccacatctttcaattttgtaagcttggattggattttgagttctggtttatgattgtatctcgaccttgttacattgtgacacaaataaacatgtcgcgctcggctatgtgcgccgca

SEQ ID NO: 1299 - DNA, 618 bp, Camellia sinensis
gagcggccgcccgggcaggtacgcggggagctgcggcaaacccttcttctccctcacttcctctcctccgtctcaaggttgggttaacaatggctcgcggccgaggtacaaaaaaggctgatccaaaggcacaggccttgaaggctgccaaggctgtgaaatcgggttcatcaaccctcaagaaaaaagttaagaagatccgaacaacagttacctttcacaggccgaggacattgaagaaggacaggaaccccaagtatccacgcattagtgcccctccgagaaacaaattggaccattatcagatcctgaaatacccattgactactgagtctgcaatgaagaagattgaggataacaatacccttgttttcattgttgacatccgtgctgacaagaaaaagataaaggatgcagtgaagaaaatgtatgacattcagaccaagaaagtgaacactttgatcaggcctgatggtaccaagaaggcatatgttcggttgactccagactatgatgccttggatgtggcaaacaagattggaatcatctaagatcgatttacttgtcctcttatctagagcaaaaccattttgttggtacctcggccgcgaccacgct

SEQ ID NO: 1300 - DNA, 807 bp, Thellungiella halophila
ggcctgcggctgcaaagtgagctaggtttatcagctgcttagcctctccagagatttagagtgagaagaaccatcctgagctatgtctccggctaaagttgataccacaaagaaggccgacccaaaggccaaggctttgaaggctgcaaaggcagtgaagtctggccaagccttcaagaagaaggacaagaagatcaggacaaaggtcaccttccacaggccaaagactttgaccaaggccagagaccccaagtacccgagaatcagtgcaactccgaggaacaagttggatcattacggaatcctcaagtacccactcaccaccgagtccgcaatgaagaagattgaagacaacaacactcttgtcttcattgttgacattcgtgctgacaagaagaagatcaaagacgccgttaagaagatgtatgacattcagaccaagaaagtcaataccctcatcaggcctgatggaacgaagaaagcgtacgtgaggcttacaccggactacgatgctttagacgttgctaacaaaattggcatcatctaaacttatttaccttggcaacttaaaaacagacttgtggttttgtctctcgtagtctcagttttgctttaagatattattaccatcgtctggtgattgtagtatttgggcaaaaacttttttttaacaatacattcttgttgcagtttattgttgaattcaagttatatgttttcggcttctgaacaatcttatattagtcctcttataaacttcttaaaagcacataagctaatgcaatctctcttctctaaaaaaaaaaa

SEQ ID NO: 1301 - DNA, 735 bp, Nicotiana tabacum
ggaccggcggctgtaagaattcccgtcgcagtaatcaacaatggcacccgccaaagctgttagcacaaaaaaggcagaccccaaagctcaggcagcaaaggtcgccaaggctgtgaaatcaggatcaaccttcaagaagaagtcaaacaagatcagaatgaaggttacctttcacaggcctaagacattgaagaaggagaggaacccaaaatatccccgtatcagtgcaactccaaggaacaagttggatcattacggaatcctcaagtatcctttaaccactgagtctgcaatgaagaagattgaggataataacaccttggttttcattgttgatctcaaagctgacaagaagaagattaaggatgccgtcaagaagatgtatgatattcagaccaagaaagtgaacactttggtcaggcctgatggaaccaagaaggcgtttgttcgattgacaccagactatgatgcattggatgtggcaaacaagatcggaatcatctaaaagaggaactcgttttctctgcaaagatagctcgtttgacaattttgttagctatgtttgttttaaataccgttagtaatattactgtagttgtgactgttaatttgagaacaatcttggcaccttttggttaaatgtcccgatggtttacgtactgttttgtgaaattaccttcttatctattttgtaagacaagaaacattttgcgagcggatgaaaatatttgattc

SEQ ID NO: 1302 - DNA, 785 bp, Nicotiana tabacum
  misc_feature (168)..(168): n is a, c, g, or t
  misc_feature (613)..(613): n is a, c, g, or t
ggccgcctcggccggggaatcggcagagcagcttctctcaggtaagctggtagatttatcgtagggtttcagactgtacctaaccaaatggctccagctaaagctgatccgtccaaaaaatctgatcccaaggcacaggcagctaaggttgccaaggccgtcaagtcnggatcaaccttcaagaagaagtcacaaaagataaggacaaaagttacattccaccgacccaagactttgaagaaggatagaaaccccaagtaccctcgtatcagtgcacctggaaggaacaaacttgatcagtacggaattctaaagtatcccctcaccaccgagtctgcaatgaagaagattgaggacaacaatacccttgttttcatcgtggacatcaaggctgataaaaggaagattaaggatgccgtgaagaagatgtatgacatccagacaaagaaagtcaataccttgattaggcctgatgggactaagaaagcatatgtgaggttgactcctgactacgatgcattggacgttgccaacaaaattggaatcatctaaactagtagttacctgtttagaattttacgagaatttaaaatcttggattgagtttttaganacacttgaatggaagtgccttctatttttcattttgaattttgtgttttggagacatgttttgttccgtataagagaaatcaacttttatgctgcagtttttctttctcgaaattctctgagtccttagctgtgttcctaaacccttagaggcggagggggtcaagaatcct

SEQ ID NO: 1303 - DNA, 690 bp, Nicotiana tabacum
  misc_feature (81)..(81): n is a, c, g, or t
  misc_feature (636)..(636): n is a, c, g, or t
  misc_feature (661)..(661): n is a, c, g, or t
  misc_feature (665)..(665): n is a, c, g, or t
gaaaaccctaggcggtacagcgggagcaactctgaggtttgcagtagtgttttagaactgtctcccatggctccagctaangatgtggcaaagaaaggtgatcccaaagcccaagccgtcaaggctgccaaggctgtgaaatcaggatcaacctttaagaagaaatcaacaaagatacgaacaaaagtcacatttcatcggcccaagacattgaagaaggatagaaatcccaagtatccccggattagtgcacctggaaggaacaaacttgatcagtacgggattcttaaatatcctctcaccaccgagtctgcgatgaaaaagatcgaggacaataatacacttgtttttattgttgacatcaaggctgacaaaaagaagattaaggatgcggtgaagaaaatgtatgatatccagacaaagaaagtcaataccttgatcaggcctgatggaacgaagaaggcatatgtgaggttgacacccgactatgatgctttggatgtggcgaacaaaattggaatcatctaaatgtattaaatgttttgagttctttatatgagaatttggaactattgaactgaagtactatattattcaattttgacaattgagtttcagtgatgtactgttccatgnaagactgttaagcttgtattaaaantagntctaatttgtgagcggccgcatgag

SEQ ID NO: 1304 - DNA, 624 bp, Nicotiana tabacum
  misc_feature (304)..(304): n is a, c, g, or t
cctaaaccacagagctaagcagcttctctcaggtaagccatcgtattgggtttttagcactgtcctcagctatggctccagctaaagttgatttggccaaaaagaaagaccccaaagcccaagctgtcaaggctgctaaggctgttaagtcaggatccacatttaagaagaagtcaacaaagataaggacaaaagttactttccatcgacctaagacattgaagaaggataggaatcctaagtacccccgcattagtgcacccggaaggaacaaactcgatcaatacgggatcctaaaatatcntcttaccactgagtctgcaatgaagaagattgaggacaacaatacccttgtcttcatcgttgatatcaaagctgacaagaaaaagataaaggatgcagtgaagaaaatgtatgacatccagacaaagaaagtcaataccttgatcaggcccgatggaacaaagaaggcttatgtgaggctgacacctgactatgatgctttggatgtggctaacaaaattggaatcatctaagttgattacctagttttgaatttttatgtcaaacctgaaattttggatatgagttctttagaaactttgaacaggaagtgccttgggt

SEQ ID NO: 1305 - DNA, 690 bp, Nicotiana tabacum
aatcggcagagcagcttctctcaggtaagctggtagatttctcgtagggtttcatactgtacctatccaaatggctccagctaaagctgatccgtccaaaaaatctgaccccaaggcacaggcagctaaggttgccaaggctgtcaagtcaggatcaaccttgaagaaaaagtcacaaaagataaggacaaaagttacattccaccgacctaagactttgaagaaggatagaaaccccaagtaccctcgtattagtgcacctggaaggaacaaacttgatcagtatgggattctaaagtatcccctcaccacagagtctgcaatgaagaagattgaggacaacaacacccttgttttcattgtggacatcaaggctgataaaaagaagattaaggatgccgtgaagaagatgtatgacattcagacaaagaaagtcaataccttaattaggcctgatgggacgaagaaagcatatgtgaggttgactcctgactatgatgctttggacgttgccaacaaaattggaatcatctaaactagttacctgtctagaattttacaagaatttaaaatcttggatttgagttactagatacacttgaatggaagtgccttgtgtttttcattctgaattttgtgtttcagagacaagttttgttccgtgtaaaagatttcacttttattctcgca

SEQ ID NO: 1306 - DNA, 766 bp, Solanum lycopersicum
aaataaagtcatcttcatctccaaaaccctaatcagcagcttctgtcagttcgtattggatttttcgcattgtatttagctatggctccagctaaagtggacttaacaaaaaagaaagaccccaaagcccaggctgtcaaggctgccaaggctgttaagtctggatcaacctttaagaagaagtcaagtaagataaggacaaaagttactttccatcgacctaagacattgaagaaggataggaatcccaagtaccctcgcattagtgcacctggaaggaacagacttgatcagtaccaggttctaaaatgtcctcttacgaccgagtctgcaatgaagaagattgaggacaacaatacccttgttttcattgttgacattcatgctgacaagaagaagataaaagatgcagtgaagaaaatgtatgacatccagataaagaaagtcaataccttgatcaggcctgatgggacaaagaaggcttatgtgaggttgacacccgactatgatgctttggatgtggccaacaaaattggaattatctaaatcgattacctagttttgaatatttctcagtcttgagtctttatatgagttctatggaaacttttgaacggaagttccttggtatattcattttgaatattgagtttcagctatgtactttgttccatatagtcaggcaagcttcttttcacatatttattttaagcattttaacttcaagcttctatgtctttttcatacaacctcgttacctccacaa

SEQ ID NO: 1307 - DNA, 620 bp, Solanum lycopersicum
aagcaattagggagctgagttttgtagtttagggtttagaactgtctctaatggctcccgctaaagcagatgtgataaaaaaaggtgaccccaaagctcaagctgtaaaggctgccaaggctgtgaagtcgggatcaacctttaagaagatgtcaaaaagaatacgaacaaaagttacatttcatcggcctaagacattgaagaaggacagaaatcccaagtatcccaggattagtgcacctggaaggaacagacttgatcagtaccagattcttcaatgtcctctaaccaccgagtctgcaatgaagaaaattgaggataataatacacttgtatttattgttgacattcatgctgacaaaaagaagatcagggatgcggtgaagaaaatgtatgacatccaggcaaagaaagtcaatacgttgatcaggcctgatggaactaagaaggcctacgtgaggttgacgcccgactatgatgctttagatgtggcaaataaaattggaatcatctaaacgcgttaaatagttgtatttttttgagtatgagagtttacaacttctgaattgaaatacccaaatatattcaattttgacagttaaatagttacaaaatgtact

SEQ ID NO: 1308 - DNA, 706 bp, Solanum lycopersicum
aaaaccctaatcggcagaagcagcttcttctctctcaggtaagctggtgtttttttccctagggtttcagaactaaacatatccaaatggctcctaaagctgattcgaccaagaagtctgaccctaaggctcaagccgttaaggctgccaaggctgtcaagtcaggatcaaccttcaagaagaagtcacagaagatcaggacaaaggttacattccaccgtcctaggactttgaagaaggatagaagccccaagtatcctcgtgttagtgcacctggaaggaacaaacttgatcaatatgctattctaaagtatcctctcaccaccgagtctgcaatgaagaagattgaagacaataacacccttgttttcattgttgacatcaaagctgataagaagaagatcaaggctgctgtgaagaagatgtatgacattcagactaagaaaatcaataccttgatcaggcctgatggaactaagaaggcatatgtgaggttgactccagactatgacgctttggatgtggccaacaaaatcgggatcatctaaattagttttcctgtttagaattttgaggagaatttagaatttcatgaaacactttaatggaagtgccttgtgttttgaattttgaattttgctttcctgttttattccatatttttgttataatagaattcaaccttgtgctcctagtgagtacttga

SEQ ID NO: 1309 - DNA, 840 bp, Triticum aestivum
tctcatcctcgctctcatcgagcttcagaccctccttggtggcagagacaagcttcttgcctcgtgccgaattcggcacgagggcatcgcctcgcgcccgcaccccaggaaggtaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggaaggaacaaattagaccagtaccagatcctcaagtacccgcttaccactgagtctgcgatgaagaagattgaagacaacaacacccttgtcttcattgtcgacctcaaggccgacaagaagaaaataaaggctgctgtcaagaaaatgtatgacattcaggccaagaaggttaacaccctcatcaggcctgatggcaagaagaaggcgtacgtgaagctgacaccagactacgatgctcttgacgtggccaacaagatcggcatcatataagccagagggagggtcctgcagtaggcgcttgtgtcgtggtttcttatgttattggaattttgtagttgttacttagcaaagggccttagtggctccattgcctaccatatcgctgcacactttcatgaatttgatgcaatcgaagtgacttgtgttgatgctaatttgagctttgcgtttggtcttaccatattggttggtttctttaccatccttcgacttactgtatttcctgta

SEQ ID NO: 1310 - DNA, 778 bp, Triticum aestivum
gcatcgcctcgcgcccgcaccccaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggcagacaaaaaaaagatcaaggctgccgtgaaaaagatgtacgacatccaggccaagaaggttaacaccctgatcaggcctgatggcaagaagaaggcgtacgtgaagctgacaccagactatgatgctcttgacgtggccaacaagatcggcatcatataagtcagagggacggtcctgcagtaggcgcttgtgtcgtggtttcttatgttattggagttttgtagttgttacttagcaaaggggctcagtggctccattgcctaccatatcgccgcgcactttcatgaatttgatgcaatcgaagtgacttgtgttgatgctaatttgagctttgcgtttggtcttaccgtattggttggtatctttaccatccttcgacttaccttatttcctgtataatttcccagttttgctcgt

SEQ ID NO: 1311 - DNA, 790 bp, Triticum aestivum
ctcagccgtcttcgcatcgcctcgcgcccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctgaaggccgacaagaagaagattaaggccgctgtcaagaaaatgtacgacattcaggccaagaaggttaacaccctcatcaggcctgatggcaagaagaaggcgtacgtgaagctgacaccagactacgatgctcttgatgtggccaacaagatcggcatcatataagtcagagggagggtcctgcagtaggcgcttgtgtcgtggtttcttgtgttattggaattttgtagttgttacttagcaaaggggctcagtggctccattgcctaccatatcgctgcacactttcatgaatttgatgcaatcgaagtgacttgttgttgctaatttgagctttgcgtttggtcttaccatatcggttggtttctttaccatcctttgacttaccatatttcctgtataatttcccggttttgctcgttg

SEQ ID NO: 1312 - DNA, 553 bp, Triticum aestivum
  misc_feature (7)..(7): n is a, c, g, or t
  misc_feature (466)..(466): n is a, c, g, or t
  misc_feature (523)..(523): n is a, c, g, or t
  misc_feature (533)..(534): n is a, c, g, or t
aaaaaanaactcgagcctcgtgccgaattcggcacgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggcagacaaaaaaaagatcaaggctgccgtgaaaaagatgtacgacatccaggccaagaaggttaacaccctgatcaggcctgatggcaagaagaaggcgtacgtgaagctgacaccaagactatgatgctcttgacgtggccaacaagtcggcatcatataatcaagagggacggtcctgcaataagcgcttgtgtctggttcttaagttantggagttgtagtgttacttacaaagggctcatggtccattgctacatatcgcgccantcataattgnncatcgagtactgtttgtct

SEQ ID NO: 1313 - DNA, 658 bp, Zinnia violacea
tcgtcaccgttttgcaggtttatcgactattggattagctcgagttaacaatggtgtctaaaggtgatagcacaaagaaagctaatgcaaaggctcaggctttgaaggtggctaaagccgtgaagactggttcaaccttcaaaaagaaggcgaagaagatcagaaccaaggtcacctttcaccgcccgaaaacattaaaaacagacaggaaccctaagtatccccgcatcagtgctccaccaaggaacaagttggatcattaccagattctcaagtatccattgaccactgaatcggcaatgaagaagattgaagacaacaacactcttgtcttcattgttgacatccgtgctgacaagaagaagatcaaagctgcggttaagaagatgtatgacatccagaccaagaaagtcaacaccttgatcagacctgatggaacaaagaaagcttatgtgaggttgactccagattacgatgctttggatgttgcaaacaagattggaatcatctaaatttttaaatcaagttatttctgcttcagttgttattttcaacattattgttagtgtgtcgacttgaatagagtttcaaagttttgtgttggtcttaattatgaattcaaatatgctaatgaatcatgtttcaactaaaaaaaaaa

SEQ ID NO: 1314 - DNA, 1543 bp, Malus domestica
ctctctctctctctctctcaagaatatatgagccccacccagtttgtctgcatgcaacctcatacttataatctctttgtttatctgttccatatctattttgcactgcttcctcttgatgcactttgttgcatagtcttggactcaaacttcagggaagcgtcgacagtcaacttgtaaaatggagattaccaacgtcagcgagtatgaggccatcgcaaaggagaagttgccaaagatggtctatgactactatgcatcaggagcagaggaccagtggactcttgctgaaaacagaaatgctttcgcgagaattctgtttcgaccccgtattctcattgacgtgagccgcatagacatgaccaccacggttttgggcttcaagatctcaatgcccatcatgattgccccaacagccatgcagaaaatggcccatcctgaaggtgaatatgctactgcgagggcagcatcagcagcaggaacaattatgaccttgtcttcatgggctacttcaagtgttgaagaggttgcttcaactggacctggaatccgtttcttccagctctatgtctacaaggacaggaatgtggttgctcagctggtgagaagagctgaaagggctgggttcaaggctattgctcttacagttgataccccaaggctcggtcgcagagaagctgacatcaagaacagatttactttgcctccgtttttgacactgaagaactttgagggtttggacctcggaaagatggacaaagctgctgactctggacttgcttcatacgttgctggtcaaatcgatcgttctcttagctggaaggatgtgcagtggcttcagacaatcacttcactgcctatcctagttaagggtgttctcactgccgaagatgcaaggattgcagtacaagctggagcagctgggattattgtgtccaaccatggagctcgccaacttgattacgtcccttcgactatcatggccctcgaagaggttgttaaaggtgcacaaggacgcattcctgttttcttggatggtggtgtccgtcgaggaacagatgtcttcaaagcattagctttgggtgcctctggcatatttattgggcgccctgtggtgttctctctcgctgctgaaggagaggctggcattagaaaggtactccaaatgctgcgcgaagagtttgagctaaccatggcattaagtggatgccgttcgctcaaagagatcacccgcgatcacattgtgactgactgggacgctcctcgccctcgccatcagccaaggttatagaaacattcaaatgaatggcggtggataaacctttacaagctgagagttgatgtgatcggttccacagcctgcctttgttcttggattccttattatttctgcgttttctgtaatgatgctggacggtgagataatatttccatggctactgctgctgcccttcactgtatattttttccattaaacagaaatatcgatcgtcatataactattacgacaatctcctttgctgcagttaaatgattctgatat

SEQ ID NO: 1315 - DNA, 1392 bp, Musa acuminata
gggggcgaatcaccatctcacatcccaacccatatatcactcttctccaccccccaccctccattccttcccctgctctcggctaccaagatcggttgaagttgtgggggtgtgacacgctaccataagcatggagatcaccaacgtgatggagtacgaggccgtcgccaagcagaagttgcccaagatggtgttcgattactacgcctctggcgcggaggaccagtggaccttgaaggagaacagggaagccttctcaaggatcctgtttcgtccacgcatactcattgatgtctccaggattgacatgaccacaactgttctgggtttcaagatatcaatgccaatcatgattgctcccactgccatgcagaagatggcccatcctgaaggagaatatgctactgcaagagcagcatcagccgctggcactataatgacgctgtcatcctgggctacttccagtgtggaagaggtggcctcaaccggaccaggaattcgattcttccagctttatgtatacaaagaccggaatgtggttgcgcagcttgtgagacgagcggaaagagcatgattcaaagcaatagccctcactgtggatactccaagactaggtcggagagaagctgatatcaagaacagattcactttgcccccatttttgacgctcaagaacttcgagggcttggacctggggaagatggataaggctgatgactctggactggcttcttacgttgctggccaaattgaccgaactctgagctggaaggatgtcaagtggttgcagacgatcactactatgccaattctagtgaaaggagtcctcactgcggaggacacaaggctggccattcaatctggtgcagctggtattatcgtctccaaccatggagctcgtcagctggactacgttccagccaccatcactgccttggaggaggtcgtcaaagctgcgcagggccgccttcccgtcttcctcgatggtggcgttcgccgtggcaccgatgtcttcaaggccttagctttgggagcctccggaatctttattggaaggccggtggtgttttctttggctgctgcaggtgaagccggaatccgaaatgttctgcaaatgcttcgcgatgagttcgagctcaccatggcactgagtggctgcacctcgctcaaggaaatcactcgcagccacatcgtgaccgaggcagaaaggaatcgtcctgtgccaaggttgtagatcatctccagtgtctcctcctccgacaacaggggactgactacttataagctctgcatcttttgagtgatctggagaacatgctcaggagacactatctacccatggagcaaagttgcgatgagttccaagaatcattagatgcttaagtaatataa

SEQ ID NO: 1316 - DNA, 2899 bp, Brachypodium distachyon
gcgacctcccttccttccttccttcctcgttccgctccactgctccaggacacgaaacgagccgtcgatcgcgcagcttcgcccgtctctcccggtgccggtccccccttgcaacaacatgggagtggagttgatcacgaacgtttccgagtacgagaagctcgccaaggagaagctgcccaagatggtgtacgactactacgcctccggcgcagaagatcagtggacgctcaaggagaacagggacgccttctccaggatcctgttccgaccacgcgtgctgatcgatgtgtcccatatcaacatggctacaaacgtcttgggcttcaacatctccatgcctatcatgatcgcccccacagcaatgcagagaatggctcaccctgaaggagagcttgctactgcaagagcagcagcgtctgcaggaaccataatgacattgtcttcatgggctacttctagtgttgaagaggttaactcagtaggacctgggatacgtttcttccaactttacgtttacaaggacaggaccatagtacggcaactcgtgagaagggctgaaatggccggatttaaggctatcgcactgaccgtcgacactccaaggctcggtcgcagggaagctgatatcaaaaacaggttcaccttgcctccacatctggtgttgaagaactttgaggggctggatatcggcacgatggacaagacaaatgattctggcctcgcttcctacgttgctagccaagttgaccggtctctttgttgggaggacgtcaagtggctgcagacaatcacctcgttgccgatcctagtgaaaggggtcatgactgcagaagacactagacttgccgtcgaaaatggggccgccggtatcatcgtgtccaaccatggcgctcggcagctagactacgttcctgcgaccatcagctgcctggaagaggtggtgagggaggcgaaggggcggctgccggtgttcctggacggcggcgtccggcgcggcacggacgtgttcaaggccctggcgctgggagccgcaggagtattcatcgggaggccggtgctgtactcgctggccgtggacggggaggccggggtgaggaaggtgctgcagatgctgcgggacgagctggagatcgccatggcgctcagcgggtgcacgtcgctgagggagatcacgcgcgcccacgtcctcgtcgccgccgacgccgacactactgtcccccgccgcgcccggctctaggcggcacctgctcctgcatgcgaactgaagatttctacggagtgctgttgaaagcagatccgttcctcagcgagctgaccaacatgtacgagcggagcacggagaagggctctgtctgggtcaccatgaagcgatcgtcgctcaagtgcgcggctaggttgaagaagatggagaagaagggacagacggtggagtacatgtgcctcgtccgcgctaccgatggcaagaggaacatctccacctcgctggctgcaaaggactatgccaaattccaagcttcgtatgctctagttcttaaagcccatatgcatgctttgaagaagagggagaggaaggacaggaagaagaccgtggaggctgagaaggtacccgagaaggagccaaagaagcagaagaaatcatcttcaaaaaaatcttcagggtctaagtatacaaggactccatcatggactccaccctcaactgccgcgccaacggcagcctcttcgacgtctcccacatgtgcggcctcagcctccacggctcccaggccatccccttcctcgagaccctcgtcgtcgccgacgtcgccgccctcaaggacgggaccggctccctcaccgtcttcaccaacgagaaaggcggcgccatcgacgactccgttgtcaccaaggtcaccgacaagcacgtctacctcgtcgtcaacgccgggtgcagggacaaggacctcgcccacattggggcgcacatggaggcgttcaacaagaagggcggcgacgtcaagtggcacatccacgatgagcggtccctgctcgcgttgcagggtcctcttgctgcaccaactctccagttgctgacaaaagaagatttgagcaaaatgtatttcagtgacttcaagatgattgacatcaatggatctgcttgctttctcaccagaactggttataccggtgaagatggttttgaaatctcagtcccatcagagaacgcgcttgatctcgcaaaggctctcctggagaaatccgaaggcaaggtgaggctgacagggctgggagcccgcgacagcctccgtctggaggccgggctctgcctctacggcaacgacatggagcaacacaccactccggtggaggccggcctgtcgtgggcgatcggcaagcggaggagagcggagggcgggttcctgggcgcggaggtgatcctgaagcagctcaaggaaggccccaagatcagacgcgtgggcatcttctcgcagggcccgcccccgcggagccacagcgcgatcgtgagcggcgacgggtcgggggagaacatcggcgaggtgaccagcggagggttcagcccgtgcctgaagaagaacatcgccatgggttacgtcaagtcggggctgcacaaggccgggacggagttcaaggtggtcgtccgtggcaagtcctacgacgccgtcgtcaccaagatgcccttcgtgcccaccaagtactacaaggccccttagatatatgtgattttgtacaaaacaggatgccgcgatttttctcttgcaactccgtcgtcgtagcttgttcatggcagggtacttgaaaatgctgcgacgattgtaacttctgtcactgtcaggctttcctcctacggcttgacgtttcgtctaataaatatatatgccagctgcgttgttttttc

SEQ ID NO: 1317 - DNA, 1472 bp, Manihot esculenta
atcacttgagagctccagagttccttctctctctctctccaacattatatgcactctttctcgttttctcttcccattttcttcttctcctattggtagagtttggccaagaatattattttaaggtacaaataatcaattcagaaagatggagataaccaatgtcatggaatatgaggaaattgctaagcagaaattgccaaagatggttttcgactactatgcatcaggtgcagaagaccaatggactctcaaggagaatcgcaatgctttctctcgaattctgttccgaccccgcattcttattgatgtgagcaagattgacatgactacaagtgtgttgggcttcaagatttcaatgcctatcatgattgctccaactgccatgcagaaaatggctcaccctgaaggagagtatgcaacagcaagggcagcctcagcagctggcacaattatgacgctatcttcatgggctacttccagtgtggaggaggttgcttcaacagggcctggcattcgctttttccagctttatgtgtacaaagacaggaatgtggttgctcagcttgtgagaagagctgagagggctggattcaaggcaattgccctcactgtggatactccaagacttggccggagagaagctgacatcaagaacagatttactttgccaccatttttgacactgaagaactttgagggcttggatcttggaaaaatggataaggctgatgactctggacttgcttcatatgttgctggccaaattgacaggacacttagctggaaggatgtgaagtggcttcagacaatcacatcgctgccgatcctggtaaagggtgtgctgactgcagaagatgcaaggctatccatacagaatggagctgcaggaatcattgtctccaatcatggggctcgccagcttgattatgttcctgcaactattatggcactggaagaggtcgtcaaagctgcacaaggccgtgttcctgttttccttgatggtggagttcgccgtggtactgatgttttcaaggcattggcactaggagcatctggaatatttattggaaggcctgtggtgttctcattggctgctgaaggagaggctggtatcaggaaagtacttcagatgcttcgtgaggagttcgagctaacaatggcattaagtgggtgccgctcactcagggagattactcgtaaccacattgtggccgactgggaccttcctcgcccagtcccgaggttataaggcaccaccactcccaaccgcacattgaaatgaagaaaggagaatttgggagaacctgtctgtcattagaatcccatatatcaaattgaagggttcatcaatatttgaagaatttgaacttttgtaatgacaatcaatggtatatctaagaatggcttctgcttgccttgtatactctttttcctaactacggcatccttaccagaccagccttcattat

SEQ ID NO: 1318 - DNA, 1558 bp, Manihot esculenta
gtttgtttgtttgcatcacttgggagctccagagttctcagtctccctctccaccattatatccactctttctcatttgctctgtcatttgttttctctcctgttgcgtagagtttagccaagatactgtggtgaggcacaaataatcagtttgggaagatggagataaccaatgttatggaatatgaggaaattgcaaggcagaaattgccaaagatggtttttgactactatgcatcaggtgcagaagaccagtggactctcaaggaaaatcgcaatgcattctctcgaattctgtttcgacctcgcattcttattgatgtgagcaagatagacatgactacaagtgtcttgggcttcaagatttcaatgcctatcatgattgctccaacagccatgcagaaaatggctcacccagaaggagagtatgcaacagcaagggcagcttcagcagctggaacaattatgactctatcttcatgggctacttccagcgtagaggaggttgcttcaacagggcctggtattcgctttttccagctttatgtgtacaaagacaggaatgtggttgctcagcttgtgagaagagctgagagagctggattcaaggccattgcccttacagtggatactccaagacttggccggagagaagctgatatcaagaacagattcactttgccaccatttttgactttgaagaacttcgagggcttggatcttggcaaaatggataaggctgatgactccggacttgcctcatatgttgctggccaaattgaccggacacttagctggaaggatgtgcagtggcttcagacaatcacatcactgccaatcctggtgaagggtgtcctgactgcagaggatacaagactagccatacagaatggagctgctggaatcatcgtatccaatcatggagctcgccagcttgattatgttcctgcaactattatggcattggaagaggtggtcaaagctgcacaaggccgtgttcctgttttccttgatggtggagttcgccgtgggacagacgttttcaaggcattagcactaggagcatctggaatatttatcgggaggcctgtggtattctcactggctgctgaaggtgaaactggtattaggaaggtgcttcagatgctccgcgaggagttcgagctaacaatggcattaagtggctgccgctcgctcagggagattactcgtaatcacattgtgactgactgggaccttcctcacccagttgccaggttataaggcggcgtcaccccaactccacgttgaaatcgagacaggaaaattcgagagaggctctgtctttagaatctcatatatcaaattgaagggttgatcaatatttggaaggatttgaagttgtgtgtttgacaatcaatagcattttacttgatattaataattttaaggtaaatactaatgattaggtaactgtattaacgaaattaaattagagcttagaagttttccaagtggagtaaaatccaaggaaagaatatgattaaattattaatagaataatatgtgactttatatt

SEQ ID NO: 1319 - DNA, 1338 bp, Ricinus communis
gcttcattcttgtgtcatccactttcttgggctttcaccttgttgctctttagttccattgaatattttggtaaggcggaagcaatcagttcggaaagatggagataaccaatgttatggaatatgaggaaattgcaaggcagaagttgccaaaaatggtttacgactactatgcatcaggtgcagaggaccagtggactttgaaggagaaccgcaatgcattctctagaattctgttccgcccccgcattcttattgatgtgagcaagattgacatgaccacatctgtcttgggattcaagatttcaatgcctatcatgattgctccaacagccatgcagaaaatggcccacccagaaggagaatacgcaacagcaagggcagcttcagcagctggcacaattatgacactatcttcatgggctacttccagtgtcgaggaggttgcttcgacaggacctggcattcgctttttccagctctatgtgtacagggataggaatgtggtagctcagcttgtaagaagagctgaaagggctggtttcaaggcaattgccctcactgtggatactccaagacttggccgaagagaagctgacatcaaaaacagatttactctgccgccatttttgactttgaagaactttgaaggattggatcttggaaaaatggataagagtgatgactctggactatcatcatatgttgctggccaaattgaccgaacacttagctggaaggatataaagtggcttcagacaatcacatcactgccaatcctggtgaagggtgtgctgactgcagaggatactaggctagccatccagaatggagctgctggaatcatcgtctccaatcatggagctcgccagcttgattatgttcctgcaactattatggccttggaagaggttgtcaaagctgctcaaggccgagttccagtttttcttgatggtggagttcgtcgtggaacagatgttttcaaggcattggctctaggagcatctggaatatttattggaaggccagttgtgttctcattggctgctgaaggtgaagctggtattaggaaagtacttcaaatgcttcgcgatgagttcgagctaacaatggcattaagtggctgccgctcgctcagggaaattacccgtgaccacattgtaactgactgggatcttcctcgccctgttgcctctgccaggttataaggcagttgactaaaatggaaattgtcattagaatcacatatatcggattgatcaatatttggaagaaatttgaacttttgtaataacaatcaacagtattgctatgaatggccactgctttttccttgta

SEQ ID NO: 1320 - DNA, 1694 bp, Castanea mollissima
ggcaatgctaacctcgaaaagccaatccactctgtctttctctctctctctctctctcatgtcatccctacccctacgctttttgtcttcacttatcagaatacaaataactttacgctctcttcttccctcaccatttgtttggttttttatttctttttcttctttgtatcgtattgttgggacgttcactctctctctctctctctgcttctctcttcagcattatctgcagtgcagctcctctttggcactctctcattcgttctttttcctaaggagcccaagaatattctgtagatagcataaacaatcctttggagagatggagataactaatgttacagagtatgaggcaattgccaaggagaaattgccgaagatggtttatgactactacgcatcaggtgcagaggaccaatggactcttaaggagaaccgaaatgcattctcaaggattttgtttcgacctcgtattcttgttgatgtaagcaagatagacatggccacaactattctgggcttcaaaatctcaatgcccatcatgattgctcccacagccatgcagaagatggctcaccctgaaggagagtatgcaacagcaagagcagcatcagcagctggcactattatgatactttcctcatgggctacttccagtgttgaagaggttgcttcaacaggacctggcattcgctttttccaactctatgtgtataaagacaggaatgtggttgcacagcttgtaagaagagctgaaagggctggtttcaatgcaattgccctgactgtggacactccaaggcttggccgcagggagtctgacattaagaacagatttgttttgccaccatatttgactttgaggaactttgacggattgaatcttggaacgatggataagaccaatgattctggactagcttcatatgttgctggacaaattgaccgctctctcagctggaaggatgtgaagtggcttcagacaatcaccaaattaccaattcttgtgaagggtgtccttactgctgaggatacaaggctagcaatacaagctggagctgcaggaattattgtgtccaatcatggagctcgccaacttgattatgttcctgcaactattatggctttggaagaggttgtcaaagctgcacaaggccgagttcctgtttttctggatggtggaatccggcgagggacagatgtctttaaagcattggctctaggagcatcaggcatatttattggaagacctgttgtattctcattggctgctgaaggcgaggctggtgtaagaaaagtacttcaaatgcttcgggatgagtttgaactaacgatggctttaagtggttgtcgctcacttaaagagattacccgtgatcacattgtaactgaatgggaccgtccgaatctttcacccaggttgtaagattataaggctgcttcttgttcattattatggtgggaggttatttcaggaacatgtcttttgtaaagaataacacctctcacatctggtttgaaaatatatattgaagagttcgaacttctgtaacacaataaatgagattattatactgagattattacaaaactacttagttggggattggggttatgaacttatggcaccaatgcagcatatttttgtaacagtgaatgctttattttattcctaagcaactggtggtgaa

SEQ ID NO: 1321 - DNA, 1449 bp, Castanea mollissima
ttatttatctacaacacctctcagttggttcccctgcatgcactccattgcatagttttggaaaccaagattttctgaagggaaactttaacagaaaccaaagatggaaataaccaatgtcagtgagtatgaggccattgcaaagcaaaaattgcccaagatggtgtttgactactatgcatcaggagcagaggaccaatggactctggcagaaaacagaaatgctttctcaagaattctgtttcgaccacgtattcttattgatgtaagcaagatagacatgactactactgttttgggcttcaaaatatcaatgccaataatgattgcccctacagccatgcagaaaatggctcatcctgaaggggagtatgcaacagcaagagctgcatcagccgctggaacaattatgactctatcctcatgggcaacttctagtgttgaggaggttgcttcaactggacctggaatccgctttttccagctctatgtctacaaggacaggcatgttgttgctcaacttgtgagaagagctgaaagagctgggttcaaggctattgcccttacagttgataccccaaggctgggtcgcagagaagctgacatcaagaataggtttactttaccaccatatttgacattgaagaactttgaaggtttggaccttggcaagatggacaaaagtaatgactctggacttgcttcatatgttgctggtcaaatcgatcgttctctgagctggaaggatgtgaagtggcttcagacaatcaccaaactgccaattctagttaagggtgtactcactgcagaggatgcaaggctagcagtacaagctggagctgctgggattattgtatccaatcatggagctcgccaacttgattatgtccctgccactatcctggcccttgaagaggttgttaaagctgcacaaggacgagtgcctgtgttcttggacggtggtgtacgtcgtggaacagatgtattcaaggcattggcactgggagcttctggcgtattttttggacgccctgtgctgtactcattggctgcagaaggagaggctggtgtgagaaaagtactccagatgttgcgtgaggagtttgagctaactatggcattaagtggttgccgttcactcaatgaaatcacccgtaatcacgttgtgactgattgggaccttcctcacccacgcccattgcccaggctatagaacaatgcctcagaacatcagcagctgcctatataaagcagtgttctttaaatggttatattctgtgttaagcagcctgcctttttctttggagaactcattttagttttgatgagtctgcaaatattttggaagttctaaacttcctgcaatgatgatgaataatgtatctttattaatactgcttcctttcaatgtatattctttatacacatatatacatagtttaatcttca

SEQ ID NO: 1322 - DNA, 1875 bp, Citrus sinensis
atagcgaaaatatttcttgtccgttttgattatatgtaattttatttataacatcacatagaaatagcattgatctatttttcctgtcgataattctggtggaaagcagggatgatgatgatattcatcagtacacgcagccgcatgcacatcaaaccaaaacctatcttcttattttccagaagatttgctttgcacacgtaagatgagcaacaggcagcgattatggttaaaatgattcaatggaactgcccactcacaagtctcaagtttccatgaaaaagagttcaagtctcaatttgctctgattttgattcgtacccttttgtcttgactctgcattctttagtacttttttgccaccttatcattcagtgccgtcccatgtttgtttatgtcgtgcgtcagcgtctgtaatataatatttaatgcttgtagagtcccaagaagagtttttcactctctcttccttcagtcttcatttcccagtttctgactttattgctttgcgctcccttcactgattcatttctgcttcttttgttgtttaaggaagccaagcgatagcattatgacttatatatcggagatcaccaatgttatggagtatgaggctcttgcaaaggagaaattgccgaagatggtttatgactactatgcatcaggtgctgaggaccagtggactcttcaggaaaaccgtaatgcattctctaggattctatttcgaccacgcattcttagagatgtaagcaagattgacatgactacaacagtcttgggcttcaacatttccatgcccatcatgattgctccaacggcatttcagaaaatggctcatcctgaaggggagtgtgcaacagcaagggcagcctcagcagctggcacaatcatgacattatcttcatgggccacttccagtgtcgaggaagtttcttcaacgggacctggaattcgctttttccaactctatgtgaccaaggacaggaatgtggacgcacagctagtaaaaagagctgaaagggctggttttaaggcgattgcccttaccgtcgatactccaaggcttggccgtcgggaagctgatattaagaacagatttgttttgccgccacatctgactttgaagaactatgagggcttgtatattggcaagatggataagactgatgactctggattagcttcgtatgttgccaaccaaattgaccggtcactgaactggaaggatgtgaagtggcttcaaacaatcacctcactgccaatactcgtgaagggtgttcttactgctgaggatgcaagtctagcaatacaatatggagctgcaggaatcattgtatccaatcacggagcgcgccaactagattatgtccctgcaactgttatggctttggaagaggttgttcaagctgcaaaaggccgagttcctgttttccttgatggtggggttcgtcgtggaaccgatgtcttcaaggctttggctctaggagcatctggagtatttgttggaaggccagtaccattctcgctggcagttgatggagaggctggtgtgagaaaagtgcttcagatgcttcgtgatgagtttgagctaacaatggcattaagtgggtgccgttcgctcaaggagattacacgcaaccacattgtgactcattgggacactccaggagctgtagccagattgtaagatggtctccaacatcaacattaaaacttttcatttttaaacaactgtgattcgaataacctaatcccggattcagggattaggatattgttaagacgacaaggatgtatgaattaattaaataaagggaggtgcggcttggcttggcttggcttggcttggcttggggctttttatgtaaaaaaaaa

SEQ ID NO: 1323 - DNA, 1367 bp, Gossypium hirsutum
  misc_feature (696)..(696): n is a, c, g, or t
  misc_feature (955)..(955): n is a, c, g, or t
  misc_feature (1167)..(1167): n is a, c, g, or t
  misc_feature (1203)..(1203): n is a, c, g, or t
  misc_feature (1216)..(1216): n is a, c, g, or t
  misc_feature (1229)..(1229): n is a, c, g, or t
  misc_feature (1235)..(1235): n is a, c, g, or t
attcagctctctatcaactctctctagattcctggagacagccaaagataattttgtgtttgcagaaaacattgtagaaaaagaaatggagatgataacgaatgtttcggaatacgaggtcattgcaaaggaaaaattgcccaagatggtttatgattactatgcatcgggtgccgaggatcagtggactcttaaggagaatcgcaatgccttttcgaggatcttgtttcgacctcgcattctaatcgatgttagcaagatcaacatgatgaccaccattttggggttcaggatttcgatgccaatcatggttgctccgactgctatgcagaaaatggctcaccctgaaggagaatgtgcaacagctagagcagcttcagatgctggaacaatcatgacactatcgtcatatgcaaattctagtgtggaagaggtcgcttctaccggatctggcattcggtttttccaactctatgtacacaaagacaggaacctggttgctcagcttgtgagaagagctgaaagggctggtttcaaggcgattgccctaacggcagatactccaagactcggccgcagggaagctgatattaaaaatagatttactttgccaccatatttgacattgaaaaactttgagggtttggaccttggcaaaatcgataagactgatgactccggactagcttcatatgntgccaaccaaattgatcagtcactcagctggaaagatgtgaagtggcttcaaacgatcacatcattgccgattctagttaagggtgttcttaccgctgaggatacaaagctagctatagaagctggagctgcagggatcattgtatccaatcatggagctcgccagcttgattatgtaccagcaactattatggctttggaagaggttgttaaagcagcacaaggtaaagttccggttttcctcgatggaggagttcgncgaggaaccgatgtctttaaggcattggcactcggagcatcgggaatattcattggaaggccagtggtatttgcattggctgtggatggcgaagctggtgttcggaaagtgcttcaaatgttacatgacgaattagagctgacgatggcattaagtggttgtcgatcgctgaaggagattactcgaaaccacgttgtcgctgattgggaccntcctcgggttttgcctaggttataagttgagagctnttataattttgcncatgatcacaaanggagtnttattgatgcattaaatggttaaaatcccttgaattgttttaagttttgaaggttttgaatgatttagtgtatgtaattgacaatttgagtgtttttattttttcagtagtagaaagtaggattagattttg

SEQ ID NO: 1324 - DNA, 1635 bp, Gossypium hirsutum
ggcacgagcccaataccccaaaataggatttggtctcaatttctcacctccaaatgctcatccacttaaacttgtgatttccatataatataatataaatatatattcttacatgttttaatatgtatccctttttttttaaatataaaaccttttttttaaaatatttttcattgccaatcagtcccttattaataagtagagtatttccacaactggtttaattcccttcatgcactgtgctccatagtcttggaacccaaggacagaagactcttttaacatttcaccgcaaagatggagataacaaatgtgagcgagtatcaagaaattgcgaagcaaaagttgccaaagatggtgtatgactactacgcatctggtgctgaggaccaatggacattgcaagagaatagatttgctttcactaagatactgtttcgtcctcgtattctcatcgatgtaagcaagatagacatgaccacaactgtgttgggtttcaagatatcaatgcctatcatgattgccccaactgccatgcaaaaaatggctcatcctgaaggggagtatgcaacagctagggctgcatctgccgctggaactataatgacattatcctcatgggcaacttctagtgttgaggaggttgcttcgacaggacccggcattcggtttttccaactctatgtatacaaggacaggaatgtagttgcacagctcgttagaagagccgagagggctggtttcaaggcgattgcccttacagttgatactccgagactcggtcgcagagaagctgatatcaagaacaggttcactttaccaccatttttgacattgaagaactttgaaggtttggaccttggcaagatggatcaagctgatgactcgggtcttgcttcgtatgttgccggacaaatcgatcgttcccttagctggaaggatgtgaaatggcttcaaacaatcaccaaattgccaattcttgtgaagggtgtactcacggctgaagatacaaggatagcgatacaggctggagcagccggtatcatcgtctccaaccacggagctcgccaacttgattacgttcctgccactatcatggccctggaagaggttgtcaaagctgctcaaggtcgggttcctgtcttcttggacggtggtgttcggcgtggaaccgatgtttttaaagctttggcattgggagcctctggtatatttattgggcgaccagtggtgttctcattggctgctgaaggagaagctggcgtgaggaaagtgctttcgatgctgcgcgacgagttcgagctaaccatggcgttgagcggttgtcgttcgcttaaagaaatcactcgtgaccacatcgtgacagaatgggacagtcctcatccgcgtccggccccgagactgtagagtcctatatattatgggcgtgcaactttagcctagcaaatcgcaagatgaacttagttggagctcaagagatatatatagcatttgcattgcatttatggcataaaattactgtctttttttttctttgggaacaagtttctgtttcattgagttaaaaggttatgtaatgataatgttggctactgttgccttttctgtatattcttttcttaaaaacaaattggt

SEQ ID NO: 1325 - DNA, 1610 bp, Vigna unguiculata
aatttccttcatttgaacctatacacgttacaacaaatatgagggccatctaactttgtctctattccacaacgtatttatcaacccttcccatttttcacttccttctgtttctattcctcaataggagtttatctccattgcttcctctgcatgcacacagttgcaagttttcgatactaagaatttgtgaagggtaacatcaagaagcagttctgaaaatgggggagatcaccaatgtcagtgagtatgaggctattgcaaagcagaaattaccaaagatggtgtttgactactacgcatctggtgcagaggaccagtggactctgcaagagaacagaaatgccttttccagaattttgtttcggcctcgtattcttattgatgtgagcaagatagacatgacaaccactgtcttgggcttcaaaatatccatgccaatcatgattgccccaacagccatgcagaaaatggctcatccagagggagaatatgccacagcaagagctgcctctgcagctggaacaatcatgactttgtcttcgtgggccacttcaagtgttgaagaggtggcttcaacaggacctggcattcgctttttccagctatatgtgtacaaggacaggaatgtggttgctcagcttgtgagaagagctgaaagggctggattcaaagccattgcccttacagttgataccccaagactaggacgcagagaagctgatatcaagaacagattcacactgccaccgtttttgaccttgaagaactttgaaggattggaccttggaaagatggacaaagctgatgattctggacttgcttcatatgttgctggtcaaattgatcgcactctaagctggcaggatgtgaagtggcttcaaacaatcaccactctgccaattctggtgaagggtgtgctgactgcagaggacactaggatagctgtacaaagtggtgcagcaggaattatagtgtccaatcatggagccagacaacttgactatgttccagccaccatatcagcattagaagaggttgtcaaagctgctgaaggtcgtcttcctgtttttttggatggtggagttcgccgtggaactgatgtcttcaaggcattggcactaggtgcctctggcatatttattggacgccctgtggtgttctccttggctgctgaaggagaggctggtgtaagaaaagtgttgcagatgctacgtgaagagtttgagctaaccatggcattgagcggttgtcgttcactaaaggaaatcactcgtgatcacattgtgaccgattgggaccagcctcgcgttcagcctcgcgtccgtgcgttgttgtgaaaaacttgctcttcatttgagccaagtttgcataatgcggtgcagaacaaaggggaaacacttctatatatgtttcatgaacctgttctcatcctttcttttccttttcctttttggagaactcatttaaggttttgtttccaaaactctatgctctctttgtaagcattatatcatgatactttgtggctactgctactgctgctgctgctgctgcattcactcattgtatattcttcatttcaataatttatcaactttctctccaac

SEQ ID NO: 1326 - DNA, 1727 bp, Zea mays
gaaacattttttttcttctgaatccctggtctgcttgttcattcctcattcctctacacgcatattcctacatgccatgcccacacgcaaatatgtcagatgctcagcgctcgacttagccctcgatcacgggcgcacaacaacacagcgacgctatctgaccgagtgttcaaataaatacccacacgggcacgccacgagacgatgagacccctctgctccaatccgccgctccactccaagtcacacggaggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacattctgggcttcagcatttccatgcctatcatgatcgctccttcagccatgcagaaaatggctcatcctgatggagagcttgccacggcaagagctgcagcttccgcaggaacaataatgacattgtcctcatggtctacttccagcgttgaagaggtcaactcagttgggccgggcatacgtttcttccagctctatgtctacaaggacaggaatatcgtacggcaactcgtgaaaagggctgagatggctggcttcaaggccattgcactcacggtagacactccaatacttggccgcagggaagctgacattaagaacaggttcgccttacctccacatctggtgttgaaaaacttccaagcgctggatcttggcacgatggacaagacaaatgattccggccttgcttcctacgttgctggtcaagttgaccgcaccctttcctggaaggacgtcaagtggctgcagacaattacctcgttgccgatcctagtgaaagggatcgtgactgcagaagacactaggcttgcgatcgaatatggcgctgctgggatcatcgtgtccaaccacggcgcgcgccagctagattatgttcctgcgactatcagctgcctggaagaggtcgccagggaagcgaaaggccggctaccggtgttcctcgacggcggcgtccgccgtggcacggacgtcttcaaggccctggcgttgggagcttcaggagtgttcatcggccggcccgtgctgttctcgctggcggtggacggcgaggccggcgtgcggaaggtgctgcagatgctgagggacgagctggagctcaccatggcgctcagcggctgcacgtcgctgagggagataacccgcgcacacgtcatcaccgacagcgaccggatcggccgctcgcggctgtagaatcattgtgcagttcacctcaggaatgatgttggtctcgactgaactgtcctgattcgggatctatttgtagctcttgtgctctcattttacgttaggcaaataaggaagctgcgtgcgtatgtgtgactgctgctgacgtttgtttgcgccgctgtcgtggttgcctggttggcacttggcagtgttgattggcgttagtggttggtttgggtgaaaggagtttatgagatctggtgccggtttctaagatactagcccatcaacgtttgttcgtgtgttgcccgtgctaatgcttcgggaaaatataaaataaaataata

SEQ ID NO: 1327 - DNA, 1377 bp, Elaeis guineensis
  misc_feature (380)..(380): n is a, c, g, or t
  misc_feature (575)..(575): n is a, c, g, or t
  misc_feature (608)..(608): n is a, c, g, or t
  misc_feature (610)..(610): n is a, c, g, or t
  misc_feature (644)..(644): n is a, c, g, or t
  misc_feature (649)..(649): n is a, c, g, or t
cgaacaaatcaccagctcttatctccagcccatataatactttaatccacaccacatcatctattctggtttcactccattcgctctcttctaaggaactaaggttctttagtcttccttagctcttcttctttcctcgcttgatgattgcgttctctacttagctagttgggtttaattttttgatcttgtttttgttaaaagggggtgtgtgataagcagccataagcatggagatcaccaacgttatggagtatcagccaatcgctaagcagaagctgcctaagatggtctatgactattatgcctctggtgcagaggatgagtggactttgaaggagaacagggaggcattctcgaggattctgtttcgtccgcgnatacttatcgatgtgtccagaattgatatgactacaactgtgcttggtttcaagatatcaatgccaattatgattgctcccactgccatgcagaaaatggcccacccggaaggagaatatgcaactgcaagggcagcatcagcagctggcaccataatgacactatcatcatgggctacttctagtgtcgaggangttgcttccacaggaccaggaattagattcttncngctctatgtctacaaagataggaatgtagttgcncagcntgtaagaagggctgaaagggctggattcaaggcaatagctctcactgtggatactccaagacttgggcgtagggaagcagacatcaagaacagatttaccttgcctccatttttaactctgaagaactttgagggtttggaccttggcaagatggacaagaccagtgactctgggttggcatcttatgttgctggccaaattgatcgatcactaagttggaaggatgttaagtggttgcaaacaattactactatgccaattttagtgaaaggagttctcactgcagaagatacaaggttggccatacaaaatggtgcagctggtatcattgtgtccaaccatggagctcgccagcttgactatgtcccagctaccatcactgctctggaggaggttgtcaaagctgcacaaggccgaattcctgtctttctagatggtggtgttcgtcgtggaacagatgtgttcaaggctttagctttgggagcctctggtgtatttattggaaggcctgtggtattttctttggctgctgaaggtgaggctggtgtcaggaaggtgcttcagatgcttcgcgacgaattcgagctgactatggcattaagtggttgcacctcactcaaagaaatcactcgcagccacatagtgactgatgcagacaggcatcgtcctgtatccaggttatagatcacctggaggatgaccactcttgctccaaacggagagctac

SEQ ID NO: 1328 - DNA, 1575 bp, Carica papaya
aatctgattcttcttgatggactgtctccgattgtgctttctgcgtctcattttctacttctatatttcacagtcaagcagatcctgtttcaagtgttttggtggatgttgggaagaaactgttaaattctaaaacatacttaccaagtaattggtgttaacttttggtgtgaactttactcctttctttctttattatatccagaacactttggagtatcatataggattaatcccttagaaaggatggaggagataacaaatgttatggagtatgaagtcattgcaaagcagaaactgcctaagatggtttatgactattacgcatctggtgcagaggaccaatggactctaaatgagaacagaaatgcattttctaggattttgtttcggccccgtatacttattgatgtaagtaacattgacataagcacggtggttttgggcttcaaaatttcaatgcctatcatgattgctcccacagcaatgcagaaaatggcacaccctgatggggaatttgcaactgcaagagcagcttcagcagctggaacaatcatgaccctatcatcatggggtacttccagtgttgaggaggttgcttccacaggacctggcattcgcttcttccaactctacgtgctcaaagatcggaatgtggttattcagctcgtacggcgagctgagaaggctggattcaaagcaattgtccttactgtggataccccacggcttggccgtagggaagccgatatcaagaatagatttgttttgcccccacatttgattctgaagaactttgagggcttggatcttgggaagattgataggaccaatgactctggactagcttcatatgttgctagccaagttgaccgatcacttagctggaaggatctgaaatggcttcaaacaattactcatttaccaattcttgttaagggggtgcttactgctgaagatgcaaggctagctgtagaagctggagctgcaggaatcattgtgtcaaatcatggagctcgtcagcttgattatgtccctgcaactattatggctttggaagaggttgttaaagctgcacaaggacgcattcctgtttttcttgatggcggggttcgccgtggaacagatgtattcaaggcattagctctgggtgcatcaggagtttttattggaaggccagtagttttctcattggcagctgctggtgaggctggtgttcgaaaagttcttcaaatgctccatgatgagtttgagctaaccatgacactcagcggttgtcgctcactcaaagagataactcgcaatcacatcttgacagattgggaccgtcctcgcactgcatccaggttataaagagaatcttcgccttttgttgctctcatgattttatggaagtcccctgtgcaagtagaataaactggcctcagattcagcaggctgacagagggtaagacatcaataagctcctgtaatggctatagaatgattttagcaaagccaagatcttggactgaggttgtaggatatgtctttctcagaattacttctgcaatagaaagaaatattatatttttt

SEQ ID NO: 1329 - DNA, 1344 bp, Raphanus sativus
  misc_feature (1224)..(1224): n is a, c, g, or t
  misc_feature (1284)..(1284): n is a, c, g, or t
tttttattctccttatagttttcttcgccacctactcaagaacaccaaccaagccgccctctctcgctctagaaattttataaaaagatggagataacgaacgtgatggaatacgagaagatagcaaaggagaaactaccaaagatggtttatgattactatgcatctggtgcagaggatcagtggactcttcaggaaaatcgtaacgccttctccaggattctgtttaggcctcggattctgatcgatgtaagcaagattgatgtgagcacgactgttttagggtttaacatatctatgccgatcatggttgctcctactgctatgcagaaaatggctcaccctgatggtgagcttgcaactgctagagctacttcagctgctggaacgatcatgactttgtcttcatgggcgacgtctagtgttgaggaagttgcttccacaggacctgggattcgctttttccaactctatgtctataaggatagaaacgtggttaggcagcttgtgaaacgagctgaagaagctggtttcaaagcgattgctcttactgttgatacccctaggcttggacgcagagaatccgacatcaaaaacagattcgcgcttcctagaggtctgaccttgaagaacttcgaagggttggatcttgggaaaatagacaaaaccgatgactcagggctagcttcatatgttgcgggtcaagttgatcaatcacttagctggaaggatataaagtggttacaatctatcacaagcttgccaattcttgtcaagggtgttattacagctgaggatgcaagaatcgcggttgagtatggagctgcaggaattatagtttctaaccatggagctcgtcagcttgattatgtccctgcaactataatggctcttgaagaggtggttaaagcggtggagggtcggttaccggtgtttcttgacggtggagttcgccgtggaactgatgtctttaaagcattggctcttggagcttcaggtgtctttgttgggaggcctagcttgttctcgcttgcagcgaatggagaggcgggagtgaggaagatgctgcagatgcttagagacgagttcgagctgacaatggcactaagtggctgccgctccctgagagagatcagtcggaaccacatcaagaccgattgggactttcctcattacctcccggccaagctataaggggatatcttattcacttcttttctatantcatcaaacaaaatgaaacgagatatgaatgtttgaattacgattcaataatgtactctnccccatccaacttttacagtaggaaaatttccatttgaataaaacaaaaattgcgtacga

SEQ ID NO: 1330 - DNA, 1539 bp, Oryza sativa
gctccgctccaagacactcgcacgcagacatcacatccattccaggctcgatcgcttcgatccctttgcctgagaccgaagaaatggagctaatcacaaacgtctccgagtatgagcagcttgcaaagcagaagctgccgaagatgatctacgactactacgcctctggtgcagaagatcaatggactctcaaggagaacagggaggccttctcaagaattctgtttcgaccgcgaatactgattgatgtatcccgtatcaacatggctacaaatgtcttgggcttcaacatttccatgcccataatgattgctccctcagccatgcagaaaatggcccaccccgaaggagagcttgctactgcaagagcagcttctgctgcaggaacaataatgacattgtcttcatggtccacttctagtgttgaagaggttaattcagcagcgccggggatacgtttcttccaactctatgtttacaaggataggaatatagtacggcaacttgtcagaagggctgaattggctggttttaaggcgattgcactcactgtcgacactccaaggcttggtcgcagggaagctgacatcaagaacagattcaacttacctccacatctggtattgaagaattttgaagcgctggatctcggcaagatggacaagacaaatgattctggccttgcttcctatgttgctagccaagttgaccgctctctgtcttggacggacgtgaagtggctacagacaatcacctcgttgccgatcttagtgaaaggagtcatgactgcagaagatactaggcttgctgtcgaaagtggcgcggccggtatcatcgtgtccaaccatggagctcgccagctagattatgttcctgcaactatcagctgcctggaagaggtcgtcagggaggcaaaggggcggctgccggtgttcctcgacggcggcgtccgccgtggcacggacgtgttcaaggccctggcgctgggagcttcaggagtatttattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgtagcagggaatttgtcactgttgctgtcgttggcagggaatttggtgattcagagtagtttgtgttggaaaaaggaaaatctgtccaattctgtctcgacactgactgtgatgctttgcatcgtcatttgtcgtggacgaaacgaagcttttgcctct

SEQ ID NO: 1331 - DNA, 1456 bp, Sorghum bicolor
ctgctccaatccaccactccactccaagtcacacgggcagccgtctcagcctcgcccgactccgctccccctgtgcgttcgagacatggagctgatcacaaatgtcaccgagtatgagaagctcgccaaggagaagctgcccaagatggtgtacgactactatgcctccggcgcagaagatcagtggacgctcaaggagaacagggaggccttctccagaattctgtttcgaccacgggtactgattgacgtctcccgtatcgacatggccacaaacgtcctgggcttcaacatttccatgcctatcatgatcgctccttcagccatgcagaaaatggctcatcctgatggagagcttgctacggcaagagcagcagcctctgcaggaacaataatgacactgtcctcatggtctacttccagcgttgacgaggtcaactcagttgggccagggatacgtttcttccagctctatgtctacaaggacaggaatatagtacggcaactcgtgaaaagggctgaaatggctggctttaaggctattgcactcactgtagatactccaatacttggccgcagggaagctgatataaaaaacagattcaccttacctccacatctgacgttgaaaaactttgaagcgctggatctcggcacgatggacaagacaaacgactctggacttgcttcctatgttgctggtcaagttgatcgcactctttcctggaaggacatcaagtggctgcagacaattacctcactgccaatcctagtgaaaggagtcgtgacagcagaagacactagacttgcaattgaatatggcgctgctgggatcattgtgtccaaccacggcgcacgccagctagattatgttcctgcaactatcagctgcctggaagaggtcgtcagggaagcgaaaggccggctgccggtgttcctcgacggcggcgttcgccgtggcacggacgtgtttaaggcccttgcgttgggagcttcaggagtattcatcggccggccggtgttgttctcgctggcagtggacggcgaggccggcgtgcggaaggtgctgcagatgctgagggacgagctggagctcaccatggcgctcagcggctgcacgtcgctgagggagatcacccgcgcccacgtcatcaccgacagcgacaggatcggccgctcgcggctgtagctgtagaatgcacagttcagctcggcatgttggtctcgactgaactatccactgtcctgattcaagataccgctatttgtagctgttgtgctctcattttacgttaggcaaataaggaagctgcatatgtgtcaatgtgtgtgtgcctgttgatgacgtttgtttgcacaattgcaccgcagtcgtagttgccagtgttgatcacttgattggcgttgctggttggtttgggttctcgacacatggaaaggagtttatgagattttg

SEQ ID NO: 1332 - DNA, 1441 bp, Glycine max
ctcgccaccttttcttgttccattttgcttcatcgtattccacccacctcggaggcctaagccaaagcagatcctgcggacattgtaagtaaatcttatgaagatggagatgataactaatgttaccgagtatgaggcaattgcaaaggaaaaattgccaaagatggtttatgactactatgcatcaggggcagaggatcagtggactttgaaggagaaccgaaatgcattctcaaggattctgttccggccgcgtattcttgttgatgtgagcaagatagacttgactgcaactgtattgggcttcaaaatatcaatgcctatcatgattgctccaacagccatgcaaaagatggctcaccctgaaggagaattagctactgctagagcagcatcagcagctggcacaatcatgacactatcctcatgggctacttccagtgttgaggaggttgcttcaacaggtcctgacattcgtttttttcaactttatgtgtttaaagacagaaatgtggttgctcagcttgtgagaagagctgaaagagctggtttcaaggcaattgcccttactgtcgacactccaattcttggtcgtagggaggctgacatcaaaaacagatttacattgccaccaaacctggttttgaagaattttgaaggattggatcttggaaagctggacaagactagtgactccggtcttgcctcttatgttgctggacaaattgatcggtcactcaactggaaggatatcaaatggcttcaatcaatcacttcattgccaattttagttaagggtgtccttactgctgaagatacaaggttagccatacaagctggagctgctggaatcattgtttccaatcacggagctcgtcaacttgactatgtccctgcaactattatggctttggaagaggtagttaaagctgcacaaggaaaaattccagtttttctggatggtggaattcgccgagggacagatgtttttaaagcactagctcttggagcagctggtgtattcattggtaggcctgtggtgttctcattggctgctgatggtgagactggtgtgagaaaagtacttcaaatgcttcgtgatgaatttgaactaacaatggcactaagtggttgccgttcgctcaaggagataactcgtgaccatgttgtcacagagtgggatcacccaagattttctcccaagttataagatggcaggactccaccttgttcttctatattctaaaatagaaattttagaataacctttgttcttatttcatgcttctgtggaaaactttgttgttaccgtgagtcaggcattagtcatccattagtaattgctacttcattttgttgcatttggtgctaggatttggtactctagaaacatgattgccaataaaatgtactttttttcttagcaaaagattaagtttta

SEQ ID NO: 1333 - DNA, 1215 bp, Saccharum officinarum
  misc_feature (970)..(970): n is a, c, g, or t
  misc_feature (994)..(994): n is a, c, g, or t
  misc_feature (1035)..(1035): n is a, c, g, or t
  misc_feature (1052)..(1052): n is a, c, g, or t
  misc_feature (1064)..(1064): n is a, c, g, or t
  misc_feature (1098)..(1098): n is a, c, g, or t
  misc_feature (1100)..(1100): n is a, c, g, or t
gggcgtacgtcagagcctcggtcgcttccgcttccgcttcccttgcgcgctcaagacatggagctgatcacaaatgtcaccgagtatgagaagctcgccaaggagaagctgccgaagatggtgtacgactactatgcctccggcgcagaagatcagtggacgctcaaggagaacagggaggccttctccagaattctgtttcgaccacggatactgattgacgtctcccatatcgacatggccacaaacgttctgggcttcaacatttccatgcctatcatgattgctccttcagccatgcagaaaatggctcatcctgatggagagcttgctacggcaagagcagcagcctctgcaggaacaataatgacattgtcctcatggtctacttccagcgttgaagaggtcaactcagttgggccagggatacgtttcttccagctctatgtctacaaggacaggaatatagtacggcaactcgtgaaaagggccgaattggctggctttaaggctattgcactcactgtagatactccaatacttggccgcagggaagctgatataaaaaacagattcaccttacctccacatctgacgttgaaaaactttgaagcgctggatcttggcacgatggacaagacaaacgactctggccttgcttcctatgttgctggtcaagttgatcgcactctttcctggaaggacatcaagtggctgcagacaattacctcgttgccgatcttagtgaaaggggtcgtgaccgcagaagacactagacttgcaattgaatatggcgctgctgggatcattgtgtccaatcacggcgcacgccagctagattatgttcctgcaactatcagctgcctggaagaggtcgtcagggaagcgaaaggccggctgccggtgttcctcgatggcggcgtccgccgtggcacggacgtgttcaaggccctggcgttgggagcttcangagtgttcatcggccggccggtgntgttctcgctggcagtggacggcgaggccggcgtgcggaangtgctgcagatgctganggacgagctggngctcaccatggcgctcagcggctgcacgtcgctnanggagatcacccgcgcccacgtcatcaccgacagcgacaggatccggcgctcccggctgtagaagtacaattcagctcagcatgttgtgctcgactgaactgggctaattcttaat

SEQ ID NO: 1334 - DNA, 1381 bp, Helianthus annuus
  misc_feature (17)..(17): n is a, c, g, or t
  misc_feature (1317)..(1317): n is a, c, g, or t
  misc_feature (1322)..(1322): n is a, c, g, or t
  misc_feature (1325)..(1325): n is a, c, g, or t
  misc_feature (1354)..(1354): n is a, c, g, or t
aatttttaaaaaagttnttttgcttatctatacttattacttcacttgttgcttgctctttccaccaagccccaaaaggtttgctctcttgcagaaactacgcgggtagtgaagagaaatggaggtcacaaatgtcaccgagtatcaggctattgccaaggagaagttgccaaagatggtctatgactactatgcatctggtgctgaggatcagtggactcttgaagagaaccgaaacgcgttctcaagaatcttgtttaggccgcgtatccttattgatgtcagcaagattgacatgactaccacaattttgggattcaagatctcgatgcctataatgcttgcaccaacagccatgcagaagatggctcaccctgaaggtgaatatgcaacagcaagagctgcatcttctgctggaactattatgactttgtcatcatgggctacatcaagtgttgaggaggttgcctcaacaggacccggaatccgtttcttccagctttatgtgtacaaggacaggaacgtggttgctcagcttgtgagaagagctgaacgagctggtttcaaggctattgctcttactgttgatacacctaggctcggccgccgagaagctgacatcaaaaacaggttcacattaccaccatttttgacattgaagaactttgagggcttggaccttggcaagatggatgaagctaatgattctggtttagcttcttatgttgctggtcagatcgaccgcactttgagctggaaggacgtgaagtggctgcaaacaatcaccacgatgccaatcctcgtgaagggtgtgatcactgctgaggacacaaggttagctattcaagctggagcagcaggtattattgtttccaaccacggagcccgccagctggattatgttcctgccaccatcatggcattggaagaggttgtgaaagcggcacaaggccgtgttcccgtgttcttagatggtggtgttcgccgtggaactgatgtgttcaaggcgctggctcttggagcttctggcatatttattgggcgacccgtagtgttttcattggctgctgaaggagaagccggagtgagaaaagtactgcagatgttacgcgatgaattcgagctaaccatggcactaagtggctgtacctcgctcagtgagattactcgcgaccatattgtgaccgagtgggatgcaccccgggctcgtcctgcaccaaggttataaaccaaaacatgatatcgttgcgaccaactcgacttttaatcgcaaaatataacatgtaccttgtgttatggttgccaaacttgtattgnttccntgnataatgttcgtttctgaatgataagctgnctgaatgtataatttttaaatgtccat

SEQ ID NO: 1335 - DNA, 1751 bp, Panicum virgatum
cctgctcgaatccaccactccgaggcacacgggcagccgtcgcagcctcgaccgcttcggcttcccttgcgctgaagaaatggagttgatcacaaatgtcaccgagtatgagaagctcgcaaaagagaagctgccgaagatggtgtacgactactacgcctccggtgcagaagatcagtggactcttaaggagaacagggaggctttctccagaattctgtttcgaccacgcatactgattgatgtctcccatattgacatggccacaaatatcttgggtttcaacatttctatgcctatcatgatcgctccctcagccatgcagaaaatggctcatcctgaaggagagcttgctacggcaagagcagcagcctctgcaggaacaataatgacattgtcctcatggtctacttctagcgttgaagaggttaactcagttgggccaggaatacgtttcttccagctttatgtctacaaggacaggaatatagtgcggcaactcgtgaaaagggctgaaatggctggctttaaggctattgcactcactgttgacactccaaggcttggccgcagagaagctgatattaaaaatagattcaccttacctccacatctggtgttgaaaaactttgaagacctggatcttggcacgatggacaagacaaatgattctggccttgcttcttatgttgccggtcaagtggaccgcactctttcctggaaggacgtcaagtggctgcagacaattacctcgttgccgatcctagtcaaaggagtcgtgactgcagaagatactagacttgcaatcgaatatggcgctgctgggatcatcgtgtccaatcacggcgcacgtcagctagattatgttcctgcgactatcagctgcctggaagaggtcgtcagggaggcaaagggccggctgccggtgttccttgacggcggcgtccgccgtggcacggacgtgttcaaggccctggcgctgggagcttcaggagtgttcatcgggcggccggtgctgttctcgctggcggtggacggcgaggccggcgtgcggaaggtgctgcagatgctgagggacgagctggagctcaccatggcgctcagcggctgcacgtcgctgagggagatcacccgcgcccacgtcatcaccgacggcgaccggatcggccgctcgcggctgtagagcgtgcgcggcagttcagctcagccctgatgctatgatcgatggttgaactgttccctaaagatgtgtgtacgttaattagccgattcgagatactgcaagcttgtagctattgtgcttccatgtgatgtcaggcgaataaggaggctgtctggctgtgtgcgtgcgcgcgcgcctgttcgtgacgttttgcagcggtgctggcagtgttgataggtgattgattctgggcttctgccaatggaaaaggagttcataaagtttgggccttgttaggtttcacggttttgatttttaccgtctcgttggcagtaggctcgtagcccagcggttgcgccggccacactcgttcgacgcccagcatcgacaccttttggtgtctcgccggggcttggccccaaatattcaagctcaagcgtcaagcacttgtggatatgaccgtcattttaaatctcaggaggcgtctatatatgttgtagtttctatttagatagggagtgtgtgtggtgttacatatacactacaacttgtaccctaggttgagatattaaaaaaaattctacagtat

SEQ ID NO: 1336 - DNA, 1459 bp, Triticum aestivum
  misc_feature (106)..(106): n is a, c, g, or t
  misc_feature (408)..(408): n is a, c, g, or t
tcccctgttccgcttccgctccagcctccaggacacggacgagccgccgtcgccgcagccctcctcgtgcgcgcagcctgcctccgtccatcgctcctcccccttngcgacatgggcatggagatgatcacgaatgtgtccgagtacgagaggctcgccaaggagaagctgcccaagatggtgtacgactactacgcctccggcgcagaggatcagtggacgctcaacgagaacagggaggccttctccaggatcctgttccgaccacgcgtactgattgatgtgacccatatcaacatggccacaaacatcttgggcttcgacgtctccatgccgatcatgatcgctcccacggccatgcagaaaatggctcaccctgaaggagagcttgctactgcaagagcagcngcatctgcagggaccataatgacattgtcttcatgggctacttctagtgtggaaagggttaactcagtaggacccgggatacgtttcttccagctttatgtttacaaggacaggaatatagttcggcaactcgtgaaaagggctgaaatggccgggttcaaggcgatcgccctcaccgtcgacactccgaggctcggccgcagggaagctgatatcaagaacaggttcaacttgcctccacatctggtgctggagaactttgcggcgctggacctcggcaagatggacaagacagatgattctgggttggcttcctatgttgctagccaggtcgaccaatctctttgttgggaggacgtcaggtggctgcagacaattacctcgttaccgatcttggtgaaaggggtcatgactgcagaagacactaggattgccatcgaatacggcgcggccggcatcatcgtgtccaaccatggcgctcggcagctggactacgtccctgcaaccatcagctgcctggaagaggtggtcagagaggcgaaggggcggctgccggtgttcctcgacggcggcgtccggcgcggcaccgacgtgttcaaggcgctggcactgggagccgcgggagtatttatcgggaggccggtgctgtactcgctggcggtggacggcgaggcgggggtgcggaaggtgctgcagatgctgcgggacgagctggagctggccatggcgctcagcgggtgcccgtcgctccgggacatcacccgcgcccacgtcgtcacagacggcgacaggatccgccgcgcacgcctctagatggggaggcgcgccgcatccgccctcagcagtacgtgcttgtgcgcgcgggcgcgcgctggtcgatttgagatgccgctcgttcttgtgcctccgtttgatcgatcgatgtatcgggcaataaattcgtagaaataaagtgtggagaagggcgcatgcgttgtcgtcgtgtagtctgcccgcgaaatgctgtttatcacgttctgattttggcgactacgccctctctgtcgggttt

SEQ ID NO: 1337 - DNA, 1308 bp, Triticum aestivum
  misc_feature (724)..(724): n is a, c, g, or t
  misc_feature (772)..(772): n is a, c, g, or t
caggatactgttccgaccacgcgtactgattgatgtgacccatatcaacatggcgacaaacatcttgggcttcgacgtctccatgccgatcatgatcgctcccacagccatgcagaaaatggctcatcctgaaggagagcttgctactgcaagagcagcggcatctgcagggaccataatgacattgtcttcatgggctacttctagtgtggaaagggttaactcagtagggcccgggatacgtttcttccagctttatgtttacaaggacaggaatatagttcggcaactcgtgaaaagggctgaaatggccgggttcaaggcgatcgctctcaccgtcgacactccaaggctcggccgcagggaagccgatatcaagaacaggttcatcttgcctccacacctggtgctggagaactttgcggcgctggacctcggcaagatggacaagacagatgattccgggctggcttcctacgttgctagccaggtcgaccaatctctttgttgggaggacgtcaagtggttgcagacaattacctcgttgccgatcttggtgaaaggggtcatgactgcagaagacactaggattgccatcgagtacggcgcggccggcatcatcgtgtccaaccatggcgctcggcagctggactacgtccctgcaaccatcagctgcctggaagaggtggtcagagaggcgaaggggcggctgccggtgttcctngacggcggcgtccggcgcggcaccgacgtgttcaaggcgctggcgctnggagccgcgggagtgttcatcgggaggccggtgctgtactcgctggcggtggacggcgaggcgggggtgcggaaggtgctgcagatgctgcgggacgagctggagctggccatggcgctcagcgggtgcccgtcgctccgggacatcacccgcgcccacgtcgtcaccgacggcgacaggatccgccgcgcacgcctctagattgggaggcgcgctgcatccggcctactagtagtacgtctacttgtgcgcgcgcgctggtcgatttgagatgccgctcgttcttgcgcctccatttgatcgatcgatgtatcgggcaataaattcgtagaaataaagattggagaaggctgcatgcgttctcgtgtagtctgccggcgaaatgctgtcgatcacgttctgattttggcgactactcgctgtctgtcgtgtttttttttcaccaactagtaaatatgcacgtgcaatgcacgtctatttcgacttataagtagtagagatgaagtcataaggatcatgattcaagatattcggag

SEQ ID NO: 1338 - DNA, 7920 bp, Oryza sativa
tggctggattgatttgcttgatttgattttttttccatgaatcatgctctacttgctacttgttggtggcatcatcatattttactcattcatcccagttgctttctcatcgatcttgtacagaggactcaaaaaattttttgcaattaatttttgtgctaagtttggtctataactgagaccgaaccgaactagccgaagaccgaaatgctcggtcttgagttttcttgaagaccgatcggtcttgtgattctaaagaccaaatttttcaaacaccaaataaccgaaccgaatttttcggttagactgaatgaccacccataccaccatacgccagaggcatgatgtcatccgcgcccaattcgaggccaagggctacgtcgacgtcctggcgaggcctccgacgactctgacactgaccaggagatgcatccgctgtaattactatagacgctgacaaactccactttacttgagcaagtttaatagtatagccaactattagctctaaatcatatatagccaatttatacaatagttgcttactatattattaatacctgaccctgtctatcatacacacattatgttttagagttcgtgctgtagctggctatagatctgtagcccgttgcttttttctctttttctttatctttttaaaatatgtttatagctggcttatagtctgttattgtacctgttcaaattcactagtatattactatagacgctcttgacgatgctggttacataatgtctcgttgatctgcatgtacatttgactggattactgaattcaacttgttaagtggaattaaaaaagttacgaggcctggtttaggtagcaattgaaaggtgacgagataaagcagcggcatactattatatgtgctttcatgatgctcttctcttcttttcttcctttctttcttttttccccatccatgacaaagtgcggccatctcaaatcctggaataaaacatatcctggaaatcatggaaacaaggcttttaagttgttgtgttgggccctgcagggcaacaagaaccatatggatatgttggtcgactagttgattttgtacccaggaaggctcttgaagctgcaaatttctgcttttgaaaccctgcagaaagatgatgatcagacactgtttgcaaagccgcaatataggaaccttaatttaacaccttttgcactgtggccgctcgggaggctaaagagtgaggtcctagctgcctaaactaggaacattccatatctgcataattgaagcttggtgattttccttcctagccaaaagtgattccctctcagcctgtcgagttcgtgggcatcgcatcgcatcgatctccctctggatctgggacgtgtttgtttcgactgcctccagatcacatctcttgtttgttcgtacagagaatatattttgcctgattcttacaccaactaggcactagtttccctttggtagtttaagctgaatgtttttgcaaatttgacgctgctcaagtgtgaaagaggcccctggttgctgtaagcaggtcaatttttaactgctatatatcgccatgaaagaggcgaggtagtgcagcaataggtagctatcaaattacgactaaatcaataaagtagattagcacatgattaattaaaaatcagctgcttgtttgcttcagactgaaaaatagattttttttaaatatatatatatatagttttcattaaaaaaccacagtctaatgatttggaaagcttgtaaatgaaaaatgagaaagtaactttttctataagctgaaaaaacggtgccctgagccgatattggtttcagtcctgtaatatgcagtgcaaaacagattaattaagaatttaagatctatcactgcagtgcatttttttaaatgcaaggaatatgtcatggccatgatcaaaacaaagtctagtctctttgatctctctattggtaccaaagcgcaatgagatccagaagagcaggagtaaaggagaggttagctggtctggtctggtccaaatgagactgtcctagtagagacatgatcgcgcatttctttctttatgtgattcctgtgcgtcccaagggccaacattaattctgatcgttcattttgcacccgacaataatctagtactaccagcatagagtacttaattagttgtagcagcaaaaaaagttcactatattactacctctaatcccaaaataagttaacttagtatgaaatgtgagttaacctaatacgagattctagattcttagtaattttaagatggaaggagtacatcattcacaagttcatggaggtgctccctccggttccatattaattgacgttttagataaggttgagatcaaacttttataactttgactatcaataactttaaaaatatttagtttaaaggaactagaacaatatatatatatttgtctttcaaagcactataataaaaaaagtaaacatgtatttatttattatatatattataatagaaaaataaggtcaaaaatatattttgtagaccgtgtcgttgtccaaaatgtcaattaaaatgaaactagagggagtagtctttagtgaagagcagagagagcacatatagggccatgtttagttcacccccaactaccccaaacttccaactttccatcacatcacatcacatcaaaaactttcctacacacataaactttcaacttttttttttcaaactcccaacttttcccaaacttccaacttttttttcaaactcccaactctccccaaacttctaacttttttcaggaactaaacacaccctagattgtttttgaggttggagttgtattttgtttgaattaacatgctgattatatacatttgcgatcgtgtgagtaatccaacacagtccaagccaacccagccagagggagtattgaagtattttatacatgtgaacacgtgtgtgtagcgcagatctacggacagtatatttgttggattatctatgtactgtagcatgcaatagaaaagcgcctttgttatttaaatggtgatgaaatcatggcacgaatcacgcaaagtggtttgattgacaattggagtagtaggttaagaggaagttcagtagtatagccaactactggcttcaattcatctatagtcaatctaatagctcatttatataatagttacatactacactattaatatctcggattccacctatcattcacacactgtatcttggaatcagtgctacagctagctacaaatttgtagcctgctgccattctctctccttatttatcttcttaaaatatgtttgcagctgacttatagcctgctattatatctgctctaatgccaacaggtagctgctaccgaccgactgactgagagctgactcaaattaaccttgaaccaagcaaagtaaatcaaccaggggttaatttagtttagtttattactatagattgctgacgaatctatctggaatagtacaaagtttttggatgtgcgtgcgcaagcccatatttgtttggtcgatgatgagaagaagaaagcatgtgcacatgaggatcagcatgttgatgctgtgggcgtgcaacgcatggcagcgagtaaaatgaccgagattgaaattgcagtgaaatatactaggatttattggtttcaccaggagtagtagtagtagtaggaaaaccgataaatccttccttgggttgatggatgggcgacgagctggcacatggagggaggagggcctacgttcgtacggtggggactagtcctttgggcgcctgcagtttcacgagacgagtcccggggctcccgactccattttcccagctgatggtcgaactgttaaagcaagtttaatactcccactggtacagaatataatcatttttagtgctagacacggttattaaaaaaatagatagaattaaataggggaggattattattggatgagaagtgaaggtaggtgaaaaatttgaatggtgaagggttatgattagttaaaaaaaaagaatattggtgtaaaagttattatattttgggacggagggagtagtagtttaatattataacccactactagctccaatacatctatagctaatttaatagccaattcatataatagttgcttactatattattaatatattgtcccacctgtcatacacacaattgcgtcttggaatccgcgctgcaactggctacattatctgtagcccgctgctcttttctctcatcttttatctcattaaaatatgtttatagctggctaatagtctactattgtacctactcttaatccctctatctgttagtagatactccatccatcccataaaagaccaacctaatatcacatccggtactagattggtcttttatggggacggagggagtagagttaaataacttttactccttataaccgatccaggtataatgttggttttggagtatttaagatgtgctgctgcaaatggtgaatggtgtgtattactaagggcacccacaatagttatctataggctctatacaagagattcatgtcagcatatttttctacttggaataaattaaatgaagagagagagagcaaagctatctactaacctggagatagtctatagagaaaaacgaggcaatggattagagagctatagatacccatgtagatatactattgagttggtttactattaatctagtttattgctgagatatacatattttatatggagagcaccttattttattattgcgagtgctctaatagcttgattagcttagcttaagtagacaagccactttagaggaacaatgaagatcagtgagacaacgaaggagaggggagtcaggggacacgagatttcgatttcattggagagaaagagacatacaacgtccaaagcaaagcaaaaaggagaaacaaacaaaagcaaaaaagaagaaactagagagagagagagagagagagagagagttgtggaatccaaccaaccaatatgcgccgctcctcttcactctccaagcagagcacaagaacgcgctttgctcaataacacactcccctagctccccgaggatgcctgcccctgcctagcttaatgtggaactaactaggagtattaattaattccttccactaatcacccatcagcgccaaccggcggccacggccaccgtccgctccgacgacgacgacaagttgccactgctcactgctcactgctctggaaggtggtgaagcaggtgtcgctcggcttcactatgaagggccaccaccaccaccattccttgccgccgtcgccgccgcccaagcgccggtgtaccgccctggccgcggccgtccctgcgctcgtcgtctgctccatcctcctgcccctcgtcttcctcctgggtctccaccgccccgggcatggatcggaggagcgcgccgcggttgtcatcagcactgaaatggggtttagcaagcacaagcatctggatgggaggatgaagcacaagctactcaaggggtattcactctacactgtaagccagggctttgttgctattctggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaagaacttcatacacaaagaagataccagttaaaggacttatcctggagatcaaaggatactactattgataagaaagagaaccaagaagtcgagcatgaggagaaccccaaatcctgtgaacttgaatatggtatctactgtctctggtctgttgaatataaggaagtgatgaaagattttattgtgaagaggcttaaggatcaactttttatggcaagagctcactatcctagtattgcaaagctgaagaaccaggaaacattcacacgtgaactgaaacaaaacatccaagagcatgaacgcatgctcagtgacaccattgcagatgctgatcttccaccattttttgcaaagaagctagagaaaatggagcacacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgactgtagaatatttcaaatcaacgtctattcatacggtccagtcaaacaagcagaaacttgaagaccccaccttccatcactatgtgatattctccaagaatgtgcttgcagtttcgactacaattaattcaacagttatgaactccaaggattcgggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgtttcgtaatcattctcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggtggtaaagtggtgggagctattcagttctgtgaagttaaattaggacaattgaaggcttacaccgaggaacgtaattttgacaacaattcatgtgtgtggttatctggtctgaatgttgttgaactgaaaaaatggagggatctccacattaccagtcggtatgaacaattgcttcaaaagttgcaaaaggacagtgtgacatcatttccacttaaagtacttcccataagcttacttgtctttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattataagggctactggaggaagtatatgaccaacggggaaaggtttatgacagaatgcaatatacattaataacagtaacatgagattcaccacattctacatttctgggattttggagcaacagaactttcgggaacaaagagggttagagtgagataaaatctgatgcagcattataatgaattgagtatagtaagggtggcatggtggcactacattaattccaaaatggagataggatgaaatgtttttgtgccagattttaagcaatacttcatagtagctaaagatggtagcaggccaccagcatgatacctttgaagtagatccctggttaacaatggtgtatgttgattccttcaccttttacacgatttggatggatcttcttcacatttaccactttaggattgcaaaagtgcagttccctggtggtcatttttttcgtataaattctttcatgtgtatctttgctcgttgtataagagctatactgtataacttgggtgttgactggcatggcatgtacagatgtagaatgccttaacccgaaagcattgggtgattctttctttcttcttcaaggctgagatgtaccatgtcacaccaatgtcaagtttcgagatctttgcattttgtacatcggaaggattcttgtatcatcagtttgataaaagatacatagagctaaagcagacgtcgaaacattgc

SEQ ID NO: 1339 - DNA, 872 bp, Hordeum vulgare
gcccccccctccactccactccacctagttagccacacacccaccacacagacgtaccaagcacagtacagtagagagcggagcggagccatgagcaaggagcagcagcacaggcacgagcaccatctgcggcgctgctgcggcggcctggcggcgtgcctcctgttcctggtcgtcgccgtcgcgctcaccgcgctcatcgtctacctcgcgctccgccccgccaaaccctccttctacctgcaggacctgcagctccgctccgtcagcttcggggacccgtccctgtccgccacggcgcaggtcacgctcgcctcccgcaaccccaacgaccgcgtcggcgtcctctaccggcgcctcgacgtcttcgtcacctaccgcgacgagccggtcacggtgccggtctcgctgtcgcccgcgtaccagggtcaccgggacgtcaccatctggtcccccgtgctgtccggggagtccgtgcccgtggccgggttcgtcgccgacgccatgaggcaggacatcgccgccgggtacgtggcgctgcaggtcaaggtggacggccgcgtgaggtggaaggtcggcagctgggtctccggaagctaccacctcttcgtcagctgccccgccgtgctcgccgccggccctggcggcatgccgctcgggggcggcccaaacggcacctccggccgcgccgtggcggcgctcaagttcgcgcaaccgacagggtgcaccgtcggcacgtgatggaaattacgtaccgtacattgaaggtggaagaaactacgtagctgtttaattttcgttttatgtctcatgtaacgggagaataaaatgtactacaatttttgaattaacaattgcaatttgcatcatgc

SEQ ID NO: 1340 - DNA, 940 bp, Brachypodium distachyon
tcctgtacctgcatttcatttcggaagcaccgatcactcactcactcactcactcacaagagctagagctagccacacccactgcgcacacaaccagctagctactacagctcagagccatgaaggagaagcaccacaagcacgagcaccggctccggcggtgctgcgggggcttcgcggcgtgcctgctggccctagtcctcatcgtcgccttcacggccctcgtcgtctacctcgcgctccggcccacgaagcccaccttcttcctgcaggacctgcagctccgctccatccacctgggcgacccgtccctctccgccacggcacaggtgacgctcgcctcccgcaaccccaacgaccgcgtgggcgtcttctacaggcgcctcgacgtgttcgtcacctaccgggacgagccggtgacggtgccggtctccctgccgcccatgtaccagggccaccgggacgtcaccatctggtcccccgtgctctccggggagtccgtccccgtggccggctacgtggccgacgccatgaggcaggacatcgccgcagggtacgtcgtgttgcaggtcaaggtggatggccgcgtcaagtggaaggtcgggagctgggtctccggaagctaccacctcttcgtcagctgccccgccgtgctcgccgctggccccggcggcatgtcgacgtcgctcgcgggatctgcaggcggcctcaacggctccctctccgtcgcgtcgctgaaattcacgcagcccacggggtgcaccgtcgggacatgataggatttcgcagctagccagtggttgttgttcaatttgatcgtgtctctgaactgttcagctttttttcctgtagtaaattgtggctcgagttgttgattgatttttgttaatgtcttatgtatgtactggcagaataaataaaaatgtacttttgatttcgg

SEQ ID NO: 1341 - DNA, 967 bp, Leymus cinereus x Leymus triticoides
  misc_feature (610)..(610): n is a, c, g, or t
gccattaacacccactgaagagagtagctagctagccactgcacacacacacacccccaccggtcacacagagtactgtacagagagcagagccatgagcaaggagaagcaccacagacacgagcaccacctccggcgctgctgcggcggcttcgcggcgtgcctcctggcgctggtcgtcgtcgtcgcattcatcgcgctcgtcgtctaccttgcgctccgccccaccaagccttccttctacttgcaggacctgcagctccgctccatcaacctcggggacccctccctctctgccactgcgcaggtcacactcgcctcccgcaaccccaatgaccacgtcggcatcttctacaggcgcctcgacgtcttcgtcacctaccgcgacgagcccgtcaccgtgccggtctccctgccgcccatgtaccagggccaccgggacgtcaccatttggtcccccgtgctgtccggggagtccgtgcccgtggccggatacgtcgccgaggccatgaagcaggacatcgccgccgggtacgtgtcgctgcaggtcaagatcgacggccgcgtcaaatggaaggtcgggacctgggtctccggcagctaccacctnttcgtcagctgccccgccatgctcgccgccggccctggcggcatgccgctcgggggtggccccaacggcaccgggggcgccgtcgcgtcactgaaattcacgcagccgacagggtgccccgtcgggacgtgatcgaatggaccgcgcatacggtcgcacgtacgtactgtaagtggaagaaactacgtagcgggcttgttcttctctttttttttttcgggaaactagttcttctcttcgtgtctctaaacacgttcttgtttattgtagtaaataaattgtctaaagctcttagtttttgtatgtctcgtgtaatgggagaataaactgtgttgatgtatgtacttcaattttgga

SEQ ID NO: 1342 - DNA, 871 bp, Pseudoroegneria spicata
  misc_feature (643)..(643): n is a, c, g, or t
agcggagccatgagcaaggagaagcaccacaggcacgagcaccacctccggcgctgctgcggcggcttcgcggcgtgcctcctggcgctggtcgtcattgtcgcattcatcgcgctcgtcgtctaccttgcgctccgccccaccaagccttccttctacttgcaggacctgcagctccgctccatcaacctcggggacccctccctctctgccaccgcgcaggtcacgctcgcctcccgcaaccccaatgaccgcgtcggcatcttctacaggcgcctcgacgtcttcgtcacctaccgcgacgagcccgtcaccgtgccggtctccctgccgcccatgtaccagggccaccgggacgtcaccatttggtcccccgtgctgtccggggagtccgtgcccgttgccggatacgtcgccgaggccatgaagcaggacatcgcctccgggtacgtgtcgctgctggtcaaggtcgacggccgcgtcaagtggaaggtcgggagctgggtctccggcagctaccacctcttcgtcagctgccccgccatgctcgccgccggccccggcggcatgccgctggggggtggccccaacggcaccgggggcgccgtcgcgtcactgaaattcacgcagccgacagggtgcnccgtcggcacgtgatagaatggactgtgcatacggtcgcgcatccgtaccgtgagtggaagaaactacgtagaaggctagttcttcacttagtgtctcttaataagttaagcttattgtagtaaattgtctaaagcttttaatttttgtatgtctcgtgtaacgggagaataaactgtgttgatgtatgtacttcattcaatttttagaattcatggttgcaattcca

SEQ ID NO: 1343 - DNA, 1135 bp, Oryza sativa
aattcgttcgctccactaatcttaaaagccattattactctcttactcgctttcatatctaacgcccctctctctctctctctctcactcagcaacagctcgcagctcactctctcactctactactcgtagctaagctagctcgcgccgccgccgccgccgtcgccgccgccatgagcaaggagaagcaccacaagcgggagcaccacctccggcgatgctgcggcgggatggcggcgtgcatcctggcgctggtcctcgtcgtcggcttcatcgcgctcgtcgtctacctcgcgctccgcccctccaagccgtccttctacctgcaggacctccagctccgctccgtcgacctcggcgacccctccctctccgccaccgcgcaggtcaccctcgcctcccgcaaccccaatgaccacgtcggcgtccactaccgccgcctcgacgtcttcgtcacctaccgcgacgaacccgtcacggtgcccgtctccctcccgccgacctaccagggccaccgcgacgtcaccatctggtcgcccgtgctctccggcgagtccgtccccgtggcgggcttcgtcgccgacgcgctcaggcaggacgtcgccgccgggtacgtcgcgctgcaggtgaaggtcgacggccgcgtcaagtggaaggtcggcagctgggtctccggcagctaccacctctttgtcagctgccccgccatgctcgcctccgccggaccaggcggcgtcggccccatgcctctcggcggcgcctccgccgccgtcgtgaacggcaccggcgccggcgccgtcgcgtcgctcaggttcacgcagccgacagggtgcagcgtcgaggtgtgagtcacaaatttgagtagcggctagtggcaatatggtaattaattaagttcatcggtcgcgttaatccgcaagctgttaattttttttttgtgttcatgtagctcatgcatactctatgtgagagaataaagttacgtacgttcatatgtataccattgcaacacattaatttcctatatgaagtgtactagtataatttcgttgctgtaatttttgaattattgttaataatatatattcaggtaatatttctcgagaaattaattaaccatagttgttgatgaagc

SEQ ID NO: 1344 - DNA, 821 bp, Triticum aestivum
  misc_feature (13)..(13): n is a, c, g, or t
  misc_feature (49)..(49): n is a, c, g, or t
  misc_feature (54)..(54): n is a, c, g, or t
  misc_feature (56)..(56): n is a, c, g, or t
  misc_feature (62)..(62): n is a, c, g, or t
  misc_feature (66)..(66): n is a, c, g, or t
  misc_feature (83)..(85): n is a, c, g, or t
  misc_feature (601)..(601): n is a, c, g, or t
tcacacagagcanagtacagagagcagagccatgaacaaggagaagcancacangnacgagnaccncctccggcgctgctgcnnnggcttcgcggcgtgcctcctggcgctggtcgtcgtcgtcgcattcatcgcgctcgtcgtctaccttgcgctccgccccaccaagccttccttctacttgcaggacctgcagctccactccatcaacctcggggacccctccctctctgccaccgcgcaggtcacgctcgcctcccgcaaccccaatgaccgcgtcggcatcttctacaggcgcctcgacgtcttcgtcacctaccgcgacgagcccgtcaccgtgccgatctccctgccgcccatgtaccagggccaccgggacgtcaccatttggtcgcccgtgctgtccggggagtccgtgcccgtcgccggatacgtcgccgaggccatgaagcaggacatcgcctccgggtacgtgtcgctgcaggtcaagatcgacggccgcgtcaagtggaaggtcgggacctgggtctccggcagctaccacctcttcgtcagctgccccgccatgctcgccgccggccccggcggcatgccgctcggnggtggccccaatggcaccgggggcgccgtcgcgtcactgaaattcacgcagccgacagggtgcaccgtcggcacatgatagaatggaccgctcatacggccgcacgtccgtactgtaagtggaaggaactacgtagccggctagttcttctcttcgtgtctctaaacaatttctgtttgttgttagtaataaattgtctaaagctctcttaaaaaaaaaa

SEQ ID NO: 1345 - DNA, 880 bp, Triticum aestivum
  misc_feature (66)..(66): n is a, c, g, or t
  misc_feature (414)..(414): n is a, c, g, or t
  misc_feature (603)..(603): n is a, c, g, or t
  misc_feature (625)..(625): n is a, c, g, or t
  misc_feature (638)..(638): n is a, c, g, or t
  misc_feature (654)..(654): n is a, c, g, or t
  misc_feature (693)..(693): n is a, c, g, or t
  misc_feature (696)..(696): n is a, c, g, or t
  misc_feature (709)..(709): n is a, c, g, or t
  misc_feature (713)..(713): n is a, c, g, or t
  misc_feature (719)..(719): n is a, c, g, or t
  misc_feature (732)..(732): n is a, c, g, or t
  misc_feature (735)..(735): n is a, c, g, or t
  misc_feature (744)..(744): n is a, c, g, or t
  misc_feature (758)..(758): n is a, c, g, or t
  misc_feature (803)..(803): n is a, c, g, or t
  misc_feature (807)..(807): n is a, c, g, or t
  misc_feature (818)..(818): n is a, c, g, or t
  misc_feature (826)..(827): n is a, c, g, or t
  misc_feature (829)..(829): n is a, c, g, or t
  misc_feature (836)..(836): n is a, c, g, or t
gcacgaggcactcactcactcagtgaagggagctactccactccactagctaagccacacacccanccacagatccaagcacagtacagagagcggagcggagccatgagcaaggacaggcacgagcaccacctgcggcgctgctgcggcggcctcgcggcgtgcctcctgttcctggtcgtcgccgtcgcggtcaccgcgctcgtcgtctacctcgtgctccgccccgccaagccctccttctacctgcaggacctgcagctccgctccgtcagcctcggggacccgtccctgtccgccaccgcgcaggtcacgctcgcctcccgcaaccccaacgaccgcgtcggcgtcctctaccggcgcctcgacgtcttcgtcacctaccgcgacgagcccgtgaccgtgccggtgtcnctgccgcccgcgtaccagggccaccgggacgtcaccatctggtcccccgtgctgtccggggagtccgtgcccgtggccgggttcgtcgccgacgccatgaagcaggacatcgccgccgggtacgtggcgctgcaggtcaaggtcgacggccgcgtccggtggaaggtcggcagctgggtctccggcagntaccacctcttcgtcagctgtnccgccgtgctcgncgccggccctggtggnatgccgaccgggggcgctggcctcaacggtacagccagncgngccgtcgcgtcgntcangttcangcagccgacaggntgnaccgtcggnacatgatggaaatnacgtgccatacgtgcctacgtggaagaaattacgtagcttttgantttnctgcttatgtntcatgtanngngagaatnaaatgtcctagttcaaattttggaataacttattggaatttggt

SEQ ID NO: 1346 - DNA, 3834 bp, Brachypodium distachyon
gatggcgacgccgatggccggggaggggccgatcgccacggcaattccgcgctcccctcctccgccggccgcctccgcggcggcggcggcaggcggcgcggggtcggcggccgaggcgcccgtgctgatattcgtctacttccacaaggcgatccgcgccgagctggagaggctgcacgccgcggccgtgcggctcgcgacggagcgcggcggggacgtggcggccctcgagaggcgctgccgcttcctcttctccgtctacaggcaccactgcgacgccgaggacgcggttatctttccagcactcgatattcgagtcaagaatgtagcagggacgtattcccttgaacacaaaagggaaaatgatctctttgcccacctattcgctctatttcagctcgatgtacataacaatgatggtctccgtagggaacttgcgtcctgtgctggagcgattcgaacaatcatatctcaacatatgttcaaggaagaagaacaggttttcccattacttattacaaagttttcacatgaagagcaagctggcctagtctggcaattcttatgcaacatccctataaatatgatggctgatttccttccatggctttcatcttccgtttcacctgatgagcatcaagatattattgattgcttacatgaaatagttcctcaagagaaacttctccaacagattgtatttggatggtttggaggaaaagcagtgagaacagaggaggatttcgataatccttgttcaaaaggcagttgtcgatgtgagaataactcttatcaaacagacaagcacggatgctcacatgcgcattgtaaaattggcaagagaaagtatgcagaatctagtcgtagtttgcttgccatacatccaatagatgagatattgtgttggcacaatgctatccggacagaactgcgtgatatagtagatgagacaagaaggatccagcagtttggtgacttctccaacataccagccttcaatctgaggcttcagtttatcgcagatgtgtgcatcttccacagtattgccgaggatcaagttatatttcctgcagttgatggtgaagtgtcctttgagaaggagcatgctgaacaagaacaacggtttaataaatttagatgtttaattgaacaaatccaaacagcaggagccagatcaactgtggtggatttttacaccgaattatgttcacaagctgatcagataatggaggaaatcgaggagcacttcaataatgaggaaacaaaagtacttcctcaagctaggataaagttctcaccagagaaacaaagcgaacttttatacaagagcctttgcattatgccattgaagttattggagcatgttctaccatggtttgtatcgaagctggatgatgcaaatgcacagtcatttcttcagaatatgtgctcggcagcaccttcctctgaaactgcactggtcactcttctctctggttgggcgtgcaaaggccgtttgaaggatacatccaactctggaaaattcttatgcttgacatcaggagcactgaactgctcatatgatggagatgagttaaacgaacgtcaatccttctgtccatgttcagtcagcaacaatggagctttttcaccacctcagctaacagcaaatggttcaaggccagtcaagcgaggaaatcatgcagaatctagtaccgatattaaaagaagtcactgttcacaaactactgacattgaagaggctccatgtaacaacagaccttgccacattcctgggttaagagcagaaagtactaatgttggtgctgattcattggcttctgcaaactcttttcgctctctgtgttacagttattctgcgccttcattatactcgagtcttttttcatgggagacagatgcagcattttccagtccagataatatctctaggccaattgatgcaatattcaaatttcataaggcaattcgcaaagatttagagtttttagatgttgaatctggaaaactcattgatggagacaaatcctgccttcgccaatttgtaggaagatttcgtttattgtggggactttatagagcgcacagcaatgctgaagatgaaattgtattccctgctcttgaatcgaaagaaacactacataatgtcagccactcctacaccctcgatcacaaacaggaggaggaattatttaaagatatatccactgttctgtttgatctttcacaactgcatgatgattctagtcattccattgatgaaactaatgaagctggaaaccatatttgttcacataatgaaacttatcgttccaggaagcacaatgagcttgtgacaaagcttcaaggaatgtgcaagtcaatccgagtcaccctgtctaatcatgtgcatagagaagaacttgagttgtggccactgtttgataaacatttttctgtagatgatcaggataagattgtaggtcgtataattggatctacgggagctgaggttctgcagtcaatgttgccctgggttacttcagcactcagtcttgaggaacagaacagtatgttggataccatgaaacaagcaactaagaatacaatgtttgatgaatggctaaacgaatggtggacgagatcaccatcttcatctggcccctcaaatgagacctcatcatctccagaagaaaatcattttcaggaaaaccttgaccatagtgaccagatgtttaagcctggttggaaggacatcttcaggatgaatcaaagtgagctcgaggctgagatacgaaaggtttctcaaaattctacccttgaccctaggaggaaggcatatctaattcaaaatctcatgacgagccgctggatagctgctcagcagaaatcaccacaaccaaaatcagaagatcacaatggatctactgttatacctggatgttttccttcatatcgcgatggagagaaccaaatatttggttgtgaacattacaaaagaaactgcaagcttgtcgctgcatgctgcaataagctgttcacatgcaggttctgtcatgataaagttagtgatcatacaatggaaaggaaagcaacggtggagatgatgtgcatgcgatgcctgaaagttcaaccagttggttcaaattgccaaactccttcttgcaatgggttatccatggcaaagtatcattgcagtatatgcaagttttttgacgatgaaaggagtgtatatcactgccctttttgtaatttgtgtcgtgttgggcaaggattgggtaccgactttttccattgcatgaattgcaattgttgcctcggtgtgaaattgatcgaacacaaatgtcgcgaaaagatgctagagatgaattgtccaatctgttgcgacttcttattcacatcaagtgcagcagttagaggtcttccttgtggccatttcatgcattcagcttgctttcaggcatatacttgcagtcactacacctgcccaatctgcagcaaatccttgggagatatgacagtgtactttggcatgcttgatggcttgcttgctgcagaagaacttcctcctgaataccgggatcggtgccaggatatactctgcaacgactgcggaagaaaagggcgatcccggttccattggctgtatcacaaatgcggcgcatgtggctcgtacaacactagagtcatcaagacagatgcagcagattgctcgacgtcgaattaacaggcgagtttagtttttttttggttcttgcccgattcttttggaaatccgttcctgtaatgtacttcgacacacagaatgtgtgtgtacatctatgatgattaataagtcattacgaatccatgtca

SEQ ID NO: 1347 - DNA, 1329 bp, Brachypodium distachyon
ggccgccggtattccgcatagtatatcttcactcgccgctgccattaggacttcgggagaatcgagagcaaatcgggggcgagcgagcgagcaagagagatactccagatcgcagcaggtggccgccgcctcgacacacgcggctccgccccaagcccccaacgcctccccctcccgccgtctgttggtctccccgtcgcagcatttctccgggccctattccccaatcgataatagtgtataccagaggctctagtccagatcatcatcaaacatgtcgctcctttcaaaattacgcttagtcaccgtggatgtgactggtactctgatcgcttacaaaggacggcttggcgattactactgtatggctgctaagtctgctggaaagccgtgccctgactataaccgaatgcacgaaggcttcaagcttgcatacactgagatggcaagaaaatacccatgctttggatttgctgcaaagatgccaacaatcgaatggtggaggatgtgtgtcaaggattcgttcgttaaggctggctatgattatgatgacgagacatttgagaaaatcttcaaacgtatttattctgcttttggctcctctgcgccatactcggtgtttcctgatgcacaacccttcctgagggggcttagggaaaagggaatcacagttgggattgtgagcaatgcagagtatcgttacaaagaggtcatcttacctgctttagggctaaatcagggctcggaatgggactttggggtgttctcgggcattgttggtgtcgagaagcctgacccagcaatctacaagatcgcgctggaaatggcagggaacgtcgcaccagaagaagcgcttcacataggtgacagcatgcgcaaggactatgtccctgcacggagcatcgggatgcatggcttgcttttggaccgattcaagaccgccgatgccgagagctggaagcagtctggtgcgcctgtgcttcccgacctggtagctgctgaagcatggcttgcccagaatcagaaggcagaaactgaagaggagcctctagcggcttccctgctgcgacggatgtcagaaaagctttgagttttggcctttcagatggtcccttttgtgcccttgctatgaaatgggtgagccaaagaaacaggttatgttgtactaatgggaggagaaaggcggtggttcttggctggtgtaattagccggagctgctcactggctgtagcctttagttctatcgccgattgctgaatatggcaagcaatttagcgtgccatgaatcctgttttgacaaataataattctaattatgttcagcattc

SEQ ID NO: 1348 - DNA, 1392 bp, Leymus cinereus x Leymus triticoides
  misc_feature (7)..(10): n is a, c, g, or t
gatttcnnnncgccactcccaaagccccgatactttatagccggcgacaacaaagccaacaaaatcccatctcccaactcagaaatccccccactcccgccccagaatcagttgccccttcccttcccagagatctcagcccgagcctgcacgccgcaacttccgccggaatcctcctctcctagccgcagcgtcgtgggattgattcaggaggcattcttggtggccggagaagcagtctttggtcctctgctcgagaagaatataacagaggctgtagttcagatcatcatcaaacatgttgctgctatcgaaattacggttggtcactgtggatgtgactggtactctgcttgcttacaaaggacggcttggtgattactactgtatggctgctaagtctgctggaaagccatgccctgactatgatcgaatgcatgaaggcttcaagcttgcatacactgagatggcaaggaaatacccatgctttggatttgcggcaaagatgccaacgattgaatggtggaggatctgtgtcaaggattcatttgttaaggctggctatgattacgatgatgagacatttgagaaagtgttcaagcgtatttactctgcctttggctcctctgcgccatactcggtgtttcctgatgcacagcccttcatgagagggctgagggaaaaggggatcacagttgggatcgtcagcaatgcagagtaccgttacaaagaggtcatcttgcctgcgttagggttgaatcagttgtgcaactagggctcggagtgggacttcggggtgttctcaggcatcgtcggcgtcgagaagcccgacccaacaatctacaagatcgcgctggagatggcggggaacgtcgcgccggaagaggcgctccacatcggcgacagctaccgcaaggactacgtccccgcgcggagcatcgggatgcacgcactgctcctggaccggttcaagaccgccgacgccgagagctggaggcagtccggcgcgccggtgctccctgatctggaagccgcacaggcatggctcaccaagaacccgggaaggagccagtaggggccgagctgctgcgcaggatggccgagaagctttgaatctcgcccctgtgatagttcctttcgtgctcttgctgtggagtgagggagccaaggagaagggccgtgtttgtagtaatgggaggaaaaatgggtgatggttcactggccaatttagttagctggagctgcttgaactctggtagtaacttccaatgctgctgctgattgctggatgtggcaagtgattcagcgtgtgatggatcatcttgcaacgacgaataatgctgatcatgtttcgcgtaatggagaaatttaacatgattctgcaaaaaaaaa

SEQ ID NO: 1349 - DNA, 1453 bp, Zea mays
atggaccagcaccgccggtatcccgttcccaattccacagatttccgctccccactccgcactcccagtacttaaaccacctaaaaaccaagcaaaatcccacctcccgaaccctggactcatagacaaggaattgggagattcgatttctgctattcagcccacgcccactggttcaaccggtttcttcaaatctcaggcttcaaggccgcaacttttcccccgttggggttggacttggacagctgccgtgcttgggaggcattgccggcaacgggaggtccaatcatcgatccttcgatagattgtatataaggaccacggttcagattactgtcaagcatgtctctactttcaaagttgcgcttgatcaccgtggatgttactggtacactgattgcttacaaaggacaccttggggattactactgtatggcagcaaagtctgctgggatgccatgtcctgactataaccgcatgcatgagggcttcaagcttgcatacactgagatggcaagacagtacccttgctttggatttgcagctaagatgccgaacatcgaatggtggaggacatgtgttaagaattcattcgttaaggctggctatgattatgatgaagagacatttgagaaagtcttcaggcgcatttattctgcatttggctcctctgcgccatactcggcgtttcctgattcgcagcccttcctaaggtgggcacgcgaaaagggactcactgttggcatcgtcagcaatgcagaataccgctacaaagatgtaatcctgccagctttaggattgaatcagagctccgaatgggactttggggtgttctcaggtgtcgttggcgttgagaagccagacccaagaatttacaagatagcgctggagatggcaggaaacgtcgctccggaagaagcgctccacataggtgacagcatgcggaaggactacaccccagctaggagcatcgggatgcatgcgctgctcctggaccggttcaagactgccgacgctgagagctggaggcagtcaggcgccacggtgctcccggaccttgtcgccactcaagagtggctcaccaaggatcagaatgacgaacaggaggaaacagtggcagcacgagtgctgaagagaatgtccgaaaagctatagatgggggctttaaccatgcattaattctacgagtgttcctttatattatctagctatggactgaaggtccaaaagcaacttatgctgatgagaggttggtgacgattcttggctactggctactgtaattagcttgagctactattctggttgcagcatctgtggctgaacacgagtaccatatctgagtgtcataagtcatgttgcgaagaacatgagtagcatatttcaggtgccgtttggttcatatatttgtaatgtaatgggtaacggataacgttaaatcatgtttgtttta

SEQ ID NO: 1350 - DNA, 1357 bp, Pennisetum glaucum
aagctcacaggcgacggacacgaaggttcgatttctgcgattctttcgagccctctggtgccgccgggttcttgaaatctcaggctgcgatttctgtttcctccccccttccggttggacggctgccgtggctgggaggcattgctgacgaccgggggtgcaactgtcgatcctgtgcttgagatagattgtatattaaggctgcagctcagatcactatcaagcatgtctctcctctcgaagttacgcttgatcaccgtggatgtgactggtacactgatcgcttacaaaggacatcttggggattactactgtatggcagctaagtcagctgggatgccatgtcctgactataaccgcatgcatgagggcttcaagcttgcatacactgagatggcaaggcagtatccatgctttggatttgcagcaaagatgccaaacattgaatggtggaggacttgtgttaagaactcatttgttaaggctggctacgattatgacgaggagacatttgagaaaatcttcaggcgtatttattctgcttttggctcctctgcgccatactctgcatttcctgatgcacagccctttctgaggtgggcgcgggagaagggactcacagttgggattgtcagcaatgcagagtaccgctacaaagatgtaatcttaccagctttaggattgaatcagggctcggaatgggacttcggggtcttttcaggtgttgtcggcattgagaaaccagatccaagaatttacaagttagcgctcgagatggcaggaaacatcgcgccagaagaagcactccacataggtgacagcatgcggaaggattacgtccctgcaagaagcattgggatgcgagcgctgctcctggaccggttcaagactgccgatgctgagagctggaggcagtctggcgcgacggtgctacccgacttggttgccactcaggagtggctcaccaaggaccagaatgaggagccaaagcatgagacggtagcagctcaagtgctgaacagaatgtctgaaaagctcaagatgggggcttaagcccagagctcctacaggtggaaggagacaggttcttgactgctggctaatgtaatgagcttgaactgggttagcggttcctggggcttgtgctgattgctgaatatgattagcaaatcattgtgtcatgaatggaagatttcaggctctgttttccattcttcacctgtgtgtggatgagtaaagaagaggaaatggattttgcattcttaacatgtgtaggtcaatttgattcgtgcagcttgtacttccaatataaattagataacatgtatagataataatagctgatacaaaaatcggt

SEQ ID NO: 1351 - DNA, 1328 bp, Oryza sativa
aatttgcaaggaatgggatgcgctaggcgaaattactaaactgccctcgccattttgacgcttctatctcgcccaccggccaccgctgccgtctccatccatcccgcgaggcgccgccgccgactccgcctccgcctccgcctccggcgatccccatccatcacgcgaggcgccgcctccgcctccggcgacccccatccatcacgcgaccgccgcttcgtcggcatcctcccaccgcatccatcctgaagaagatcatcgtcaaaacatgtcgctcatttcgaagctgcggttgatcactgtggatgtcaccggtactctgcttgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggctggttatgagtatgacgaggagacatttgagaagattttcaaacggatttactcttcttttggctcgtctgctccgtactcggtattccctgatgcgcagcccttcatgaggtggcttcgcgggaaggggctcacggttggaattgtcagcaacgcagaataccgttacaaagacgtcatcttgcctgctctaggactgaaccagggctccgagtgggactttggggtgttctctggaatagttggtgtggagaagccagatccaagtatctacaggattgcactggaaatggcgggcaaggtcgcgccagaagaggcgcttcacataggcgacagcatgcgcaaggactacacccctgcacggagcatcggaatgcacgcgctgcttctggaccgattcaagaccgccgatgctgagagctggaggaagtctggagcaactgtgctccctgacctggtagctgctcaggagtggctcagcaagaatctcaaggatgagccagtagcagctgaacaaaatgtctgaccttagaaaattcagttcccctgtcactgagctgaattccctcttgtttcctagttatgaaacgagggaggcaaaagaaatgtgccattgatgtatttgtattgtactgatggaataggttatgtgatggttcttggctgctggattatgtaagctgtttggtgttgaactgttgatgctgattgctgaatatgtcaagcaaatcagtgtggcagagcattgttgtagtctcccatgaactgtgtttcagcgaagaaaactagttttgtttggc

SEQ ID NO: 1352 - DNA, 1447 bp, Sorghum bicolor
gtggaccatcaccgccggtatcccgttcccaattccacagatttccactccccactcccagagtcccagtacttataccaccgaaaaaacaagcaaaatcccacctcccaaacctcaaaacctggagctcataggcaagaaactgggaagggagattcgatttgggagggcagattcgatttctgctattctttggaggagcccactggttcagccggtttcttgaaatctcaggccccaaggccaacttttcccccgttccggttggacaactgccgtgattgggaggcattgccggcgactggagattcaatcatcgatccttttctaggtagattgtatataaagaccacagttcagatcactgccaagcatgtctctactttcaaagttacgcttgatcaccgtggatgttactggtacactgattgcttacaaaggacaccttggggattactactgtatggcagctaagtctgctgggatgccatgccctgactataaccgtatgcatgagggcttcaagcttgcatacactgagatggccagacagtacccttgctttggatttgcggctaagatgccgaacattgaatggtggaggacatgtgttaagaattcatttgttaaggctggctatgattatgatgaggagacatttgagaaaatcttcaggcgcatttattctgcttttggctcctctgcaccatactcggcatttcctgatgcacagcccttcatgcggtgggcgcgggaaaagggactcattgttggtgttgtcagcaatgcagagtatcgctacaaagatgtaatcttaccagctttagggttgaatcagggctccgaatgggacttcggggtgttctcaggcatggtaggtgttgagaagccagacccaagaatttacaagatagcgttggagatggcaggaaacgtagctccagaagaagcgctccacataggtgacagcatgcggaaggactacaccccagctaggagcatcgggatgcatgcgctgctcctggaccggttcaagactgccgacgccgagagctggaggcagtcaggcgcgacggtgctccctgatctggttgccactcaagagtggctcaccaagaatcagaatgaggaacaggagaaaacagtggcatcacgagtgctgaacagaatgtctgaaaagctaaagatgggggcttgatcgtgcaataattatatgagtgttcctttatagtattatcggactgaagttccaaaagaaacttgtgctgatggatggggggtaggtgattgttcttgactaggttactgtaattagcttgagctacccttctgcttgcggcatctggggctgaacattatccgagtgtcacgaatcatgttgcgaagaagatttcaagttgtcttccattcatctgcgtggagcaataaaggaagtggaaatgaactc

SEQ ID NO: 1353 - DNA, 1718 bp, Panicum virgatum
cacagatttgaggtttccactctccatttccagtcagtacttaaacacccgaaaaaccaagcagaattgctacatctcgaaccaaagcctggacctcataggcaacgaaagcgaaggatcgatctccaccgatcccgctgatttcttgaaatctcaggcattgttggcgaccggagctgcaaccatcgatcctttgcttgaggtaatggagcattttggatttgttcctgccactttctggtaagagagggccgttttcctcccgtgccctctgctccctctccctcagtcttcgccgaccctccctgcgccccctctttctcgcgctccggcaaggcgcggcggtcgtcgctctccacgtccctccgcacccgccgcctgccatcccctccccgaccaaggatctgcaccgccgccgctcctgcccttcccccgaccggagcagcgccgcctgcctctcccttgctgtgcgccgttgcgtccccattttggcaatcaggagctattgtctataaaggcctcagttcagatcattatcaagcatgtctctcctttcaaagttacgtttgatcaccgtggacgtgactggcacgcttatcgcttacaaaggacatcttggggattactactgtatggcagctaagtcagctgggatgccatgtcctgactataaccgtgtgcatgagggcttcaaggttgcatacactgagatggcaagacagtacccatgctttggatttgcagcaaagatgccgaacattgaatggtggaggacatgtgttaagaattcgtttgttaaggctggctatgattatgatgaggagacatttgagaaaatcttcaggcgcatttattctgcttttggctcctcggccccatactcagcatttcctgatgcactgcccttcctgaggtgggcgcgggtgaagggactcacagttgggattgtcagcaatgcagagtaccgctacaaagatgtaatcttgccagccttagggttgaatcagggctcggaatgggactttggggtgttttcaggcattgttggtgtcgagaagccagatccaagaatttacaagatagcgctggagatggcaggaaatattgcgccagaagaagcactccacataggtgacagcatgcggaaggactacacccctgcgaggagcgttgggatgcatgcgctgctcctggaccggttcaagacagccgacgctgagagctggaggcagtctggcgcgacggtgctccctgacctggttgccactcaagagtggctcaccaagaaccagaatgaggaaccgaagcacgagacagtagcagctcaagtgctgaacagaatgtctgaaaagctaaagatgggagcgtaaagcccacagagagttcctttttatgcgccggttgtgaactgaagataggtgatggttcttgactactggctagtgtaattagcctaagctgctggctgttgtaatgcctactggggcttatgctgattgctgaatatgactagcaaatcagtgtcatgactgtctactgatgaagacttcctggttccgatttccacctatgtggatcaataaagaagaggaaatggatttcacatgtgccacgagttttttcccgttcttaacatatgtgaaagggcattttgatttctgtatcttgtgcttccaatatgaattaattaataataatgaaagatagtatagaagggc

SEQ ID NO: 1354 - DNA, 1480 bp, Panicum virgatum
ggaaacttttcatctcgcctagtacaacagtacacgcgtacctgcttcctgcccaaaaccgtggaccatcaccgccggtatcctatcccaattccacagatttgaggtttccactccccacttccagtacttcataccacccgaaaaaccaagcagaatcccacctctcgaaccaatagcctggaattcatagccaacaaaagcgaaggatcgtctctgcgattctttggagtccgctggtcccgctgatttcttgaaatctcaagcccccaagccgcgatttttatttccccctttccggtgggagagctgctgtggctaggaggcattgttggcgaccggaggtgcaaccatcgattctttgcttgagattctatataaaggcctcggttcaaatcattatcaagcatgtctctcctttcaaagttacgtttgatcaccgtggatgtgactggcacgcttatcgcttacaaaggacatcttggggattactactgtatggcagctaagtcagctgggatgccatgtcctgactataaccgcgtgcatgagggcttcaaggttgcatacactgagatggcaagacagtacccatgctttggatttgcagcaaagatgccaaacattgaatggtggaggacatgtgttaagaattcgttcgttaaggctggctatgattatgatgaggagacatttgagaaaatcttcagacgcatttattctgcttttggctcctcggcgccatactcagcatttcctgatgcacagcccttcctgaggtgggcgcgggagaagggactcatagttgggattgtcagcaatgctgagtaccgctacaaagatgtaatattgccagccttagggttgaatcagggctcggaatgggactttggggtgttttcaggaattgctggtgttgagaagccagatccaagaatttacaagatagcgctggagatggcaggaaacattgcgccagaagaagcactccacataggtgacagcatgcggaaggactacacccctgcgaggagcgttgggatgcatgggctgctcctggaccggttcaagacggctgacgctgagagctggaggcagtctggtgcgacggtgctccatgacttggttgccactcaagagtggctcaccaagaaccagaatgaggaacagaagcatgagacagtagcagctcaagtgctgaacagaatgtctggaaagctaaagatgggggcttaatcccacagagagttcatttttatgcgccagttgtgaactaaagatcctactggtggaaggagataggtatggttcttgattggctactgtaattagcatgagctgctggctgttgtactgcctactatggcttatgctgagcgctgaatatgactagcaaatcagtgtcatgacagaggaagacttcaagttccgttttccactatgtggatcaataaagaagaggaaatggatttcacatgtg

SEQ ID NO: 1355 - DNA, 1453 bp, Triticum aestivum
gcacacccatctcttccaaaacaccctatcgcccccctgccttgagctgcaatccgatgaaccagcaaaaccgtggacgagcaccgccggtattccgctcccgaattccacagatttccactccccgctcccaaagccccgagactttatagccggcgagaacaaacccagcaaaatcccatctcccaacccagaaatcctcccacacccagaaatgaatcagcctctccttccccttctctgagatctcagcctgagcctgcgcgccgcgacttccaccggaatcctcctctcccagccgcagcgtcgccggattgattcaggaggcattcttgccggccggagaagcagtctttggtcatctgctcgagaagaatataacagaggctctagttcagatcatcatcagacatgtcgctgctatcgaagttacggttggtcactgtggatgtgactggtactctgcttgcttacaaaggacggcttggtgattactactgcatggctgctaagtctgccggaaagccatgccctgactatgatcgaatgcacgaaggcttcaagcttgcatacactgagatggcgaggaaatacccatgctttggatttgcggcaaagatgccaacgattgaatggtggaggatttgtgtcaaggattcatttgttaaggctggctatgattacgatgatgagacatttgacaaagtgttcaagcgtatttattccgccttcggctcctccgcaccatactcggtgtttcctgatgcacagcccttcatgagagggctgagggagaagggtatcacagttggcatcgtcagcaatgcagagtaccgttacaaagaggtcatcttgcctgcgttagggctgaatcagggctcggagtgggacttcggggtgttctcaggcatcgtcggcgttgagaaacctgacccaaaaatctacaagatcgcgctggagatggcggggaacgtcgcaccggaagaggcgctccacatcggcgacagctaccgcaaggactacgtccccgcacggagcatcgggatgcacgcgctgctcctggaccggttcaagaccgccgacgccgagagctggaggaagtccggcgcgccggtgctccctgacctcgaggccgcgcaggcatggctcaccaagaacccgaccgaggagccactaggggccgcgctgctgcgcaggatggccgagaagctctgaatctcgccccctgggatagttcctgttgtgctcttgctggggagtgagggagccaaggagaagggatgtgttgtagtgatggttcactggccagtttagctagctggagctacttgaactctggtagtaggcttccggtgctgtggtgactgctgaatgtggcaagtgattcagccgtgcgacgaacatcttgcaatgacgaataattctaatcatgtttcgcataatggagaaattt

SEQ ID NO: 1356 - DNA, 1276 bp, Triticum aestivum
tcccatctcccaacccggaaatcctcccactcccgggaatgaatcagcttccccttccccttctctgagatctcagcccgagcctgcgcgccgcgacttccaccggaatccttccctcctagccgcaacatcgccggatcgattcaggcattcttggtggccggagaagcagtctttggtcctctgcttgagatcatcatcagacatgtcgctgctatcgaaattgcggctggttactgtggatgtgactggtactctgcttgcttacaaaggacggcttggtgattactactgcatggctgctaaggctgctggaaagccatgccctgattatgatcgaatgcacgaaggcttcaagcttgcatacactgagatggcaaggaaatacccatgctttggatttgcggcaaagatgccaacgattgaatggtggaggatttgtgtcaaggattcatttgttaaggctgggtatgattacgatgatgagacatttgataaagtgttcaagcgaatttattccgcctttggctcctctgcgccatactctgtttttcctgatgcacagcccttcatgagagggctgagggaaaaggggatcacagttggaatcgtcagcaatgcagagtaccggtacaaagaggtcatcttgcctgcgttagggctgaatcagggctcagagtgggacttcggggtgttctcaggcatcgtcggtgtcgagaaacctgacccaaaaatctacaagatcgcgctggagatggcggggaacgtcgcaccggaagaggcgctccacattggcgacagctaccgcaaggactacgtccctgcacggagcatcgggatgcacgcgctgctcctggaccggttcaagaccgccgacgccgagagctggaggcagtccggcgcgccggtgctccctgatctcgaagccgcacaggcatggctcaccaagaacccgaccgaggaacccgctgaggagccactaggggccgcactgctgcgcaggatggccgagaagctctgaatctcgcccctgggatggttcctgttgtgctcttgctggggagtgagggagccaaggagaagggatgtgttgtagcgatggttcactggccagtttagctagctggagctacttgaactctggtagtaggcttccagtgctgttgttgactgctgaatgtggccaagtgattcagccgtgcgacaaacatcttgcaatgacgaataattctaatcatgtttcgcataatggaggaatttaacatgaaaaaaaaaa

SEQ ID NO: 1357 - DNA, 1289 bp, Triticum aestivum
gctcccgaattccacagatttccactccccactcccaaagtcccgatactttatagccggcgacaacaaacccagcaaaatcccatctctcaacccagtgaatctgcttcccctttcccttgtctgagatctcagcccgagcctgcacgccgcaacttccaccgaaatcctcccctcctagccgcagcgtcgccggattgattcagaaggcattcttggtggccggagaagcagtctttggtcctctgctcgagaagaatataactgttattcagatcatcatcaaacatgtcgctgctatcgaagttacggttggtcactgtggatgtgactggtactctgcttgcttacaaaggacggcttggtgattactactgcatggctgctaaggctgccggaaagccatgccctgattatgatcgaatgcatgaaggcttcaagcttgcatacactgagatggcaaggaaatacccatgctttggatttgcggcaaagatgccaacgatcgaatggtggaggatttgcgttaaggattcatttgttaaggctggctatgattacgatgatgagacatttgagaaagtgttcaagcgtatttattctgccttcggctcctctgcgccatactcagtgtttcctgatgcacagcccttcatgagagggctgagggagaagggtatcacagttggcatcgtcagcaatgcagagtaccgttacaaagaggtcatcttgcctgcgttagggctgaatcagggctcggagtgggacttcggggtgttctcaggcatcgtcggcgtcgagaagcccgacccaacgatctacaagatcgcgctagagatggcggggaacgtcgcaccagaagaggcgctccacattggcgacagctaccgcaaggactatgtccccgcacgaagcatcgggatgcacgcgctgctcctggaccggttcaagaccgccgaagccgagagctggaggaagtctggcgcaccggtcctccctgacctcgaggccgcgcaggcatggctcaccaagaacccgaccgaggaacccgctgaggagccactaggggccgcgctgctgcgcaggatggccgagaagctctgaatctcgcccctgggatagttcctgttgtgctcttgctgggcagtgagggagccaaggagaagggatgtgttgtagtgatggttcactggcctgtttagctagctggagctacttgaactctggtagtagcttcgggtactgttgctgactgctgaatgtggcaagtgattcagtcgtgcgacgaa

SEQ ID NO: 1358 - DNA, 1379 bp, Brachypodium distachyon
attgtgggcttactcggaaacgaacaagaagggaacaaaagggtttcttgcaagcaacttcggtgagccataagaaggcattgctctagcactgcacattatagaggagcgagagggccaaagtgagagagatagagagagagggggggagggagagggagagggagctgaagaaatcatggagaacaagcacaccgatcaggcaaaggtaaaggcaaagctcagcatgatgcactcaaaggttatctgctgcaagctctacatttctgaaagccaaaatgcgatggttgttgatgcaatcagtcgcataggccaaaaagaccctgaggtagttttgctcagcaagttcgaggatgagtactacaaccgcgtccgctacacacttgtctcctatattatcagcaatagctcaactggtgaagttatatttagcccaatcaggaaggtattgttggcaatgattgaggctgcattttcaaacataaaccttgaagtgcactgcggaactcatcctaggatcggcgtcgttgatgacatgtcgttccaccccttgagtcaagcagccacaatggaggatgctgctcagctggctaagctgttggcgtctgacattggcaatggcttacaagtcccggtgtttctgtatgcggcagcacaccccaccggcaagagtgttagtgccatacgacgtgagctcggttactaccgaccaaatcacaagggcatcaagtgggcaggtcaggtgctccctgatactctgccaatgaagccagatgagggcccaactcaagttcctcgtgaaagaggtgccacaatggtcggagcaaaaccttttgttgagagctataatgtaccaatcctttgtaaggatgtcccaacagtgaggaggatcactcgaagggtgaccgggcggagtggagggttcccgacagtgcaagcactcgccctattccatggcgacaattgcacggagattgcatgcttgttggatccagatcatgtcggtgctgagcaggttcagtggctggtggagcagattgcagcagagcaaggacttgaggttgacaagggttacttcaccgacttatccaaggatatgatgctagaaaggtacttcaagatggtctctgctgctgattgacatgtacataattttgttggcagattgcaagcatggaattgcattctgtagtgctgattgacattcttgcaatcatgtgtgtcttgcacttgagtgtatgctgcaactaaatttgtgacaccaacttgcatgccagacaaataactaatcctaacactttgtacatagaagttctatctctcttgaagatggtctttggaaactccaccttggtaatcgcaagataatttgtctgatc

SEQ ID NO: 1359 - DNA, 1193 bp, Pseudoroegneria spicata
  misc_feature (177)..(177): n is a, c, g, or t
  misc_feature (237)..(237): n is a, c, g, or t
  misc_feature (247)..(248): n is a, c, g, or t
  misc_feature (250)..(250): n is a, c, g, or t
  misc_feature (316)..(316): n is a, c, g, or t
  misc_feature (322)..(322): n is a, c, g, or t
  misc_feature (328)..(328): n is a, c, g, or t
  misc_feature (331)..(331): n is a, c, g, or t
  misc_feature (350)..(350): n is a, c, g, or t
  misc_feature (355)..(355): n is a, c, g, or t
  misc_feature (373)..(373): n is a, c, g, or t
  misc_feature (391)..(391): n is a, c, g, or t
  misc_feature (393)..(393): n is a, c, g, or t
  misc_feature (415)..(415): n is a, c, g, or t
  misc_feature (436)..(436): n is a, c, g, or t
  misc_feature (540)..(540): n is a, c, g, or t
  misc_feature (544)..(544): n is a, c, g, or t
  misc_feature (576)..(576): n is a, c, g, or t
  misc_feature (599)..(599): n is a, c, g, or t
  misc_feature (621)..(621): n is a, c, g, or t
  misc_feature (625)..(625): n is a, c, g, or t
  misc_feature (632)..(632): n is a, c, g, or t
  misc_feature (635)..(635): n is a, c, g, or t
  misc_feature (662)..(662): n is a, c, g, or t
  misc_feature (670)..(670): n is a, c, g, or t
  misc_feature (695)..(695): n is a, c, g, or t
  misc_feature (712)..(712): n is a, c, g, or t
  misc_feature (715)..(715): n is a, c, g, or t
  misc_feature (724)..(724): n is a, c, g, or t
  misc_feature (849)..(849): n is a, c, g, or t
  misc_feature (856)..(856): n is a, c, g, or t
  misc_feature (872)..(872): n is a, c, g, or t
  misc_feature (880)..(880): n is a, c, g, or t
  misc_feature (895)..(895): n is a, c, g, or t
  misc_feature (925)..(925): n is a, c, g, or t
  misc_feature (929)..(929): n is a, c, g, or t
  misc_feature (931)..(931): n is a, c, g, or t
  misc_feature (940)..(940): n is a, c, g, or t
  misc_feature (951)..(952): n is a, c, g, or t
  misc_feature (984)..(984): n is a, c, g, or t
  misc_feature (1003)..(1003): n is a, c, g, or t
  misc_feature (1020)..(1020): n is a, c, g, or t
  misc_feature (1022)..(1022): n is a, c, g, or t
  misc_feature (1048)..(1048): n is a, c, g, or t
  misc_feature (1062)..(1062): n is a, c, g, or t
  misc_feature (1068)..(1068): n is a, c, g, or t
  misc_feature (1107)..(1107): n is a, c, g, or t
aagagattgagatagagctgaaggcatggagggcaagcacaccgaccaggcaaagctcagcacgatgcactcaaaggtgatctgctgcaagctctacatctctgaaagccaaaatgcggctgtggtcgatgccatcagccgcataggccagaaagaccctgaggtggttctactcancaagttcgaggatgagtactacaaccgtgtccgctacacgcttgtctcctacatcaccancgaaagctcnncnggtgaagctgtatttagcccaatcaggaaggtactgctggcgatgatcgaggctgcattttcagcnataaanctcgangtncacagtggaactcatccanggatnggtgtcgtcgatgacatntcattccaccccttgagncnagcggccacaatggaggatgcngctcagctggctaagctggtngcctctgacattggcaatggcttgcaagttccagtgttcctatatgcggcagcacaccccaccagcaagagcgtcagtgcagtccggcgtgagctcggctactnccgnccaaaccacaagggcgtccaatgggcaggccnggtgctccctgatactctaccgntgaagccggatgtgggcccagntcangtttctngtnaaagaggcgccaccatggtcggagctnaacctttngtcgagagctacaatgtgccgatantctgcaaggatgtcccnacngtgagaagnatcacccggagggtcaccggacgcagcggagggttcccgacggtgcaggcgcttgctctcttccatggcgacaattgcatggagatcgcgtgcttcctggacccagatcatgtcggtgccgatcnggttcantggctggtggagcagnttgcagangagcaagggcttgangttgacaagggctatttcaccgacctgtcnaagnanatgatgctngaaaggtactnngagatggtttctgcagctgattgacatgtgcncagttttcttattgtgatnatgcatgtctgcacttncntgtatgctgctgtttaaactgtggcnccaacttggacccnggaccnaccaattccaacattttgtatatacttagttatatctgnactagaggtggtctctggaaactccaccgcagtaattggcgcataacaggtctgatcattgaataagaatgttgtattcagtgata

SEQ ID NO: 1360 - DNA, 1299 bp, Triticum aestivum
gttggggcttactcggaacaaaaaggttccttgaaagcaactttttgatccatataaccataagaagaaggcgttgctctaccactccattccattccccacaagagagagagagagagggagaggggagccgaaggcatggagagcaagcacaccgaccaggcaaacgtgaaggcgaagctcagcaccatgcactcgaaggtgatctgttgcaagctctacatctctgaaagccaaaatgcggctgttgtcgatgccatcagccgcataggccagaaagaccctgaggtggttctactcaacaagttcgaggatgagtactacaaccgtgtccgctacacgcttgtctcctacatcaccaacgaaagctcgactggtggagctgtatttagcccaatcaggaaggtactgctggcgatgatcgaggctgcattttcagccataaacctcgaagtgcactgtggaactcatccaaggattggtgtcgtcgatgacatttcattccaccccttgaatcaagcggacacaatagaggatgctgctcagctggctaagctggtagcctctgacattggcaatggcttgcaagttccagtgttcctatatgcggcagcacaccccaccagcaagagcgtcagtgcagtccggcgtgagctcggctacttccggccaaaccacaagggcgtccaatgggcaggcccggtgctccctgatactctaccgatgaagccagatgtgggcccagttcacgttcctcgtgaaagaggcgccaccatggtcggagctcaacctttggtcgagagctacaatgtgccgatattctgcaaggatgtcccaaccgtgagaagaatcacccggagggtgactggacggagcggagggctcccgtcagtacaggcacttgcacttttccatggcgacaattgcacggagatcgcatgttttttgctggatccagaccacgtcggcgccgatcgggttcaatggctggtggagcagattgcagaggagcaagggcttgaagttgaaaagggctatttcactgacctgtcaaagcatatgatgctagaaaggtactccgagatggtttctgcagctgactgacatgtcaacagttttcttggcagattatcattcatgtaattgcatttcatgccgctgatcgacactcttgtaaacatgcatgtctgcacttccatggatgctgcagtttaaactgtggcaccaacttggactccggaccgaccagttccaacattttgtatatacttagttatatctgcactatggttttttgga

SEQ ID NO: 1361 - DNA, 1100 bp, Triticum aestivum
  misc_feature (2)..(2): n is a, c, g, or t
  misc_feature (21)..(21): n is a, c, g, or t
gnatagagctgaagacatggnagggcaagcgcaccgaccaggcaaagctcagcacgatgcacccaaaggttatctgctgcaagctctacatctctgaaagccaaaatgcggctgttgtcgatgccatcagccgcataggccagaaagaccctgaggtggttttgctcagcaagttcgaggacgagtactacaaccgtgtccgctatacgctcgcctcctacatcaccagcgaaagctcaaccggtgaagctgtatttagcccaatcaggaaggtgttgctggcgatgatcgaggctgcattttcagccataaatctcgaagtacacagtggaactcatccaaggattggcgtcgtcgatgacatgtcggtccaccccttgagccaagaggccacaatggaggatgctgctcagctggctaagttggtcgcctctgacattggcaatggcttgcaagttccggtgttcctctacgcggcagcacaccccaccagcaagagcgtcagtgcaatacggcgtgagctcggctactaccggccaaatcacaagggtgtccaatgggcaggccaggtgctccctgatactctaccagtgaagccagatgtgggcccagctcatgtttctagtaaaagaggtgccaccatggtcggagcaaaacctttcgtcgagagctacaatgtgccgatattctgcaaggatgtcccgaccgtgagaaggatcacccggagggtcacgggacggagcggagggttcccgacggtgcaggcgcttgctctcttccatggcgacaattgcacggagatcgcgtgcttgctggatccagaccatgttggtgccgatcaggttcagtggctggtggagcagattgcaggagagcaagggcttgaggttgacaagggctatttcaccgacctgtccaaggacatgatgctggaaaggtacttcaagatggtttctgcagctgattgacatgtgcacaatttccttcttgcaatcatgcatgtctgcacttccgtgtatgctgctgtttaaactgtggcgccaattgggccctggaccgaccaattccaacattttgtatatatacttagttatatctgc

SEQ ID NO: 1362 - DNA, 1272 bp, Triticum aestivum
ttcggcacgagggttggggcttactcggaacaaaaggttccttgcaagcaactttttgatccatataaccataagaagaaggcgttgctctaccactccatttcattccccacaagcgagagagagagagagtgatagagggggagctgaaggcatggagggcaagcacaccgagcaggcaaacgtgaaggcgaagctcagcacgatgcacttgaaggtgatctgctgcaagctctacatttctgaaagccaaaacgcggcggttgtcgacgccatcagccgcataggccagaaagaccctgaggtgggtttgctcagcaagtttgaggatgagtactacaaccgtgtccgctacacgcttgtctcctacatcaccagcgaaagctccaccggtgaagctgtattcagcccaatcaggaaggtactgctggcgatgatcgaggctgcattttcagccataaatctcgaagtgcactgtgggactcatccaaggatcggcgtcgtcgatgacatgtcgttccaccccctgagtcaagcagccaccatggaggatgctgcacagctggctaagctggtggcctctgacattggaaatggtttgcaagttccggtgttcctctacgcagcagcacaccccaccagcaagagtgtcagtgcggtccggcgtgagctcggctactaccggccaaatcacaacggcatccaatggacaggacaagtgctccctgatactctaccagtgaagccagatgtgggcccagctcatgtttctagtaaaagaggcgccaccatggtcggagctaaacctttcgtcgagagctacaatgtgccgatattctgcaaggatgtcccgaccgtgagaaggatcacccgaagggtgaccggacggagcggagggttcccgacggtgcaggcgctcgctctcttccatggcgacaactgcacggagattgcgtgcgctggatccagaccatgttggtgccgatcaggttcagtggctggtggagcagattgcagaagagcaagggcttgaggtcgacaagggttatttcaccgacctgtccaaggacatgatgctggaaaggtacttcgagatggtttctgcagctgattgacatgtgcataattttcttattgtgatcaggcatgtctgcacttccatgtatgctgctgtttaaactgtggcactaactggaccccagaccgaccaattccaatattttgtatatatacttaataaaatcggcactggagatggtctatggaaacttc

SEQ ID NO: 1363 - DNA, 621 bp, arabidopsis lyrata
ttcggtcatcatcgtatataacagcaaaacaactcaatcgttacttttttccagaaatctctcacaatcgccatcgattttagcagacattgaagaagatgggagtattcacattcgtgtgtaaaaatggcggcggcgcgtggactgcaaagcaacacgaaggagaacttgaagcttcggcttcttctacctacgagctccagcgtaagctcgtccaagctgctctctccgccgattcctccggtggcgttcagtcttcgttttctcttgtctcccctacctccgccgtattccaggtgattgtcggtggtggtggtggtggaggattcgctgctggaggagctgcctcgggtggaggtggtgcgggtgaatctgcagctgctcctaaggaagatgagaagaagaaagaagaatcagaagaggaagaaggagacttcggatttgatctctttggttaagatggaaatagtattttggaggtgttagtttgagcttttgtttttgtgtggggtgtttcttctactgtcatgtgatatgctactctgctttcagttccatttcacgagtctctgatgtaatgacaagcttcttctatttcgatcatatcatttttttggctcc

SEQ ID NO: 1364 - DNA, 582 bp, arabidopsis lyrata
atatataaacgtaatcacgcagtttttcgccgtgagacttaagttttttcatagttgagaaatttcgccgccgtttgaagaagaagaagaagagatgggagttttcactttcgtttgcaaaagcaaaggcggagaatggaccgcaaagcaacacgaaggagatcttgaagcttcagcttcttctacttacgatctccagcgcaagcttgttcagactgctctctccgccgattcttctggcggcgttcagtcttctttctctcttgtctctcctacctccgccgtcttccaggtgatcattggtggtggtggtggtggaggatttgctgccggaggtggtgcagctgctggaggtggtggtggcggtgaatctgccgcagccacaaaggaggaagagaagaagaaggaagagtctgaagaggaagaaggagactttggatttgatctctttggttaagagacctgaagtaactttgttagtgtttgaggttttttatctcattttctttttgttttctggtttttgatctttttgagactataatgtaatgtcagaaatatatgttattgtttctgctttca

SEQ ID NO: 1365 - DNA, 749 bp, Arabidopsis thaliana
gctttcgttcatcatcgtatataaaaacaaaaccactctcgatcgtcactttttccagaaatctctcactatcgccatcgattttagcagacattgaagaagatgggagtattcacattcgtatgcaagaatggaggcggcgcgtggagcgcaagcaacacgaaggagaacttgaatcttcagcttcttctacctacgagctccagcgtaagctcgttcaggtatctctctccgctgattcctccggtggcgttcagtcttcgttttctcttgtctcccctacctccgccgtattccaggtaattgttggtggtggtggtggtggaggattctctgctggaggagctgcctcaagtggaggtggtgcgggtgaagctgcagctgcccctaaggaagatgagaagaagaaagaagaatcagaagaggaagaaggagacttcggattcgatctctttggttaagattgaaatagtattttggaggtgttggtttgagctttccatttttgtgtggggtgtttcttccattgtcaagtgtgatatgctacactgctttcaattatatttcgtgagtaatgacaagtttctctttcgatcctatactttggctcctcatgtcagatgaatgaaagaaagtctcaaaacagtgttgaaatgtgataagaatctgtagctcatgaaatttgaggaagaggaggctatttcaggattagcatgtaatgtttggcttcaataataatattctctagt

SEQ ID NO: 1366 - DNA, 572 bp, Brassica oleracea
gagtctttgacagcttagaaatcttgccgaagaagaagatgggagtattcacattcgtttgcaaaagcaaaggcggggaatggagcgctaagcaacacgagggagacctcgaagcctccgcttcttccacctacgatctccagcgcaaggttgttcagactgctctctccgccgattcctccggtggcgttcagtcttccttctctctcgtctcccctacctccgccgtcttccaggtgatcattggtggtggttctggaggaggatttgctgccggtggaggtgcagcagctggaggcggtggtggaggtgaggccgccgcagccacaaaggaggaagaaaagaaaaaggaagaatctgaagaggaggaaggcgactttggatttgatctctttggttaatgctctttcgaaggtgttactttttgaggtttatttgtttctcttatctgaattgtgttttttcgattgaacctttatgcaagaaagactacaatgtcagaaatatatgttttgtttcttgtttcaacccatatgatgcagacttatctagtctactatggtctgattttt

SEQ ID NO: 1367 - DNA, 583 bp, Brassica oleracea
agctgaaaaatctcgccgccgttaaagaagaaaggagaagaagatgggagtattcacattcgtttgcaaaagcaaaggcggagaatggaccgctaagcagcacgagggagacctcgaagcctccgcttcttccacctacgatctccagcgcaagctcgttcagactgctctctccgccgattcctccggtggcgttcagtcttccttctccctcgtctcccctgcctccgccgtctttcaggtgatcatcggcggtggatctggaggaggatttgctgccggaggtggtgcagcagctggaggaggcggtggtggaggtgaatccgctgcggccgcaaaggaggaagagaagaagaaggaagaatctgaagaggaggaaggcgactttggatttgatctctttggttaagtcaagtgacaaaacataaaactctttccaaggtggtgtttagtttctgtggttgttgatctcagattctttattttggtttttcttttcgaaacggttttgagattgagctctatgattttgcaatgtcagaaatatatgtttggtttctggttattatgaaacttatttagc

SEQ ID NO: 1368 - DNA, 2245 bp, Brassica rapa
  misc_feature (2205)..(2205): n is a, c, g, or t
  misc_feature (2208)..(2208): n is a, c, g, or t
cccacgcgtccgcttgaagaaaagtaaaacaaactacaaaccaaaaatggctttgcataagtttcctctcatggggctgcttttgctcctaaccatcgtcgtctctccggcaacagccgatggacctgtttgcccaccgacgacaaaactaagccgggcaagtttccccgaaggtttcctatttggcacggctactgcagcatatcaggttgaaggcgcagtgaatgaaacctgtcgtggaccgtccttatgggatatctactgcaagagatttccatccagatgcaactacgataacggcgatgtggccgttgatttcttccaccgttataaggaagatatccaactaatgaagaatctaaacacagatgccttcagaatgtctatcgcatggcccagaatatttcctcatgggagaaaggagaaaggcgtgagtcaagctggtgtgcaattttaccacgacctcatcgacgagctcaaaagaaatggtattactccgttcgtgacagtctttcactgggacactccacaagatctagaggacgaatatggcggctttttaagtgaaaggattgtgaaagatttccgggagtatgcagattttgttttccaagagtatggaggaaaagtgaaacattggatcactttcaacgaaccatgggtgttctcccacgccggttatgatgtaggaaagaaagcaccaggacgttgctcaaagtatgtcaaggaagaatgtcaggaaggacgatcaggattcgaggcttacctcgtcactcacaatctccttaactctcacgcagaagccgttgaagctttccgacaatgcgaaaagtgtaaaggtggtaagatcggtatcgcacatagtccggcttggtttgaaccacatgaccttgctgattcacaggacggtgcatccatagaccgagcacttgactttattttgggatggcatctggacacaactatgtatggagattacccacagatcatgaaagatattgttggacatagattgcctaaatttaccgatgcacagaaagcaaaactgaaaaactcagccgatttcgtcgggctcaactactatacttcagtgttttcaaaccatctggagaagccagatccttctaaaccaagatggatgcaagattctcttattaactgggaaactaaaaacgcgtacaattacagcatcggtagcaagcctatcaccggtgcacttcccgtttttgcgagaggctttagaagtcttttgaagtacatcaaggataagtatggcaacccagaaattatgatcatggaaaacggatatggagaagaacttggggctacagattcagttgcagtaggtacagctgatcacaacaggaaatattatcttcagaggcatcttttgagcatgaatgaagctatttgcatcgacaaggtgaatgttaccggatactttgtatggtctttgttggataactttgagtggcaagatggctacaagaacagatttggactctactacattgatttcaaaaataacctcacacgatatgagaaagagtcgggcaagtattacaaagagttcctaagtcaaggtgttcgtccatccatgatcaacagggatgagctttgagctgtcttttgagaatttgttttcatgttttaatgtctatctctccttgtatccctttgtgattgaccatgatcgatgaggtcttggttataataataaagttgaaaccaaacgtgtattcctgacataacattaaagtattcttgcatagagttcaatctaaaaaaaaaaaacaattcaagataatagaaacagaaaatctcaaaaagtaaaacacttcgaaagagtttgttgttgtttttgttgggctcttaaccaaagagatcaaatccaaagtctccttcctcctcttcagattcttccttcttcttctcttcctcctttgtggctgcggcagcctcacctccaccaccgcctccagctgctgcacctccaccggcagcaaatcctcctcctgaaccaccaccgatgatcacctggaagacggcggaggtaggggagacgagggagaaggaagactgaacgccaccggaggaatcggcggagagagcagtctgaacaagcttgcgctggagatcgtaggtggaagaagcggagccttcgaggtctccctcgtgttgcttagcggtccattctccgcctanggntttgcaaacaaatgtgaatactcccattttcttcttc

SEQ ID NO: 1369 - DNA, 598 bp, Brassica rapa
cgcgccgtcagaagaaagaagaagaagaagaagatgggagtattcacattcgtttgcaaaagcaaaggcggagaatggaccgctaagcagcacgagggagacctcgaagcttccgattcttccacctacgatctccagcgcaagcttgttcagactgctctctccgccgattcctccggtggagttcagtcttccttctccctcgtctcccctacctccgccgtcttccaggtgatcatcggcggtggttctggaggaggatttgctgccggaggtggtgcagcagctggaggagccagtggtggaggtgagtccgccgctgccgcaaaggaggaagagaagaagaaggaagaatctgaagaggaggaaggtgactttggttttgatctatttggttaagaccagagacaaaacataaaactctttccaaggtggtgttagtttctgtggttgttgatctcagattctttgttttggtttttctgtttttcttttcgaaacggttttgagattgagctctatgattattatgcaatgtcagaattatatgtttggtttctggttattatgaaacttatttagtctaattcttaagagt

SEQ ID NO: 1370 - DNA, 603 bp, Brassica rapa
  misc_feature (201)..(201): n is a, c, g, or t
ggacactagtctgagaaacctcgccgtcgttagaagaagaaaatgggagtattcacatttgtttgcaaaagcaaaggcggagaatggaccgctaagcaacacgagggagacctcgaaggctccgcttcttccacctacgatctccagcgcaagcttgttcagactgctctctccgccgattcctccggtggcgttcagtcntccttctccctcgtctccccttcctccgccgtcttccaggtgatcatcggtggtggttcaggaggaggatttgctgccggtggaggtgcagcagcgggaggtggtggtggaggtgaggctgccgcagccacaaaggaggaagagaagaagaaggaagaatctgaagaggaggaaggagactttggatttgatctctttggttaagagcccaacaaaaacaacaacaaactctttcgaagtgttttactttttgagattttctgtttctattatcttgaattgttttttttttagattgaactctatgcaagaatactttaatgttatgtcaggaatacatgtttggtttctggttttaagttaacccatatgatgcaaacttatctagtctactatgtctgg

SEQ ID NO: 1371 - DNA, 627 bp, Brassica napus
ggtcagctgaaaaatctcgccgccgttaaagaagaaaggagaagaagatgggagtattcacattcgtttgcaaaagcaaaggcggagaatggaccgctaagcagcacgagggagacctcgaagcctccgcttcttccacctacgatctccagcgcaagctcgttcagactgctctctccgccgattcctccggtggcgttcagtcttccttctccctcgtctcccctacctccgccgtctttcaggtgatcatcggcggtggatctggaggaggatttgctgccggaggtggtgcagcagctggaggaggcggtagtggaggtgaatccgctgcggccgcaaaggaggaagagaagaagaaggaagaatctgaagaggaggaaggcgactttggatttgatctctttggttaagtcaagtgacaaaacataaaactctttccaaggtggtgtttagtttctgtggttgttgatctcagattctttattttggtttttcttttcgaaacggttttgagattgagctctatgattttgcaatgtcagaaatatatgtttggtttctggttattatgaaacttatttagtctaattcttaatagtaatgccagagagatgttaaatgatc

SEQ ID NO: 1372 - DNA, 693 bp, Brassica napus
gagggtttgttaggtgtctcgaaatatcattcatatataaataaatatacactaaccacttctcctcttacactagtctgagaaacctcgccgtcgttagaagaagaaaatgggagtattcacatttgtttgcaaaagcaaaggcggagaatggaccgctaagcaacacgagggagacctcgaaggctccgcttcttccacctacgatctccagcgcaagcttgttcagactgctctctccgccgattcctccggtggcgttcagtcttccttctccctcgtctccccttcctccgccgtcttccaggtgatcatcggtggtggttcaggaggaggatttgctgccggtggaggtgcagcagctggaggcggtggtggaggtgaggctgccgcagccacaaaggaggaagagaagaagaaggaagaatctgaagaggaggaaggagactttggatttgatctctttggttaagagcccaacaaaaacaacaacaaactctttcgaagtgttttactttttgagattttctgtttctattatcttgaattgtttttttttttagattgaactctatgcaagaatactttaatgttatgtcaggaatacatgtttggtttctggttttaagttaacccatatgatgcaaacttatctagtctactatgtctggaagataaacatttgagaacgtc

SEQ ID NO: 1373 - DNA, 601 bp, Brassica napus
  misc_feature (16)..(16): n is a, c, g, or t
atcaacgcagagtacncgggggcactagtctttgacagcttagaaatcttgccgaagaagaagatgggagtattcacattcgtttgcaaaagcaaaggcggggaatggagcgctaagcaacacgagggagacctcgaagcctccgcttcttccacctacgatctccagcgcaaggttgttcagactgctctctccgccgattcctccggtggcgttcagtcttccttctctctcgtctcccctacctccgccgtcttccaggtgatcattggtggtggttctggaggaggatttgctgccggtggaggtgcagcagctggaggcggtggtggaggtgaggccgccgcagccacaaaggaggaagaaaagaaaaaggaagaatctgaagaggaggaaggcgactttggatttgatctctttggttaatgctctttcgaaggtgttactttttgaggtttatttgtttctcttatctgaattgtgttttttcgattgaacctttatgcaagaaagactacaatgtcagaaatatatgttttgtttcttgtttcaacccatatgatgcaaacttatctagtctactatggtctgattttattcg

SEQ ID NO: 1374 - DNA, 636 bp, Brassica napus
gcagctaaaaaatctcgcagccgttaaagaagaaaggagaagaagatgggagtattcacattcgtttgcaaaagcaaaggcggagaatggaccgctaagcagcacgagggagacctcgaagcttccgattcttccacctacgatctccagcgcaagcttgttcagactgctctctccgccgattcctccggtggagttcagtcttccttctccctcgtctcccctacctccgccgtcttccaggtgatcatcggcggtggctctggaggaggatttgctgccggaggtggtgcagcagctggaggagccagtggtggaggtgagtccgccgctgccgcaaaggaggaagagaagaagaaggaagaatctgaagaggaggaaggtgactttggttttgatctatttggttaagaccagagacaaaacataaaactctttccaaggtggtgttagtttctgtggttgttgatctcagattctttgttttggtttttctgtttttcttttcgaaacggttttgagattgagctctatgattattatgcaatgtcagaattatatgtttggtttcttgttattatgaaacttatttagtctaattcttaagagtaatgctagagagatgtttaatgatcc

SEQ ID NO: 1375 - DNA, 594 bp, Raphanus sativus
ggattgtcagctttagataactcgccgtcgttagaaaaaagaagaagaagaaagatgggagtattcacattcgtctgcaaaagcaaaggcggagaatggaccgctaagcaatacgagggagacctcgaagcctccgcttcttccacctacgatctccagcgcaagcttgttcaggctgctctctccgccgattcctccggtggcgttcagtcttccttctccctcgtgtgccctacctccgccgtctgccaggtgaccattggtggtggttccggaggaggatttgctgccggtggaggtgcagcagctggaggcggtggtggaggtgaggccgccgcagcagcaaaggaggaagagaagaagaaggaagaatctgaggaggaggaaggagactttggttttgatctctttggttaagagtcgaaacaacaaacacttttcgaaggtgttagtttttgaggtgttctgcttctcttatcgaaattgttttttttttagattgaactttttgcaagaagactataatgttatgtcaaggaatacatgtttggtttttgtcttaacccaatattattagataagagatcgagatct

SEQ ID NO: 1376 - DNA, 589 bp, Raphanus sativus
  misc_feature (433)..(433): n is a, c, g, or t
gggggggctactagtcttgaatctcgccgccgttccgttagaaaagaagaagaaagatgggagtattcacattcgtttgcaaaagcaaaggcggagaatggaccgctaagcaacacgagggagacctcgaagcctccgcttcttccacctacgatcttcagcgcaagcttgttcaggctgctctctccgccgattcctccggtggcgttcagtcttccttctctctcgtctgccctacctccgccgtctgccaggtgatcattggcggtggttctggaggaggatttgctgccggaggtggtgcagcggctggaggaggtggtggtggtgagtccgccgcggctgctaaggaggaagagaagaagaaggaagaatctgaagaggaggaaggcgactttggatttgatctctttggttaagacacagagagagnaaaaaacataaaaactctttccaaggtgttgttagtttctgaggtttttgatctcagattatttattttgctttttctgtttttcattttaaaacggttttgaggttgtgctctatgattatgcaatgtcagaaatatatgtttggtttctggtta

SEQ ID NO: 1377 - DNA, 1131 bp, Thellungiella halophila
  misc_feature (7)..(7): n is a, c, g, or t
  misc_feature (10)..(10): n is a, c, g, or t
  misc_feature (588)..(588): n is a, c, g, or t
  misc_feature (590)..(590): n is a, c, g, or t
  misc_feature (592)..(592): n is a, c, g, or t
  misc_feature (594)..(594): n is a, c, g, or t
  misc_feature (598)..(598): n is a, c, g, or t
  misc_feature (600)..(600): n is a, c, g, or t
  misc_feature (602)..(605): n is a, c, g, or t
gaaagcnagnctaacacagctgagaaatctcgccgccgttagaagaagaagaagaagaagaagatgggagtttacactttcgtgtgcaaaagcaaaggcggagaatggaccgcgaagcaacacgagggtgaccttgaagcctctgcttcttccacttacgatctccagcgcaagcttgttcagactgctctctccaccgattcatccggcggcgttacgtcttctttctctctcgtctctcctacctcagctgtttgccaggtgatcatcggtggtgctgttggaggaggatttgctgccggaggaggtgcagcagctggaggaggcggtggtgcaggtgaggccgccgcagccactaaggaggaagagaagaagaaggaagaatctgaagaggaagaaggagactttggatttgacctctttggttaagagacgaacaaaatcctcttttgaagcttttagtttgttgttttccatttttcttttttcttctttttgagattgaactttttatgttaagagactatatgtaacgtcagaaatatatgttggtttctggtttcaaaaaaaaaaaaaaaaaaaactcgngncnanttcncncnnnnaaaaaaattaaaagttaagcttgagaagaagaagaagaagaagaagatgcattcggcgaaggaaaagatcagcgacatggccagtacggccaaggagaagctcaacatcagcgaagcaaaggctcaaggtcatgcggagaagacgatggcgaggacttcaaaagagaagaagatggctcacgagcgagagaagtctaaggaagcgcaggccaaggccaacctccaccaatccaaggctgaccatgcggccgatgctcagcttcacggccaccatcttcccggacactccacctaccctacccgatattaagattagcggtttagtttgcactggctatatatatatatatatatatatatatatatatatatatatatatatgatatgcatgcttttgcgtttttcttctaataaaaagaaattgaattttcttagttattttcttttaccttttggggggttgatttctgttgatattatatcgtatgcataaatcatattgatgtattctgtcgaaataaactt

SEQ ID NO: 1378 - DNA, 935 bp, Hordeum vulgare
gccgaccgacccgacccaaccatctcctctcatccgccgccgcctcccctgcagccgccccgccgtgccttaccgccagccaccgccgacccttcacccccccctctcaccccacccccctcgtactcgagcccatcgccgctctcgggtgccctcatcgtcacatcacgttcccgccgtctccgcccccgcagcaatctttggattttgaggaacacaccatggagatcaggccaatggtagccctgcgtgccgccctagtaggcggggtagctgcattcgcaaagatcgctggggcgatgaaagctgcaggcggcgtgaaggttggcgctgcggctgcagccatgacagctgcagcgacggccgctgtatccggaaaagacgctggtaatgataaccaaaagccgggggcaaaatgatacgtgccacggatttggtggagaggcagtgttctaaaatgcttctccatagtgtagaccagcatttcagcagtttatcagtgctgaagagctgcggaagctaattgtggccttcaggaggagaccgcattcacaataaataagttttgccagcgcaattcccatgatacatgtgttttttataaactcggggtataagaattatgatgccctgattttttgttcctgttgatgatttgctcccatgaccatgatacattatatcagcgctgaagtgccctgagactgtagtgtcaggcacaaaataccaggaccgttacggttctactccctctgttcctaaatacttgtagtcgaggaaaactatattagttcttctgaactacaagtatttaggtataaagatagtagtaagcacatgcatcttccagcatctgctcgcgacctatgcttgtactgtatctgtcttggctatgtgctgtgtttagacacttgcaatgataaattcctgagacg

SEQ ID NO: 1379 - DNA, 632 bp, Brachypodium distachyon
gcccttcctcctcgttcctcacccagtcagccacccccgacccaagtccctaaccctagccgccgcccgccggagcgccgcaccagtcaccggagttcctccaccgcgcgccgacaccactccgccagcgacctctccttcccatcacccgacgcggcgacgcttccatctcgccaccgcgcgccgacggaatatagcatggagatcagacccatggtagctctgcgtgctgccctagttggcggggtggcagcatttgcgaagatcgctggtgcaatgaaagctgccggaagcatgaaggttggtgcagccgctgcagctatgacagctgcagcaacggctgccgtatccggaaaagacacaaataaagagaaccaaaagcctggagcacaatgatgtatgccatgaatttactggagaagcacagtgcgtagagccgtagatgcatctccagagtgtagatttactttcagcaatttatcaagtgctgaagagttgcagaagctaattgtggctttcgagaggacaccgcaatcataataaataagtcgtttgagcaatttgtcatgatacatgtgctttagcttgaataagaattacattgtcgtgagttttcactctactgataattt

SEQ ID NO: 1380 - DNA, 634 bp, Cenchrus ciliaris
ctgaactctgaaggtcttcaccaggcgtccaggccgccgccgtcgtccgccgcgccgcgtgctatccgcccgccccacggcggccgaacacgcctgcaggcgtcctctccttcggtcggaatataccatggaggtcaggccgatggtagctctacgtgctgccctagttggcgggatcccagcatttgcgaagataggtggggcaatgaaaggtgcaggagaaatcaagattggtgctgccgctgctgctgtgacagcagcagcatcggctgccatttccggaaaagacacaagcaaagataatccaaaggctgaaacaaaatgatccagaggtcaagaagagaaaggatatcgtggtcaataaactactggagcagtttttgatgctctatgttgcttttttaatcttgggaataagaacggcagtgttgagttttccccaaattcttgtttactgcccatgcaatagttttggttgctcaatgtgatgagctccctgtaaggagcacacactgtatgcctaacctggtttcttctgccatactttgagccattatcagtttgccctgtgcaggtagatcctgaagctcttctgcagtttcatgtgtaaaatcctagtagttattttcagtta

SEQ ID NO: 1381 - DNA, 776 bp, Pennisetum glaucum
gacgctaccgtggaaccgaccattcgacgcatccgcctgaagtctccaccaggcgtccaggccaccgccgccgtccgccgagtggtatccgcccgccccaccgcggccgaacacgcctgcaggcttcccctccttcggtcggaatataccatggaggtcagaccgatggtagctctccgtgctgccctagttggtgggatagcagcatttgcaaagatcggtggggcaatgaaagctgcaggaggtgttaagattggtgcagctgctgcggctgtgacagcggcagcatcagctgccatttccggaaaagacacaagcaaagatactccaaaggcagaaacaaaatgaccagaggtctagaagagaaaggatgtcgtggtcaataaactaccggactaccggagcagtttttgatgctctatgtttcttttttaatcttgggaataagaataacagtgttgagtttccccccaaattatgatgtactgccatgcgaatgcgatagttttggttgctcactgtgatgagctacatgttactcacactgtatgcctgacctgattttttctgccatactgtgagccatgatccatttgccctgtgcaggtagatcctgaagctcttctgcagtttcatgtgtagaatcctagttatttgcagtgagaccagcttatgtacaattgaaggatctgtagactagaactagaagtaggatattttcaatgtaactccgcctctggctgtatttcttgtttcctggacatgccccttcaaat

SEQ ID NO: 1382 - DNA, 799 bp, Sorghum bicolor
ggagaagtaacggcccatatgcctccgcagtcagcacaaggcccgtgtctgcgggtgcgctcccctactgcagaaccgccccagataccaaactgttctcgccgcttgctctctctctcgctcggcgacgactgggataccaccgccaccggcgccctacagcaggtgtccaggtcttcgtcggtcccttctccggcatcgagcacccaccaggatataccatggaggtcagaccgatggtagctctgcgtgctgccctagttggtggggtagcagcatttgcaaagattggtggggcgatgaaagctgctggaggtgtcaaaattggtgcagctgctgcagctgtgacagctgcagcgtctgctgctgtatctggaaaagacgcaaaagaagacgcttcaaaggcagaaacaaaatgatatgacccatggattggtcgagaagtatgaaattgcctctccagaggttcaaaagagaaaggacgccatagtcattaagttacaggagcaatttttcactccatgtgtttttatcttaggaataagaatgacaatcgagttttccctaagtatgattttgtgccgtgcaacagtttcacttgttgaatgttagtcacactgtatgagtaacctgatttctgctgtgccgcattctgggtgcaatgcgcttgccatattctgtttgcaaaggaagattctgagaaggtcttgtgcagtttcttgcctaaaatcctagtgttttacatcagcatctgtataattgaagtatctcaaactgtagaacattgtaagttttactg

SEQ ID NO: 1383 - DNA, 782 bp, Panicum virgatum
gggcaacaagccaacaaggccgctccttcggcaccgcgacccgtctccctccctacgctcccccagcgcctgccgctctccacgaggtcggcccgtgcgccgccctccccctccacgctcccctgcccagctgcagctcggcctcccctcccttcccacgaattctctgttctttctctcggcctcggtcttcctttcatagcggcgactagagggcgagttgcgctgcccgttgttcgtcgagcgaggggcgcttcgccggcgacgaacatccgacagaggaatataccatggaggtcagaccgatggtagcgctacgtgctgctctagttggtgggatagcagcatttgcgaagatcggtggggcgatgaaagctgcaggaggtgtcaagattggtgcagcggctgcggctgtgacagcggcagcatcagctgcagtatccggaaaagacacaagcaaagacccttctaaggcagaaacaaaatgatatataccatggatttgtggagaagtatgaaattgcttctccagaggtctagaagagaaaggatggccgtagtcaataaactactggagcagtttttcatgctccatgtttttatttataatcttgaaataagaatgacagtgttgagttttccccaaattatggtaccccattcaatagttttggttgctcaatgtcacgagctacctgttactcacattgtattgtatgcttaacctgatttctgctgccatattgtgagggcaatgcatcgactatgatctgtttgcacta

SEQ ID NO: 1384 - DNA, 374 bp, Triticum aestivum
  misc_feature (139)..(139): n is a, c, g, or t
  misc_feature (141)..(141): n is a, c, g, or t
  misc_feature (144)..(144): n is a, c, g, or t
  misc_feature (146)..(146): n is a, c, g, or t
agggttcggaacaataccatggaggtgagaccaatggttgctttgcgtgctgccctagttggtggggtagcagcatttgcgaagattggtgcggcgatgaaagctgcaggaggtgcgaaggttggtgcagcggctgcangncanantggacagctgcagcaacagctgctgtatctagcaaagacacaaacaaagataatccgaagactgaaacaaaatgatatgtgccttacttagtggagaaaccctgtatggaaatgcctctccagagcttaatattttttttcctgaattgcacttccaccatcgctgaagagttgtataagctaattgcgacatctgaaatgatgtcataataagcaactagatgatca

SEQ ID NO: 1385 - DNA, 770 bp, Triticum aestivum
  misc_feature (326)..(326): n is a, c, g, or t
gcctcccatacagccgccgccgcgccgtgccttagcgccagccaccgccgacccttcagcccgctccccacccctcaccccacccccctcgtactcgcgcccatcgccgcccccggttgccctcatcgtcgcatcgcgttcccgccctctccgcccctgccgcagtctttgggtcctgaggaacacaccatggagatcaggccaatggtagccctgcgtgctgccctagtaggcggtgtagctgcattcgcaaagatcgccggggcgatgaaagctgcaggcggcgtgaaggttggtgcggcagctgcagccatgacagccgcagngacggctgccgtatcaggaaaagacgcgggtaatgataaccaaaagccgggggcaacaaaatgatacgtgccacggatttgctggagaagcagcgttctaaaatgcttctccatagcgtgtagaccagcattcggcagtttatcagtgccgaagagctgtggaagctaatcgtggccttcgggaggaggccgcattcgcaataaataagttttgccagagcaattcccatgataatacatgtgtttttgtaactcggggtataatgtcccgattttttcttcctgttgattgttttgctcccatgatacattatcagtgctgaactgccctgaaactgtagtgtcaggcaccaaattccaggaccgtgccagtgctaattcctcagtaaacggttctagtaagcacatgcatctctcagcatttggtcgcggccaaaaaaaaaa

SEQ ID NO: 1386 - DNA, 1117 bp, Hordeum vulgare
acacttcgctcttcacacacagccaagatccacagagatgatccgagcgatgcaggtcgtcgtcaggggggagatccgccgggcagcggtggctggcgctggcttcgtcggacactgcggctactccaccgtgatcaccagctcccagaggttggctgggaaggtggccgtcatcaccggcggggcaagcggcatcggcaaggcgacggcggccgagttcgtcaggaacggcgccaaggtcatcctcgccgacgtccaggacgacctgggccgcgccgtggcggccgagcttggcccgaacgcggcatgctacgcgcgctgcgacgtgaccgacgaggcgcaggtcgccgcggcggtggacctcgccgtggcccgccacggcaagctggacatcatgctcaacaacgccggcatcatgggctccctggcgcgtccccggctgagcgacctcgacctcgccgacttcgacgccgtcatggccatcaacgcccggggtgtgctggcgggggtgaagcacgcggcccgcgtcatggcgccgcgccgcagcggcagcatcatctgcatggccagcgtcgccggcgtgctgggcagcgtgacgccgcacccgtacagcgtgtcaaaggcggcggtgttgggggtcgtgcgcgccgtggccggggagatggcgcgctccggcgtgcgcgtcaacgccatctcgcccaactacatcccgacgccgctggtgatgcgtatcctggagcagtggtacccgaaggccagcgccgaggagcaccgccggatcgtggaggaggacatcaacgagatggagggcgcagtgctggagccggacgacatcgcgagggcggcgctctacctggcgtccgacgaggccaagtacgtcaacgggcacaacctcgtcgtcgacggcgggttcaccgtggggaaggcgcccaacatgccgccggcgccggcgctgtgaaacgaagcgagcacttgaaataaattaattggcgttgtattgcaccagaaccatcgagctcgagctgtaaaacgaagcgagcttgagcttgagcttgagcgtttttcgaaagcaagagcatctacaacggctgcataaaaatttcgctatcaataaaaa

SEQ ID NO: 1387 - DNA, 1001 bp, Hordeum vulgare
acttcgctctttacacaccgccaagatccacagagatgatccgagcgatgcaggtcgtcgtcagtggggagagccgccgggcagcggtggctggcttcggcttcgtcggccactgcggctactccatggcctcgagctcccagaggttggctggcaaggtggccgtgatcaccggcggggccagcggcatcggcaaggcgatggcggccgagttcgtcaggaacggcgccaaggtcgtcctcgccgacgttcaggacgacctgggccgcgccgcggcggccgagcttggcccgaacgcggcatgctatgcgtgctgcgacgtgaccgacgaggcgcaggtcgtcgcggcggtggacctcgtcgtggcccgccacggcaagctggacatcatgctcaacaacgtcggcatcgtgggctccctggcgcgtccccggctgagcgacctcgacctcgcggacttcgacgccatcatggccatcaacgcccggggcgtgctagccgggatgaagcactcggcccgcgtcatggcgccacgccgcagcggcagcatcatctgcatggccagcgtcgccggcgtgctgggcagcgtgacgccgcacccgtacagcgtgtcaaaggcggcggcgttgggggtcgtgcgcgccgtggccggggagatggcgcgctccggggtgcgcgtcaacgccatctcgcccaactacatcccgacgccgctggtgatgcgtatcctggagcggtggtacctgaaggccagcgccgaggagcaccgccggatcgtggagggggacatcaacgagatggagggcgccgtgctagagccggacgatatcgcgagggtggcgctgtacctggcgtccgacgaggccaagtacgtcaacgggcacaacctcgtcgtcgacagcaggttctccgtggggaaggcgcccaacatgccgtcggcgccagcgctgtaaaacgaagcaagcacttgaaataaattaattcgcgttgtattgcaccag

SEQ ID NO: 1388 - DNA, 1086 bp, Pseudoroegneria spicata
caggggggagagccgccgggctgcgctggcgtcggtggccggctacgtcagccactgcggctactccacggcctcgagctcccagaggttggccggaaaggtggccgtgatcaccggcggggccagcggcatcggcaaggcgacggccgcggagttcgtcaggaacggcgccaaggtcgttctcgccgacgtccaggacgacctgggccgcgccgtggcggccgagctcggcccggacgcggcatgctacacgcgctgcgacgtcaccgacgaggcgcaggtcgccgcagcggtggacctcgccgtggcccgccacggcaagctggacatcatgctcaacaacgccggcatcgtgggctccctggcgcgtccccggctgagcgatctcgacctcgccgacttcgacgccgtcatggcgatcaacgcccggggagtgctggccggggtcaagcacgcggcccgcgtcatggcgccgcgccgcagtggcagcatcatctgcatggccagcgtcgccggcgtgctgggcagcgtgacgccgcacccgtacagcgtgtccaaggcggcggtgctggggatcgtgcgcgccgtggccggggagatggcgcgctccggggtccgcgtcaacgccatctcgccaaactacatcccgacgccgctggtgatgcgcatcctggagcagtggtacccgaaggccagcgccgaggagcaccggcggatcgtggagggggatatcaacgagatggaaggcgcggtgctggagccggatgacatcgcgagggcggcgctgtacctggcgtccgacgaggccaagtacgtcaacgggcacaacctcgtcgtcgacggcgggttcacggtggggaaggcgcccaacatgccggcaccggcgctgtaaaacgaagcgagctcttcgaaataaatttacttcgtgttgtattgcaccagaaccatcgggcattgcgtttttgtttcagaattgcaacaaggaattgtcctcgatgtatctggcatttggactctttgtcctcttcttctgctgtaaaattcacactcctaaagggttagaaagaaaatgtagcaactattaca

SEQ ID NO: 1389 - DNA, 1121 bp, Pseudoroegneria spicata
aagcagaagctcggcagatcggcaagatgttccgagcgatgcaggtcgtcctcaggggggagagccgtcgtgctgcatcggcggcgggggctggcttggccggccactgcggctactccacggcatcgagcgcccagaggttggctggtaaggtggccgtgatcaccggcgctgctagcggcatcggcaaggcgacggccgcggagttcatcaggaacggcgccaaggtcgtgctcgccgacgtccaggacgacctgggctgcgccctggcagccgagctcggcgctgactccgcgtcctacacccgctgcgacgtcaccgacgaggcgcaggtggcagcggtggtcgacctcgccgtggcccgccacggcaagctcgacatcatgctcaacaacgccggcatcgtgggctccctggcgcggcccgagctgggcgcgctcgagctcgcggacttcgacgccgtcatggcgatcaacacccggggcgtcatggccggggtcaagcacgcggcccgcgtcatggcgccgcgccgcgcgggcagcatcatctgcacggccagcatcgccggcgtgctgggcagcgtgacgccgcacccgtacagcgtgtccaaggcggcggtggtggggctcgtgcgcgccgtggccggggagctggcgcgctccggggtgcgggtcaacgccatctcgcccaactacatcccgacgccgctggtgatgcgcatcctgcaggagtggtacccgaaggccagcgccgaggagcaccggcggatcgtggagggggacatcaatgagatggaaggggtggtgctggaggtggaggacatcgccaaggcggcgctgtacctggcgtccgacgagtccaagtacgtcaacggccacaacctcgtcgtcgacggcgggttcacggtggggaaggtacccaacatgccggcaccggcacagtaaggaacacgatcagaatcagctgacgaatacatcgtatggcttctcggcgatgtcttgtgcaattatgagtgtcgtattgctgtaccgaaacaaatctatttatttcttcagaattgcaaaagaaaaccttcgtgatgaatgaattgtatcagtttaaatatatcgtagtgaactcca

SEQ ID NO: 1390 - DNA, 944 bp, Oryza sativa
gttcatagcgcagtgataaatgaagaagcagaagagacagatcaaagatcaagatgttcagagcattgcagatcgtcctcaggggtaagagccgaggatttgtcagtcacttctcctccacggcttcaaattctgaaaggttggctgggaaggtggcggtgatcaccggcgcggcgagcggcatcggcaaggcgaccgcggcggagttcgtcaggaatggcgccaaggtcatcctcgccgacgtccaggacgacgtcggccgcgccgtcgcctcggagctcggcgcggacgcggcgtcgtacacccgctgcgacgtcaccgacgaggcgcaggtcgcggcggccgtggacctcgccgtggcgcggcacgggcagctcgacgtcatggtcaacaacgccggcatcgtgggctccctgtcgcgccccccgctcggcgccctcgacctcgccgacttcgacgccgtcatggcggtgaacacgcgcggcgtcctcgcgggcgtcaagcacgccgcgcgcgtcatggcgccgcgccgccgcggcagcatcatctgcgtggcgagcgtcgccggggtgctcggcagcgtgacgccgcacccgtacagcgtgtccaaggccgccgtgctcggcgcggtccgcgccgccgccggcgagatggcgcgctccggcgtgcgcgtgaacgccatctcccccaactacatccccacgccgctggtgatgcgcatcatggcggagtggtaccccggggcgagcgccgacgagcaccgccgcgtcgtggagcgggagatcaacgagatggagggcgcgacgctggagcccgaggacatcgcgagggcggcggtgtacctggcctccgacgaggccaagtacgtgaacggccacaacctcgtcgtcgacggcgggtacaccgtcggcaaggcgcccaacctgccggcgccgccgcaataa

SEQ ID NO: 1391 - DNA, 1055 bp, Triticum aestivum
  misc_feature (321)..(321): n is a, c, g, or t
  misc_feature (445)..(446): n is a, c, g, or t
  misc_feature (638)..(638): n is a, c, g, or t
  misc_feature (994)..(994): n is a, c, g, or t
  misc_feature (996)..(996): n is a, c, g, or t
  misc_feature (998)..(998): n is a, c, g, or t
  misc_feature (1022)..(1022): n is a, c, g, or t
  misc_feature (1025)..(1030): n is a, c, g, or t
  misc_feature (1032)..(1032): n is a, c, g, or t
  misc_feature (1035)..(1036): n is a, c, g, or t
  misc_feature (1038)..(1039): n is a, c, g, or t
  misc_feature (1043)..(1043): n is a, c, g, or t
  misc_feature (1049)..(1049): n is a, c, g, or t
  misc_feature (1053)..(1054): n is a, c, g, or t
ggcacttcgccaagatccacaaagatgatccgagcggtgcaggtcgtcaccagtgttgagagccgccgggctgcgcgggcgtcggtggccggctacgccagccgctgcggctactccacggcctcgagctcccagaggttggctggaaaggtggccgtgattaccggcggggccagcggcatcggcaaggcgacggcggaggagttcgtcaggaacggcgccaaggtcgtcctcgccgacgtccaggacgacctgggccgcgccgtggcggccgagctcgggccggacgcggcatgctacacgcactgcgacgtgaccgangaggcgcaggtcgccgcggcggtggacctcgccgtggcccgccacggcaagctggacatcatgctcaacaacgccggcatcgtgggctccctggcgcgtccccggctgagcgatctcgacctcnncgacttcgacgccgtcatggcgatcaacgcccggggcgtgatggccggggtcaagcacgcggcccgcgtcatggcgccgcgccgcagcggcagcatcatctgcatggccagcgtcgccggcgtgctgggcagcgtgacgccgcacccgtacagcgtgtccaaggcggcggtgctggggatcgtgcgcgccgnggccggggagatggcgcgctccggcgtgcgcgtcaacgccgtctcgcccaactacatcccgacgccgctggtgatgcgcatcctggagcagtggtacccgaaggccagcgcggaggagcaccggcgtatcgtggagggggacatcaacgagatggagggcgcggtgctggagccggacgacatcgcgagggcggcgctgtacctggcgtccgacgaggccaagtacgtcaacggccacaacctcgtcgtcgacggcgggttcacggtggggaaggcgcccaacatgccggcaccggcgctgtgaaacgaagcgagctctttgaaataaatttacgtcgtgttgcattgcaccaaanananaatacgtagtagtattgtattgcnccnnnnnnanaannanngagnattgtnttgnnc

SEQ ID NO: 1392 - DNA, 1581 bp, Hordeum vulgare
cacgaggcacagccccacccactttctttccccttctttcttctcggcggaggcggaggcggaggcggaggcgacaggaaggcgaaggaggaaccctagccgcgcgaggaacaaggaacgcccagatccgcaaggccggcgacgatggcggcggttcgatgcgcggcgaggaggctcggtggcgccctgctccagcgaacgcaggcggaggagggacgcctgctcgcgccaagcaggctcatgcgctcccgccacctctccaccaaggtctccggcgaggctcgcaacatccagaagaaaggggatgacatctgggcggggttcaaagagacgttaaagagggtgtcggagcgccccccagaaaagaagccaaatgtccttctgcagcgcatgatgttgatcgaacaagtgactaagagtgtggtctatggagctttcaagctgacagttgtgtatgcggctgctgctgctgctttcggtggccgttggctagaaaactagcctaggccgttaccaaggaaaaccagtgaagacaagatgaagaaatgagaaccaaagatggcccccagcttgtttttctgtttaattatgacccatgtagtttggccagctaggcactatgctatggtacgctgtgatattacatctcctatctactattccagcagattatgcaggaaactgtagcttgaagtgaacatacttgcatagcttctaaggtcactgacatgcattgttgggcttctgtctagtgcttctggatcgaagtgtttgcaatcaacttagaagtgttcgctctctgaaactaattgtgtgacgtcttgtatagatcctttcactttaatgactgccatgtgtttttcctgtctccaagggcaggctactcaaaaaaaaaaaaaaaaaaaaaaaaaaaagaaaaaaaaaaaaaaaaaaaaaaaaaaaaaaaataataaatattaaaaaaaaaaaaaaaaaaaaacctcgtgccgattggtcccaaggacccccctgggcggtattgcggcacctctaacctgcggctggaccgagacaatggctcctataaggaggcctactgcggccccttttttcccggggcttatattatgggatctgggccctgagcttttgggcagtgtgaggcctggacctataggtggaatgtgacggtctagaaaagttattttatggaaaaaatgagactagatatcatatatgccaaagaagagttgaaccatgagagcggaagggtgaagacacaggagatagaagcatcaggtaaaggagtggatatgcgacttgtaaccacttcgtgagagagggaggagagatcgaattttgtgtatgtagaacataattacagagcgttttatggcgatcggaagctgttgtacttagatttaatacatataccaaatagtaacggagactgagatttagactacgacataaattgtagcacgaatagctgcgtattgtattgtgcattcgggttaggtgtttgggttctattttcgtggcttgtgagagtgtagaggcagacgcggcggatgcgcagatgttgtagtagggacggtatgg

SEQ ID NO: 1393 - DNA, 672 bp, Triticum aestivum
  misc_feature (338)..(338): n is a, c, g, or t
gttcatcccaacaaagcgtgtcaaacctctccctcaagtgttgtcccaatacccactacctcttctctccaccgtcttcttcagctctctcgagcggaaggaaaaggtctcatggagggcctcatcccgttcatctacagggccgtggcgcagtacaggaaggaggggcaggtctccctcgccgacctcctcttcgacgagcagccgtcctcgtcgcccacggcggcctcggcctacttccgcctccccggggactccggccggcaccagcgcgtctcggccgactccggcgcaccgtcggcgcaccatggagcacggatcgtggtgaccgattgtgnttgaagcgcagaaaggccaataataaaggaaacagagcgaagcaggtgaagacttgcctaggtacgtcgtcgagtacatgcagatacgatgtcgattgctgagcctagctaagctaacacgagcttcagacctgcagtttatgtgtgctatacatgcatatatttgtatttcagttcagcctgtaacgagtcggtgagtgtcaactgtaaatatgggatgcacaagcgcaggacctccgaaggaggactgtgaagaagatgtatagtgtcagagtccatacatatacatggagtgtaatatggcaataaaagcttcaccatgtacaaaaaggtt

SEQ ID NO: 1394 - DNA, 765 bp, Triticum aestivum
aagtgttgtcccaataaccactacttctctccaccatcttcttcggctctctcgagcgaaagcaaaaggtctcatggagggcctcatcccgttcatctacagggccgtggcgcagtacaggaaggaggggcaggtctccctcgccgacctcctcttcgacgagcagccgtcctcgtcgcccacggcggcctcggcctacttccgtctcgccggggactccggccgccaccagctcttctcggccgactccggtgcggccggagcggcgcggcggtctccgccgcaccgtcggcgcaccatggagcatggatcgtggtgactgactgtgattgaagcgcagaaagtcatccaagggataataagaaaacaaagcaaagcaggtgaagacttgcctaggtacgtcgtccagtacatgcagatacgatgtcgattgctgagcagctgcacgtattggcctagctaagctaatacgagctgcagacctgcagtttatgtgtgctatacatgcatatatttgtactatttcaattcagcttgtaaaatgatcggtccgtgagttggtgggtgtcaactgtaaatatgggatgcacaagcgcaggacctccgaaggaggcctgtgaagaagatgtatagtgtcagggtccattcatggagtgtaatatggcaataaaagcttcaccatgtacaaaaaggttatgtacacgcacacatgactgcttgctgcaagactgcaaaagaagcgagtgtcaagtatcaagattgcct

SEQ ID NO: 1395 - DNA, 677 bp, Triticum aestivum
  misc_feature (471)..(471): n is a, c, g, or t
agcgtgtcaaacctctccctcaagtgttgtcccaataaccactactacctctctccaccgtcttcttcagctctctcgagcgaaagcaaagggtgtcatggagggcctcatcccgttcatctacagggccgtggcgcagtacaggaaggaggggcaggtctccctcgccgacctgctcttcgacgagcagccgtcctcgtcgcccacggcggcctcggcctacttccgtctccccggggactccggccggcaccagcgcttctcgggcgactccggtgcggccggagccgcgcggcggtctccggcgcaccgtcggcgcagcatggagcatggatcgtggtgattgattgtgattgaagcgcagaaaggccaagaataaaggaaacagagcgaagcaggtgaagacttgcctaggtacgtcgtcgagtacatgcagatacgatgtggattggtggaaacctcaagtattgncctagctaagctaatacgagctgcagacctgcagtttgtgtgtgctatacatgcatgtattggtatttcaattcagcttgtaatgattgtcaactgtaaatatgggatgcgtaagcgcaggacctccgaaggagtcctgtgaagaaatgtatagtgtcagagtccattcatggagtgtaatatggcaataaagcttcaccatgtac

SEQ ID NO: 1396 - DNA, 1884 bp, Triticum aestivum
gcacgagttaaaacctccctaaaaaaaagatactaccccgaagatgtcaaaataaaacacgagcacagtgcccatcccctccgctcccccctcccccctccgcctccccgcgctcgaatcctctgcggttaacaatggacgcgcagtacaaccccaggacggtggaggaggtcttccgggactacaagggccgccgcaacggcctcgcccgcgcgctcaccaccgatgtggaggaattcttccggcaatgcgacccggaaaaagaaaatttgtgcctttatgggtttcccaatgagcattgggaagtaaacttacctgctgaagaagtgccacctgagctcccagagccagcattgggcatcaactttgcacgagatggaatgcaggaaaaagattggctatccatggttgcagtacacagcgacgcatggttactatctgttgcattctactttggtgctcgattcggatttgataaaagtgacaggaagcgcctgtttggtatgattaatgagcttcccacgatttttgatgttgttagtgggaagagtaaaaccaaggctccgaccaacaataaccacagcaatagcaaatccaagtccaacaataaaatgaaaacctcggagcctcgggcgaagcagcccaagccccagctgaaggaggaagatcacgaggacgaagcccctgatgcgggcgaggatggtggaggcgccgccggtggtggtggtggcggggaagagcacggcgatacgctgtgcggcgcgtgtggggacaactacgggcaggacgagttctggatcggctgcgacatgtgcgagaagtggttccacggcaagtgtgtcaagatcacgccggccaaggcggagcacatcaagcagtacaagtgcccgtcgtgcatgggcgccaacggcggcggcagcggcagcaacaagcgggcgcgcccgtcctcctaaggccgtcgccgtcatccggcgaggggcgaccgaccggcctcgccgtgtagtaggactgagctcttattgcagtcgctgtaacaaaagtttccaggcgtcaaggcgcgtgcccttaggagggcttgtaaaatgtaactttattaatctggcttcgagtagaggattcttcttattttagctgggacgaatgtggatttgatatctgttgtattatactattattaaattcatagttcaacgatgattgtttaaaaaaaaaaaaaaaaaaaaaatcgactcaagcaacgcagcgagacgagaccaaaccatggcggccaaccaccacctccgccgcctcgcctccgcgtcggcccccgctctctcccgcctctccaagccccctccctcgccgctcctccgccccgcgttctccagctccgcctcccccgcggatcagccggcggcggcggcgggcgccgctgcagccgagaagggggaggcccagagcgccgtgaaggaggcggacgaggcgcagggcggtggtgctggcgcgcggaaggcgggggaggaggaggatgatgacggcggcctggacataaacgaggcaactggcgagatcggcggcccgcatgggcccgagcccacccggtacggcgactgggagcgcggcggccgctgctctgacttctgagcaaccgctgccaactgggagggtaaaaacttgctctcggattcgttctaagctgtaatcataaggatatggcatgggcatggcatggtggttctgttttactctgctgggggaataaatcttgttgttatactgaacatgattctgaagtttcagagtactgtaccatcttagcatgtatctaagctttctaagttctctctctgtatgaatttttttgagtggtagtaactgattgtttgtttagtttgaaaaaaaaaa

SEQ ID NO: 1397 - DNA, 548 bp, Triticum aestivum
gagacgagaccaaaccatggcggccaaccaccacctccgccgcctcgcctccgcgtccgcccctgctctctcccgcctctccaagcccactccctcgccgctcctccgccccgcgttctccagttccgcctctcccgcgggtcagccggcggcggcggcgggggccgatgcagccgagaagggcgaggcccggagcgccgtgaaggaggcgggcgaggcgcagggcggcgatgctggcgcgaggaagacgggggaggaggaggaggatgacggcggcctggacataaacgaggccacgggcgagatcggcggcccgcacgggccggagcccacccgctacggcgactgggagcgcggcggccgctgctccgacttctgagcaaccgctgccagctgggagggtaaaagcttgctctcggattcgttctaagttgtataatcataaggatatggcatggcatggtggttctgttttactctgctgggggaataaatcttgctgttatactgaacataattctggagtttcagagtactgttccatctta

SEQ ID NO: 1398 - DNA, 2530 bp, Brachypodium distachyon
gaccccgtctccccagatcagcaaggagcttgcttgggtctcgtgacagcaatccctgcctgctcggctgctctcgctttgcaccctctgctgcctcccatgaggagcacaccaccctcagattgattcccaagcagtactccttcatatcttctgggctgttcctgggctggtgaaggagcgctgagtggtgtgcacgcctcctcggccgtccatctgttgaaccaggaaggtcaatcaaaatttgattcgggaactttgcagttgcttctacatagatatccatgcctttgcagtaatcttgacaagtgtgcagtcataactgtgaaatgtccaattattactcgagcccgggcaatgaaagagactcacaaaccatgtactcgcctgactcgggcagtgcatcatatcctgtgtcctcagcagccctagggaacttgatttattcaaacaatgcatcttctggaccatatacagaattcaatggcattatccagtctcatcagaatttcatggagctgtctggccatccttcagaaatctcacaccattcatcgtcaacggaacctaacatggtcacttcacttacggatcaacactcctttggtcctgccaaagatatgagaaatgaaatgttaacacatttcatggatggcgcacacagcactggtggtgatctcctccacaatgatacccacaacggtgcgcagctcgagtttggcctgttgaacagccacaattcgacaagtgttccatcagcaccaggccaaggattgtctctgggcctccacacccatatcctggcaccttcatacccatactggtccatgaagccagacttaatggcagcacagtcttaccagggtgatcacaacattacgaaggatatgcagtcagaggcctcacgggcaatcaggaactcaaaatatttgaaggcagcacaagaattgctcgatgaaatcgtcagtgtttggaagattataaagcagaatgcacagaaagaccaggttgaaacaggaaaagtggatggcaaagaggctcatggggtgtcaaaaagcgagggattatcttccaacccacaggagacaactgccaatgcggcagctgagatctctgcagctgagaaacaagagctccagaataagatggcgaaacttttggcgatgttggatgaggtggaccgaaagtacaagcattattatcatcaaatgcaaattgtagtctcatctttcgatatggttgctggatctggagctgccaaaccttatactgcagttgcccttcagacgatttcacgacatttccgatgcctgaaggatgctatcagtgaccaggtcaatgttatccgaaagaaacttggcgaggaggagaattcatccggcagagagggcaaattaactcgcctccgttacattgatcagcagttaaggcaacagcgagcttttcaacagtatggtatgttacagcaaaatgcttggaggccacagagggggcttcctgaaaactcagtatcaattctccgtgcttggctatttgaacacttccttgacccgtatccgaaagattccgaaaagctaatgctagcgaggcaaactggtttaacaagaagtcagatttcgaactggttcataaatgctcgtgtccgcctctggaaaccgatgatcgaagacatgtataaagaagagacaggggatgcagagcttgactcaaactcctcttctgagaatgtaccgagaagtaaggacaaagtggcatcttctgaggaaatgcaagatctgaaatgctctatgctggctgaatctaaaggcaactttgggatggtggatctaactggagcaccgaccagcttccacaatgaggtgaactctgatgacggcttcatgaacctattgttgaaggaccaaagacctggcgagacggatgccagtctcctccatgatgccattgctcatcactccgatgagagcgcgcggttcatggcctaccatttggcagagcttgggggaaacggaaacagcaatgtgtcgttgacgctgggcctacagcataccgagaacagtctttcagccccaaacactcaccagccaggttatgttgccgtcagggaagaggacatctacaacaccacagctcctccaggtgttgccactgcctctacagactatgaatcgacgaaccaaatggatcaacgccaacggttcaaacagtcgcctctactgcatgattttgtggcctagatgctcattgacaaagattggatgataatcatttgtaatctattgtgccagaataacatgcctaaaaatcattgaaattgtagcactagttgcagttggtacagaagagagggtatagcatgaagtgtattatgtattataaaatttaggttggtggagtaaataatcttgtagagatgaacggaaatgccattatacatgtgaaatattatgattgaagaaccatcctgtaaacaaaaagacctgtaatggatacttatggtccagttatatattgtgcagccggtttaacc

SEQ ID NO: 1399 - DNA, 849 bp, Zea mays
agtccgttttcaaccctactacgcctcggaatcagaggaaccgaacggtggaagagtacgcctcggaatcagaggagcagcgaggaagctgaaggaggggcgaatctaagcccaattgaagcatgagggcgtcgattaatcgtcccccgacgccgagcgcggaggaggatcgggacaagcagccttctctcggagagatcattaacatcaagttggtagagactggggagaaggagaagctaatggagctactccgcgagcgactcgctgagtgcggctggagggatgagatgaaggcactctgcagggcctatgcaaggaagaaaggaagaaataatgtgacagtagatgacctcattcatgttattactccgaaaggaagagcatccgtgcctgattcagtgaaggcagaactcctgcaacgcatccggtccttccttatgtctaccacacttcggtagtcatttgtcgcgacggttggagcctatatgtaccattgtaggatcattgggaagtcgatcttgttggggaccaaaggtgcaggaaagcagtgcgtaggggaatattgtgagcatgaaaagaaacagtgtgatcttcatgacactgtcgacatgttcctcgtcaggcgcaggcggttggcgtaatttcaggtgtaccaatagagttgtaagttgtaacccctgaatactgtattgttaaagcaaccttccaccttgtaatgctacattgtactataactgctcagcgctgatgcttaatttcacaattagaaaacagaaacgcaatcttgatatagatgataacacgcatgtgaaacctgaaaccctgactgggtcatcttcaattgtt

SEQ ID NO: 1400 - DNA, 667 bp, Pennisetum glaucum
gacgacgaagaagaagaaaccaagcagcagcgacagcgagggagcaagaggagggcgcaccaaccctaattcaagcatgagggcgtcgattaatcgtccgccgacgccgagcgcggacgaggatcgggacaaggagccctccctcgaagaagtcatcaacatcaagttggtagagagtggggagaaggagaagttaattgagctcctccgtgagcggctcgtcgagtgcggctggagggatgagatgaaggcgctatgcagggcctatgcaaggaagaaaggaagaaataatgtgacagtggatgatcttattcatgttattactccaaaaggaagagcatcagtgcctgattcagtgaaggcagaactcctgcagcgtatccggtccttcctcatgtctacctcacttcggtagccatttatcatgacggttagagcagcatgtaccattgtacgagtattgggggggtctgatcttgttgggaccaaaggtgcataaaaacagtgcatgtggcaatattgtgagcatgaaaaagaacagggttatcttcgtgatgctgcccacatgttccttgatcagataggcagttggtgcgattttcaggtgtaccaagacacggggttgtaatccttgaatatattgttaaagtaagtaaggaacctcagc

SEQ ID NO: 1401 - DNA, 938 bp, Sorghum bicolor
atgagccatgagcccatgaggtgacaggacgcactcccccaccaccaaaccgaggaggaagacgacgcccaggaaccggaggagcagaggaagctggaggagggcaagcgcatctaaagccggatcgaagcatgagggcatcgattaatcgtccgccgacgccgagcgcggaggaggatcgggacaaggagccttctctcggagaaatcattaacatcaagttggtagagagtggggagaaggagaagctaatggagctcctccgcgagcggctcgtcgagtgcggctggagggatgagatgaaggcactctgcagggcctatgcaaggaagaaaggaagaaataatgtgacggtagatgacctcattcatgttattactccgaagggaagagcatcagtgcctgattcggtgaaggcagaactcctgcaacgaatccggtccttccttatgtctaccacacttcggtagtcatttatcgcaacggttggagctacatgtaccattgtacgaacattgggaggttgatcttgttggggaccaagggtgcaggaaaacaatgtgtagggcaatattgtgagcatggaaagaatcagtgtgatcttcatgacactgcgacatgttcctcgtcagacaggcggttggcacaatttcaggtgtaccaaatacacttgcaatccttgaatactgtattgttaaaggaaccttccaccctgtaatgctgcattgtgttatagttgctcaactgatgcttgatttcacaattaaaaaacaaaaaaacacaatccggatatgaatgataaaacccatgtgcatcatgtgaaacctgaaaccctggctgggttatcttcagtggggcccaacgtgaacagattccactttgtcattgtgttgtgatacccgtgggttctataatatatgtcattcgttcgttggttc

SEQ ID NO: 1402 - DNA, 675 bp, Saccharum officinarum
  misc_feature (461)..(461): n is a, c, g, or t
cacgacgctcaggagtcggagaagcagctaggaagctgaagaagggcgcattaagccgaattgaagcatgagggcgtcgattaatcggccgccgacgccgagcgcggaggaggatcgggacaaggagccttctctcggagaaatcattaacatcaagttggtagagagtggggagaaggagaagctaatggagctcctccgtgagcggctcgtcgagtgcggctggagggatgagatgaaggcactctgcagggcctatgcaaggaagaaaggaagaaataatgtgacggtagatgacctcattcatgttattactccgaaaggaagagcatcagtgcctgattcggtgaaggcagaactcctgcaacgaatccggtccttccttatgtctaccacacttcggtagtcatttatcgcgacggttggagctacatgtaccattgtacgaacattaggaagtngatcttgttggggaccaagggtgctggaaaacaatgcatagggcaatattgtgagcatgaaaagaatcagtgtgatcttcatgacactgtcaacatgttcctcgtcagacaggcggttggcgtgatttcaggtgtaccaagacagagttgtaatccttgaatactgtattgttaaaggaaccttccaccttgtaaggctgcattgtgttataat

SEQ ID NO: 1403 - DNA, 886 bp, Panicum virgatum
ggagtcggcggctcccaaaacattgattaggtgacaggacgcactccacccaaaaccgaaggaagaagacgacgcccacgaaacaaagcagcagcgaggggaggaagcaagaggagggagggcgcatcaacccgaattgaagcatgagagcgtcgattaatcggccgccgacaccgagcgcggaggaggatcgggataaggagccctcccttgaagaagccatcaacatcaagttggtagagagtggggagaaggagaagttaatggagctcctccgtgagcggctcgtcgagtgcggctggagggatgagatgaaggcgctctgcagggcatatgcaaggaagaaaggaagaaataatgtgacagtagatgatcttattcatgttattactccgaaaggaagagcatcagtgcctgattcagtgaaggcagaacttctgcaacgtatccggtccttcctcatgtctacctcacgtcggtagtcatttattgtgagtgttggagctacatgtaccattgtacgaatactgggaagttaaccttgttgtggaccaagggtgcagtaaaacaatgcatatggcaatatcatgacatgaaaagaataagattgatcttcatgaggctgtccacatgttccttggtcgttagcgtgatattcaggtgtccaagacacgggggttgtaatccttgaatactgtatttgttaaaggaacctgagcttgtaatgctacacagtgttattatcgctcaattgatgcttgatttcacaattaggaaactggaatatctagatataaatgataatatccatttgaaaactggaacctgattgggtcatctccagtggggcccaacgtgaatcgattccactttgtcattgtgttgt

SEQ ID NO: 1404 - DNA, 803 bp, Panicum virgatum
attgatgaggttgacaggacgcactccacccaaaccgaaggaagaagacgacgcccgcgaaacaaagcagcagcgaggggaggaagcaagaggagggcgcatcaactcgaattgaagcatgagagcttcgattaatcggccaccgacgccgagcgcggaggaggatcgggataaggagccctccctcgaagaagccatcaacatcaagttggtagagagtggggagaaggagaagttaatggagctcctccgtgagcggctcgtcgagtgcggctggagggatgagatgaaggcgctctgcagggcatatgcaaggaagaaaggaagaaataatgtgacagtagatgatcttattcatgttattactccgaaaggaagagcatcagtgcctgattcagtgaaggcagaactcctgcaacgtatccggtccttcctcatgtctacctcacttcggtagtcatttatcctgacggttggagctacatgtaccattgtacgaatactgggaagttgaccttgttgtggacaagggtgcaggaaaacaatgcatatggcattatcatgacatgaaaagaatcagattgatcttcatgaggctgtccacatgttccttggtcagacaggtagttagcgtgatattcgggtgtccaagatacggtggttgtaatccttgaatactgtatttattaaaggaacctgagcttgtaatgctacagtgttattatcgctcaaccgatgcttgatttcacaattgggaaactgaaatatcttgatataaatgataatgtccatgtgaaacctgg

SEQ ID NO: 1405 - DNA, 1122 bp, Zea mays
ctaatcaaaaatcgctcactacgcgaccgctagctactcgatcggatcctgaccacgcccgcctaccagaccaccaccaccaccaccaccaccacccacaaatccccaatggcgaggcgcatcgccgtggcggcagcgttcctggcgctggccgtggtggctcccgccgcgctggcgcaggctcccgggcccgcggcgacgccgagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaagcgcccgccgccgcgcccgccgcgtcccaggggaagcccaagaagggcgggtcctcggacgctccctccgggtcggccggctccgacgacgccgcgccaacgggcgccgctggcgccagggccgtcggctggagcttcgccggcctcgccgccgtccttggctccctgttgtgaaagtgagaccgtgcgtcgtttctagggacggacggacgacaagctagttgaagatgagaatgccatgcccggggccgggcatgggcgccttcttccatttccatctttgtctgagattgtcagtggccgtgttcccttccccttctttctctctgttttatttaaacttctttcatctcgctagtttctttaatttgtactattggtggtttgtaagattggcttatgtgattcaatttatgcgcctgccgctgttgatactgc

SEQ ID NO: 1406 - DNA, 1146 bp, Sorghum bicolor
gctacagctgctttctactctcgtcgatctccacactccactacgcccacccaccacccacaaatccacaacacaatggcgaggcgcatcgccgtggcggcggccgcgttcctagcgctgtcggccgtggttccggcggcgctggcgcaggctccaggccccgcggcgacgccgagcgggccgccgaacgtgacggcggtcctggagaaaggcgggcagtacacgatgttcatgcggctgatgaaggagacgcagcaggacacgcagctcaacagccagctcaacagctcgttcgccagcaacggcggcgggtacacggtgttcgcgcccaccgacaacgccttcaacagcctcaagcccgggacgctcaactcgctgacgcagcagcagcaggtggcgctggtgcagggccacgtcctgccccagttctacagcatggactcgttccagaccgccagcaaccccgtccgcacccaggcctccggccgcgacgggccctacacgctcaacgtcacctccaccaccaacaaccagctcaacgtctccacgggcgtcgtcgaggtcaccgtcaacaacgcgctcagcgccgtcaagccgctcgccgtctactccgtcgacaaggtgctcctgcccttggagctgttcggggccaaggcgccagccgccgcgcctaccgcgtccaagcccaagaagggtgggtccgacgatgccgcctctggccccgcagggtctgacgacgccgcgcccacgggcgccgccagcgccagggccgtcggctggagcgtcgctggcctcgccgcccttcttggctacctgttgtgagagtgagaccgtacgccatttctatctctagggacggacgacgagctagttgaagatgagaatgccatgtccggagttgattcgggcggcttcttccatctttgtctgagattgtctggtggtgttcccttcctcttctttctctctgtttatttaaatttcttccatttgatctcgctagcttcttatttgtaatattggtggtttgtaagattgggctatgcgattcaatttttatgcgtgctgcggctgttgatactgcatcactactcttgagtcatttatatctagttctgaatttatgatcttcttatcagatgctac

SEQ ID NO: 1407 - DNA, 759 bp, Saccharum officinarum
  misc_feature (671)..(671): n is a, c, g, or t
  misc_feature (683)..(683): n is a, c, g, or t
  misc_feature (719)..(719): n is a, c, g, or t
  misc_feature (736)..(736): n is a, c, g, or t
tacgctgctccttttctactctcaccagctagctagccagtccaccctcactccacgacgcccacccaccacccacaaatccacacaatggcaagccgcatcgccgtggccgccgcgttcctagcgctggcggtggttcccgcggcgctggcgcaggcgcccgggcccgcggcgacgccgagcggcccgccgaacgtgacggcgatcctggagaaaggcgggcagtacacgacgttcatccgtctgatgaaggagacgcagcaggacacgcagctcaacagccagctgaacagctcgtacgccagcaacggcggcgggtacacggtgttcgcgcccaccgacaacgccttcaacaacctcaagccggggacgctcaactcgctgacgcagcagcagcaggtggcgctggtgcagggccacgtcctgccccagttctacagcatggactcgttccagaccgccagcaaccccgtccgcacccaggcctccggccgcgacgggccctacacgctcaacatcaccgccaccaccaccaaccagctcaacgtctccacgggcgtcgtcgaggtcaccgtcaacaatgcgctcagcgccgtcaagccgctcgccgtctactccgtcgacaaggtgctcctgcccctcgagctgttcggggccaaggcgcccgccgncgcgcccaccgngttgaagcccaagaagggtgagtcctcggacgccgncttcgggccgggcggcngcgacgacgccgggcccacgggc

SEQ ID NO: 1408 - DNA, 1409 bp, Saccharum officinarum
  misc_feature (758)..(758): n is a, c, g, or t
  misc_feature (1050)..(1050): n is a, c, g, or t
cacactacgctgctccttttctactctcaccagctagctagccagtccaccctcactccacgacgcccacccaccacccacaggggcacacaatggcaagccgcatcgccgtggccgccgcgttcctagcgctggcggtggttcccgcggcgctggcgcaggcgcccggccccgcggcgacgccgagcggcccgccgaacgtgacggcgatcctggagaaaggcgggcagtacacgacgttcatccggctgatgaaggagacgcagcaggacacgcagctcaacagccagctcaacagctcctacgccagcaacggcggcgagtacacggtgttcgcgcccaccgacaacgccttcaacaacctcaagcccggcacgctcaactcgctgacgcagcagcagcaggtggcgctggtgcagggccacgtcctgccccagttctacagcatggactcgttccagaccgccagcaaccccgtccgcacccaggcctccggccgcgacgggccctacacgctcaacatcaccgccaccaccaacaaccagctcaacgtctccacgggcgtcgtcgaggtcaccgtcaacaacgcgctcagcgccgtcaagccgctcgccgtctactccgtcgacaaggtgctcctgcccttcgagctgttcggggccaaggcgcccgccgccgcgcccaccgcgtcgaagcccaagaagggtgggtcctcggacgccgcctccgggccggccggcgccgacgacgccgcgccnacgggcgccgccagcagcgccagggccgtcggttggagcgtcgctggcctcgccgccgttcttggctacctgttgtgagagtgggacggacgacgagctagttggagatgagaatgccatgtccggagttgattcgggcggcttcttccatctttgtctgagattgtcagtggtggtgttcccttcctatccccctctttctctctgtttatttaaatttctttcatctcgctagcttcttatttgtattattggtggtttgtaagattgggttatgattcgattatgcgtntgcggctgttgatactgcatcactactcttgagtcatttatgtctggttcatgggatcaaaaaaaaaaaaaaaaaaaaaggggcgggcctgctcttaaaggaatcccaaggcttaacgttaccgcgttgcaatgccgacgttcattaagctctttctattaggggtcaaccttaaaatttcaatttcacctggcccggtcggttttaacaaaccgtctgtgaactggggaaaaaacccttggcggtttacccaaacgttaattcgctctttgcaagcacaattcccccctttttctccagcttggcggttattaaaggaaagagggccctgaccagaattgggctttttccaaacattt

SEQ ID NO: 1409 - DNA, 1052 bp, Panicum virgatum
acactacgctactctacgctctcgccagctagtcgatcttacactgcgttccgcttccgcagcagcccagcccagcccagtccacccacacacgcacccacaatggcggggcgcatcgccgtggcggcggcgttcctggcgctggcggtggttccggcggcgctggcgcaggcgccgggccccgcggcggcgccgagtgggccccccaacgtgacggcgatcctggagaagggcgggcagtacacgaccttcatccggctgatgaaggagacgcagcaggacacgcagctcaacagccagctcaacagctccttcggcaacaacggcggcggctacacggtgttcgcgcccaccgacaacgccttcaacaacctcaagcccggcacgctcaactccctcacccagcagcagcaggtgtcgctggtgcagggccacatcctgcccagtttctacagcatggactccttccagaccgccagcaaccccgtccgcacccaggcctccggccgggacgggccctacacgctcaacatcacctccgacaccaacaaccaggtcaacgtctcctccggcgtcgtcgaggtccgcatcaacaacgcgctctactccgccaagccgctcgccgtctactccgtcgacaaggtgctcctgcccatggagctcttcggggccaaggcccccgccgccgcgcccactgcgtccgagggcaagcccaagaagggcggctcctccgacgcctcgtcaccggccggctccgaggattccgacacgggcgccgccagcgccagggccgtcggctggagcgtcgctggcctcgccgccgttcttggctacctgttgtgagactgggatgagaatgccaatgtccaccaattccatctttgactgagattgtcagcggtggtgtttccttccttccccttcccatttttttctgtttaaatttctttgatactgctagtttcttcattgtgttcttgttcttgttcttggcggtctgtaggattgggttatgtgatcgaattcatgtgcttgaggctgttcataatgca

SEQ ID NO: 1410 - DNA, 1173 bp, Panicum virgatum
gggtcgacccacgcgtccgcacactacgctactctacgctcgccggctagtcgatcttactgtgcgttccgcagtagcccagcccacccactcacacacacccacaatggcggggcgtcgcatcgccgtggcggcggcgttcctggcgctggcggcggtggttcctgcggcgctggcgcaggcgccgggccccgcagcggcgccgagcgggccccccaacgtgacggcgatcctggagaagggcgggcagtacacgaccttcatccggctgatgaaggagacgcagcaggacacgcagctcaacagccagctcaacagctccttcggcaacaacggcggcggcggctacacggtgttcgcgcccaccgacaacgccttcaacaacctcaaacccggcacgctcaactccctcacccagcagcagcaggtgtcgctggtgcagggccacgtcctgcccaacttctacagcatggactccttccagaccgccagcaaccccgtccgcacccaggcctccggccgggacgggccctacacgctcaacatcacctccgacaccaacaaccaggtcaacgtctcctccggcgtcgtcgacgtccgcatcaacaacgcgctctacaacgccaagccgctcgccgtctactccgtcgacaaggtgctcctgcccatggagctcttcggggccaaggcccccgccgccgcgcccaccgcgtccgagggcaagcccaggaagggcggctcctccgacgcctcgtcgccggccggctccgaggatgctgagcccacgggcgccgccagcgccagggccgtcggctggagcgtcgctggcctcgccgccgttcttggctacctgttgtgagtctgagacaagaatgccaatgtccaccaaatccatctttgcctgagatagattgtcagtggtggtgtttccttccttccccttcttcctctctttgtttaaatttctctggtactgctagttgcttttttttattcttgttcttggcggtctgtaagattgggttaaattcatgtgcttgaggctgttcataatgcattaggcctgtttacttcccactccataaaccccgtaaacataaaaaaaccgtcatatcgaatgtttcgacacatgcatggagtactaaatgaagtctatttacaaaactttttcat

SEQ ID NO: 1411 - DNA, 2840 bp, Brachypodium distachyon
gagagcgtccgaaattgtgctcctgttcaccaaatgccaaatgccacccgtgaaacacccccgtttccccagagcctgacccgagcaactcggcttcagctcgccgtccgccccttcctcccgccgcctctctcccctccgccctcctctcaactcctctcctcccgccgccggcccctccttcactcccactgccggtcctcctccccgccgcaaccaccggccttacctcacgccgccgccgaccctccctcgatgccccacgtctagtccgccccctgcatggagcggtgcaggatttggtggccgcgccagcagcttcagcccggattggagtccggctctgccagatacgttctgctcggatggctcttctcccgcgcgggctctgtcgacatcgtcgtcgcggacttcgtctccgagggagagatcttgcggtccttccctagcgtcgacaccttccagaccatcatcctttcctcaaacaaaaggatgccagtgaggctacaagaatctgctgcatttaccatccttggggattgtgttatgcatcttccaagagattttgaagtctgttgttgtaaacaaaaatgtcaaccactgcacactcaagtttttcagaagcagcattttgacacaaaccaaggcagttctgttgtatcaaatggatcactaggaagtgaaaatctaccccgaggtgaaaataatagaaatcaggaatgtgattgtagtgtattagatggttttatggacacttgcaagaagtcagtggtgaaaggtggcaagtgggtgcacttctgctgcaagtctgaaaagagctttggatgcaatatgaaccaaattccagtgcttcatcatttgtatcttgataaccagaaggttgaacttaatcatttgcacgttatactgtatgatgttccaattgctggtagaagtcatttttccctgggtgaggatgcacctcataggttaaagacccccttcaaagtgccaaattggataaataatctgcaaaagaaaccatcagttcttgatttggatccgattgttttggcgcttaattgttcaaatgcagctaaactgccagttgcttggaaaactgctgccaatagttctgtcgctcatgtcttttttgcaactatatttgatgccttggttcaggtggtacaacatttcacaggagtattttttacttttgtatcgactatcgtctacatcatcattcaattgtttcaaaaatgtttgagccatatgcctgagtatttcatgttacaaaaggttttcagacattcatggagaaatatccatatacgtagttgccaaattctatactggccaattttcctccaagatacctccctaagagacgttaccgtctggtcaaggctctttgaccggtttggcccttggtggcacacacggaaacttacagtggcagttgatgaagcagagcctgaggcatcttcctgctgctacatgtggagctcctctgtgaatgtcgaatatgcacacagagctgcgatccagaagcatgcattgtggtcaagtattatcatcgatcttctgatgggtttcatccttggagcagcactattgttaaacacagagattatttgttcttggacttttgctcttctccactacatgacagatgctgtcttgagatctggttgtgtgtggctgatgggtgttccagcaggctttaagcttaacacagagttagcggagcttctaggcatgatttctctgaatgcaatccagatttattctaccctttggttcatcatgggaggcgtcctgaggcatatagttcgaggccttgcattttctggaatcctttttggtttcacagttcctgtttcattcttcatagacattatccagcttgcgacgttgcatgttaccatgcttcagtggttagtctcattgatatactcaaggcagattcagacagttacatcgttgtggcgtcttttcagagggcgcaaatggaatcctcttaggcagagattagatagctatgactatacggttgaacaacatgtggttggttcacttttgtttacaccagtcttgcttcttctacccacagcttctatattctatgtattcttcactatgttgagcagcacaatcatttgtttgtgcatagtattggaaattgcaatatgtataatccactgtactccatatgctgcattaattctatgggtgacaaggaggcaaagatttcctgctggattattactcctacctgtgtcgttgtcatctgtatgcactgatgaagaggatgcccaatcagttgaatattgttcagccagtggatttggtgataggcaaacagaccatctcgtccatgtacatccaggacctttagtttcaagacttcactgtaactataacactatcgggcaagtgataggaccacattaccgaaaagcttttgatgggattgctctctccttctgcaaacaattggctcatggaattctcagcggtgcaaggatcccaacaacactgcacctgccgtcttctccgttcccctggatgcatattggcattagacaatattggatgctctgccgtgacgcaaccaagcagggatggaattgaagtttttcgtgtactgtcaactttataccgccctcgagattttgcttcaactgcctaacacagtaacagaatgttgttgttcgtaagatgtcatgttgttgactgctctgtagatgatcgctgaaataccatttggagtttataggaagttaggaaccgatgttgctcaattctgtctcacccaaccaacagattttgcaatggacaagtactgacatactttagag

SEQ ID NO: 1412 - DNA, 1063 bp, Hordeum vulgare
gagacgggccccgctcgccggcgccgatggaggtgaagctgtggaacgacaagcgcgagcgggagctcctggagagcctggccgacctgtacgcgatcatcaaggccacggagaagctggagcgcgcctacgtccgcgacctcgtctccgccgccgactacgaggccgactgcctcaagctcatctcccagttcaactccctatcctcctccctcgccggggtcgtcaccataccgcgcttcgtgcaggcctaccgcctcgactgccccgccgccctcaaccgcctcgtccagtccggcgtccccgccaccatcgagctccgcgccgccaccgcctcctcctccgctccgcccgccaccgcggcctccgcctccgccatcgcccagtgcgtccagagcttcatcaccgccatggacgccctcaagctcaacatgctcgccaacgaccaggtccgccccctgctccacgacctctccacctccatggggaagctcggtaccgtcctgccgcccgacttcgaggggaaggtcaaggtgaacgagtggctcgcaaggctgcataagatgggggctggggacgagctcacagatcagcaggccagacagctcaattttgatctggaatcagcttatagtgcgtttatggcctcgcttcccactgctggcatgtgaagaatgatcggagttggttcttctttctgttttgccatgctcttgtctttgcatcattcatgcagtggtatagatatgtgtaatttggctcacgctataccgtttgtcaacaacaatgccaatcttatcgaaagttgcccccctacatacagatcgattgtttcatactcattatagggacctttgattgtattcagcgtacagtgtgtttatggcctcgcttcccattgctggtttgtgggcaaaggatcaattttgttctgaactgttcctatgtttctagtttgttaacatgttgtcttttgacccgctactgtgggtcatatatatgtgtaatttcgattgtgttctattctttgtcaataacagagcaaattttacgaaaaaaaaaa

SEQ ID NO: 1413 - DNA, 853 bp, Brachypodium distachyon
gggatctcttgctgccaccgatggaggtgaagctttggaacgacaagcgcgagcgcgagctcctggagagcctcgccgacctgtacgcgatcatcaaggccacggagaagctggagcgtgcctacgtccgcgacctcgtctccgccgccgactacgaggccgagtgcctcaagctcatctcccagttcaactccctctcctcctccctcgccggggtcgtcaccatcccccgcttcgtccaggcctaccgcctcgactgccccgcggccctcaaccggctcgtccagtccggcgtcccggccaccgtcgagctccgcgccagtaccaactcatccgcgccggccgccaccgcggcctccgccgcagccatcgcccagtgcgtccagagcttcatcaccgccatggacgccgtcaagcttaatatgctcgcaaacgaccaggtccgcccgttgctgcacgacctctcgacctccatggggaagctcggtactgtcctgccgccggactttgaggggaaggtcaaggtgaatgagtggctcgcgaagctacataagatgggggctggggacgagctcacggagcagcaggcaaggcaactcaactttgatctggattctgcttacagtgccttcatggcctcccttcccactgctggcctgtgagccaggatcagcttggttctgagttggtcctttgtttctacgctgtgatgctatagatgtgtaatttggattgtgttatattctttgtcaattttatgagaatctcctaatgattctgttgcatgttgtgtatatatatatataatgcagtgttcctctgtgatgtctatcaatggtagaatacttgcata

SEQ ID NO: 1414 - DNA, 927 bp, Zea mays
agtgaacgcagaacaatcgcgtcgttgtcgtccagtttacacgtaacccctcgcgcttattcagaattctgaaattccaagcccgatctcctctcctcttccccgaatctcgggcgccgccgtaaccctagcccccgcgatccgctcgccggagggaaggagggatctccgcaggcgcccatggaggtgaagttgtggaacgacaagcgcgagcgggagctcctggagagctacgcggacctgtacgcgatcatcaaggccgtggagaagctggaacgggcctacgtccgggacctcgtctcagccgccgactacgaggcggagtgcctcaagcttatctcccagttcaactccctctcctcctcgctcgccggcgccgtcaccgtccctcgcttcgtccaggcgtaccgcctcgattgccccgccgcgctcaaccgcctcctccagtcgggcgtcccggccaccgtcgagctccgcgccgcgtccgcctcatccgcgccggccgccaccgccgcctccgcgtcagccatcgcgcactgcgtgcagaccttcatcaccgccatggacgccgtcaagctcaacatgcttgccaacgatcaggtccgccccctgctgcaggacgtcgccacatccatggccaggctcggttccttgctgccgcccgactttgaggggaaggtcaaggttaacgagtggcttgccaagctgcataaaatgggcgccgcggatgaactcaccgagcagcaggccaggcagctcaacttcgacctcgactcggcctacagtgcctttttggctgcgctgcccgccgctggtctgtaaccgggcgtggacctggttcgttctttacttctattacagtactatagatatctgtaatttcggtactgctattttattgttaataagaaagttctgttttcttta

SEQ ID NO: 1415 - DNA, 952 bp, Zea mays
gtccagtactccagtttccacgtaacccctcgctcttcttcagacttccatactaccccgttctcctctcctcttcccccaaatctgcgtgcgccgcggcaaccctagcccccgcgatccgctcgccggaggggagggagccccgccggcgtccatggaggtgaagctgtggaacgacaagcgcgagcgggagctcctggagagctacgcggacctgtacgcgatcatcaaggtcacggagaagctggaacgggcctacgtccgcgacctcgtctcagccgccgactacgaggcggagtgcctcaagctcatctcccagttcaactccctctcctcctcgctcgccggcaccgtcgccgtcccgcgcttcgtccaggcgtaccgtctcgattgccccgccgcgctcaaccgcctcctccagtcgggcgtcccggccaccgtcgagctccgcgccgcgtccgcctcatccgcgcccgccgccacctccgcctccgccgcagccatcgcgcactgcgtgcagaccttcatcaccgccatggacgcggtcaagctcaacatgcttgccaacgaccaggtccgccccctgctgcaggacgtcgctacatccatggccaggctcggctccctactgccgcccgactttgaggggaaggtcaaggttaacgagtggcttggcaagctgcataagatgggggccgcggatgagctcaccgagcagcaggccaggcagctcaacttcgacctcgattcggcctacagtgccttcttggctgcgctgcccgctgctggtctgtaacggggtaaggatctaccagcttgatttttatttggttggttcggtctattatgcttttgacactggagcactactctccactactatagtactatagatatctgtaatttcggtactgctatttgttgtcaataagaaagttttgttttcctttgt

SEQ ID NO: 1416 - DNA, 1099 bp, Sorghum bicolor
tccactagtccagtttacacgtaaccccctcgcgcttcttcacaattcccaaatccatcctgccccgatctcctctcctcctcccccaaatctcgggcgccgccgcaaccctaggcccccgcgatccgctcgccggagggaaggagggagccccggccggcgcccatggaggtgaagctgtggaacgacaagcgggagcgggagctcctggagagctacgcggacctgtacgcgatcatcaagtccacggagaagctggagcgggcctacgtccgcgacctcgtctcggccgccgactacgaggcggagtgcctcaagctcatctcccaattcaactccctctcctcctcgctcgccggcgccgtcaccgtcccgcgcttcgtccaggcgtaccgcctcgattgccccgccgcgctcaatcgcctcctccagtcgggcgtcccggctaccgtcgagctccgcgccgcctccgcctcatccgcgccggccgccaccgccacctccgccgcagccatcgcgcactgtgtgcagaccttcatcaccgccatggacgccgtcaagctcaacatgcttgccaacgaccaggtccgccccctgctgcaggacgtcgccacatccatggccaggctcggccccctgctgccgcccgactttgaagggaaggtcaaggttaacgagtggctgggcaagctgcataagatgggtgccgcggatgagcttaccgagcagcaggccaggcagcttaacttcgacctcgattcggcctacagtgccttcttggctgcgctgcccgccgctggtctgtaaccgggcaaggaggtgccagcttgattcttatttggttggttcgttctattatgcttgacactggagcactactctccactactgtagtactatagatatctgtaattttggtactgctattttgttgttaataagaaagttctgtttccttagtatacagtaaatatgtttattgcatgatatacattcacattataatgcttgcaaatggcgtgtctatttgggtacatttattctattctctgtggaacatatgaagcaataacagtataatatattgttctctcccaat

SEQ ID NO: 1417 - DNA, 1061 bp, Saccharum officinarum
  misc_feature (16)..(16): n is a, c, g, or t
  misc_feature (599)..(599): n is a, c, g, or t
tcagaattcccaaatncatcctaccccgatctcctctcctcttcccccaaatctcgggcgccgccgcaaccctagaccccgcgatccgctcgccggagggtaggagggagccccggccgacgcccatggaggtgaagctgtggaacgacaagcgcgagcgggagctcctggagagctacgcggacctgtacgcgatcatcaaggccacggagaagctggagcgggcctacgtccgcgacctcgtctcggccgccgactacgaggcggagtgcctcaagctcatctcccagttcaactccctctcctcctcgctcgccggcgccgtcaccgtcccgcgattcgtccaggcgtaccgcctcgactgccccgccgcgctcaaccgcctcctccagtcgggcgtcccggccaccgtcgagctccgcgccgcgtccgcctcatccgcgccagccgccgccgccgcctccgccgcagccatcgcgcactgcgtgcagactttcatcaccgccatggacgccgtcaagctcaacatgcttgccaacgaccaggtccgccccctgctgcaggatgtcgccacatccatggccaggctcggccccctnctgccgcccgactttgaggggaaggtcaaggttaacgagtggctcggcaagctgcataagatgggggccgcggatgagctcaccgagcagcaggccaggcagctcaacttcgacctcgattcggcctacagtgccttcttggctgcgctgcccgctgctggtctgtaaccgggcaaggatctgccagcttgattcttatttggttggttcgttctattatgcttttgacactggaacactactctccactactgtagtactagagatatctgtaatctcggtactgctattttgttgttaataagaaagttatgttttctttgtatatacagtaaatatgtttattgcatgacatacattcacattataacgcttgcaaatggcctgtttatttgggtacatttattcgattctctgtggaacatatgaagcaataactgtgtaatattattgttggctccc

SEQ ID NO: 1418 - DNA, 1027 bp, Panicum virgatum
ctccgatcccctcccctcctcttcccccaaatctcgcgcgccgcgaaaccctagcacccgccgcgatcccctcgccggagggaggagggagacccgccggcgccgatggaggtgaagctgtggaacgacaagcgcgagcgggagctcctggagagctacgcggacctgtacgcgatcatcaaggccacggagaagctggagcgggcctacgtccgcgacctcgtctccgccgccgactacgaggcggagtgcctcaagctcatctcccagttcaactccctctcctcctcgctcgccggggccgtcaccgtcccgcgcttcgtccaggcgtaccgcctcgactgccccgccgcgctcaaccgcctcctccagtcgggcgtcccggccaccgtcgagctccgcgccgcgtccaactcctccgcgccggccgccaccgccgcctcagccgccgccatcgcgcactgcgtgcagaccttcatcaccgccatggacgccgtcaagctcaacatgctcgccaacgaccaggtccgcccgctgctgcaggacgtcgccacctccatggccaggctcggacccctgctgccgcccgacttcgagggcaaggtcaaggtcaacgagtggctcggcaagctgcataagatgggcgccgcggatgagctcaccgagcagcaggccaggcagctcaacttcgacctcgactcggcgtacagtgcctttttggctgcgctgcctgccagcatgtgactgggcaaggatatgcctgcttcattcctgtttggttggttccttctattttgttatgcttttgactgcgtggatcactactgtagttccgtagatacatgtacttgtggtcatgctaatatgctatattgctgttaatcgacattgtgcgagtggcttccatttcatttttatacagtaaatatgtttactgcatgatataactttatgctacaatatatgcatatgaagcaataactgtaacttatgaaacttcataagttacaagcgatatgacttcatg

SEQ ID NO: 1419 - DNA, 1037 bp, Triticum aestivum
tcccaatctcgcgcgacgccacgaaaccctatcccccaaatcgctcgccggggatagggagggagggaggccggagacggacaccgctcgccggcgccgatggaggtgaagctgtggaacgacaagcgcgagcgggagctcctggagagcctggccgacctgtacgccatcatcaaggccacggagaagctggagcgcgcctacgtccgcgacctcgtctccgccgccgactacgaggccgactgcctcaagctcatctcccagttcaactccctctcctcctccctcgccggggtcgtcaccatcccgcgcttcgtgcaggcctaccgcctcgactgccccgccgccctcaaccgcctcgttcagtccggcgtccccgccaccatcgagctccgagccgccacggcgtcctcctccgcgccggccgccaccgcggcctccgcctccgccatcgcccagtgcgtccagagcttcatcaccgccatggacgccgtcaagctcaatatgctcgccaacgaccaggtccgccccctgctccacgacctctccacctccatggggaagctcggtaccgtcctgccgcccgacttcgaggggaaggtcaaggtgaacgagtggctcgcaaagctgcataagatgggggccggggacgagctcacagatcagcaggccagacagctcaattttgatctggaatcagcgtatagtgcgtttatggcctcgcttcccactgctggcctgtgaacaatgatcggcttggttcagagttggttcttctttctgttttgtcatgctcttgtcttgcaatggtatacatatgtgtaatttggctcaagctatatcgtttgtcgacaacaatgccaatcttatggaaagttgccccctacagatcgattgtttcatacatgattatagggacccttgattgtattcagcgtacagtgtgttttatggcctcgcttccactgctgtttgtgatcaaaggattggttttgttctgagctgttcctatgtttctactttgttacgatgttgtc

SEQ ID NO: 1420 - DNA, 2067 bp, Brachypodium distachyon
ggtgacgtcgtcgcatgaccattccagaggctgcttgctttgctggcgactgaggctccgccggccgttggtccaccacgcgcaatccggagaccccagtgctgcgtgctcctcgcacatcaccacgctccaaaccaaatccctcccccatttcccttcctcttcctcactccctgctcctcctccaagcaatcgcaactcgcagctgccggggcgatccgtccgtccccatcgattcctcctcacagctcccgcggcggcgcccgagcctcctcccggatcccatcggctcttcctcccgccgccttctcaaagcacagagggactttggattgcagagcatattgaccaaggaactgtcattgacaagatattgtatacattggaatgttaagaataaatattggagctacttggtgtagatgttattaaatgtgcactacgctgctatctgtaacgttatgaggagtaactgaagttgtgtgtctctaatttgtttccaaccttattaattcttgacctggtacatttgtaaaaatgggagtttaccttagtacccccaaaactgagaagctatctgaagacggggaaaatgataaacttaaatttggtctttcctccatgcaagggtggcgtgcgaccatggaagatgctcattcagctttgctagatctcgacaaggacacatcattcttcggtgtttttgatggacatggcggaaaagtggtagccaaattctgtgcaaaatatctacacagagaagttctaaaaagtgaagtctactcagttggtgacctgggaacttctgtccatagagctttcttcagaatggacgagatgatgcggggtcaaagaggctggcgggaactacaggcacttggagataagataaaccagtttactggcatgatagaaggattgatctggtctccaaaaggcagtgattcaaatgatcaacatgatgattgggcttttgaggagggaccacactccgattttagtgggccaacctgtgggagtacagcctgtgttgcaatagtaagaaatagtcaacttgttgtggcaaatgccggagattcccgctgtgttatctcaaggaaaggccaggcgtacaatttatcaagagaccacaaaccagagcttgaagcagagagagaaagaatactgaaagcaggggggtacatccaaatgggacgagtaaatggaactataaatttggcaagagcgattggagatatggaatttaaacagaacaagttcttgtctcctgataagcaaatgttgactgcaaaccctgacataaacaccgtggagctttgtgatgacgatgactttcttgttttagcatgtgatggcatttgggattgcatgtctagccaacagctagtcgatttcatccacgagcacataaacactgagagcagcctttctgcagtatgtgaaagagtgctggatagatgcctggctccgtcaaccttaggtggagaaggatgcgacaacatgacaatgatcctcgtgcagttcaagaagccaattgaccatgagaagaatgccagtgctagtgaacaaccatctatcgagggcaagaatgacagtgctggggaacaattagcagctggcaacacagaacagccgtgagtcaactcacactgctgtttttccatttctttttcttcagtccagcgggtctttcttttcggtgcacctgtggtacttgtgtattcagcacggacatggagaagaatggcttgtgatgtggtagcccggtaaccctgagagctaaagaatgactcatgaatcctgaatcttggtctgatgtgccgatgctgtggtggttaaaaggcatgttgatggaaaaaatgcaagtgtagatatcaactgcgtgctgaatctgtcaatacacccagttggtacccggtcaccagccttgtgttgcttctgtttgtaataatcttttgttaatgatttggtgccgtcggtcgtttgatggaaatgtggaatgagtatattcagtgtcattattatgactttagcttctgtgcagatttcactattgacttgcaagtt

SEQ ID NO: 1421 - DNA, 1646 bp, Zea mays
atatgtttattaaaaataaaaatgtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagatccttttctatctgtcgtgttctgtctgcctggtacatttggaagaatgggggtttaccttagcactccgaaaactgagaaggtatccgaagatggggaaaatgataaacttaaattcggagtttcatctatgcaagggtggcgtacaactatggaagatgctcactcggctttgctagatctcgacaatgacactgcgttttttggtgtttttgatggacatggaggaaaagtagtcgccaaattctgtgcaaaatatctacacagagaagttctcaggagtgaagcctatgcagctggtgacctgggtgctgctgtccacagagcttacttcagaatggatgaaatgatgcgaggtcaaagaggatggcgggaacttcaagcacttggagataagataaatcagtttagtggcataatagaaggcttaatttggtctcctaaagcaagtgattcaaatgatagacatgatgattgggcttttgaggagggaccacactctgattttactgggccaaattgtgggagtacagcctgtgtagctttgatcagaaataagcaactcgttgtggcaaatgctggtgactcccgctgtgtcatctcaaggaatggtcaggcatacaatttgtctagagaccataaaccagagctcgaggcagagagagagaggatacggagtgcaggcggtttcgttctaatggggcgtgtaaatggaaatctaaacttgtcaagagctatcggagacatgaagttcaaacaaaacaagttcttgccccccgataagcaaatcctgactgcgaaccccgacataaacattgtcgagctatgtgatgacgacgaattcattgttttggcatgcgatggcatctgggactgcatgtcaagccagcagttggtcgatttcatccgcgagcatatagacacagaggaaagcctctcggcagtatgcgagagagtgctcgatagatgcctggctccgtcgaccatgggcggcgagggatgcgataacatgacgatgatcctggttcagttcaagaagccgattgctcaggtcgaggacgccagcggtgcagaaccagctgaagacgcagggtgctgtgagacccatggggcccacgagaacggctctggtaagcaggtgtagcgaagacgtggcatgcatggttctcggagtcttggactcttggtacatataggcctgacgctggacatgggtaaaacgggagtacgatagatgacaccctctgttcctcaatacaacccgctgttgtgattttttggttacctgaccacctatctgtacatttttgtggaaatgatgttacagtaattattgtccggtcaagcggaccccttttgagttttgtcatttacatgtacttactttcgtagcagaaagactgcatgagctgacaattgcactcctttaccct

SEQ ID NO: 1422 - DNA, 1545 bp, Zea mays
gtcaggttcagtcgctcaccaatctgccgttcacacctctctcgctgcctttatttcctgttggcgacgctctcgccaggtcttcggcggcccgttcgtcggcgactagcgcctccgtttgccaggtcttcgtcgtccgttcgccgtcgactggtgcccagcagccaggtacatctggaagaatggtgatttaccttagcacaccaaaaaccgacaaggtatccgaagatggggaaaacgataaacttaaattcggactttcatctatgcaagggtggcgtgcaactatggaagacgctcactcggctttgctagatcttgacaatgacactgcatcctttggtgtttttgatggacatggaggaaaagtagttgccaaattctgtgcaaaatatctacacatagaagttctccataccgaagcctatgctgctggtgacctgggtgctgctgtccacagagcttacttaagaatggatgaaatgatgcggggtcaaagaggatggcaggaactccaagcacttggagataagataaatcagttcactggcataacagaaggcttgatttggtcccctaaagcaagtgattcaaatgatagacatgatgattgggctttcgaggagggaccacactctgactttactgggccaaattgtgggagtacagcatgtgtagcattagtgagaaataggcaactcgttgtggcaaatgctggtgactcccgctgcgtcatctcaaggaatggccaggcatacaatttgtcaagagaccataaaccagagcttgaggcagagagagaaaggatacaaagtgctgggggttacattaaaatggggcatgtaaatggaagtttaaacttgtcaagagctattggagacatggagcttaaacaaaacaagttcttgtcccctgataagcaaattttgaccgcaaaccctgacataaacattgtcgagctatgtgacgacgacgaattcattgttttagcatgtgatggcatttgggactgcatgtcaagccagcagttggttgatttcatccgtgaacatataaacacagaggaaagcctttctgcagtatgtgaaggagtgcttgatagatgcctggctccatcgaccatgggtggcgagggatgcgataacatgacgatgatcttggtgcagttcaagaagccatttgctcaggtaaaggatgccagtgatgcggaacaactaactggagatgcgggatgctctgagacccatggggccgaggagaatggctctgacaagcagatatagcgaagacatggactcttttggagtcttggtacatggcctgacgctgaacctgggtaaaacaggagtacgatgttgcaatgtacataccaaccatgcgctgagttggcgtgaaggatatattcattgttccactgttgtctttaaccaaacgtgctgttttcttccggttgtgatttttggtgacctgatcatctgacaatatctaattatacatttgggaggaaatgatgttacaatagttattgtgggtgtttgttgggat

SEQ ID NO: 1423 - DNA, 2071 bp, Zea mays
ggctagtactagcaagcagtagtggtgtcgcatctgccgatctcctctgtccgagtcactcactcgtaggtggcttccacccatctccctcagcagtcagtcagcaggactcagcagcactatctcccaccccccatccttcgctactctttcgttccttctgatcgccgctatcctcttcagccccgactgaggaggcggccggcgctccccaggcacgcacgagttgacgggtccagcagcggcctcgggatcttgccgccagctgcagcggcaatccggtccgtccgcccaggaaaccagtgctgtcttaggtattgttgattcatgattcttgattccgggaggcggtttcgtgttgtgacagcccgatcttgcggttcagcagagagccaatccgctgggcttccgtggatatacatatactggtctgagttgtcaagtccttgacctgatcatatcagttttgcttataaggatgggggtttacctcagtactccaaaaactgacaagctatctgaaaatggagaaaatgatagacttaagtttggtctttcatctatgcaaggatggcgagcaaccatggaagatgctcattcagcattgctagatcttgatagcgagacagcattctttggtgtttttgatggtcatggaggaagagtcgttgccaaattctgtgcaaaatatctgcatggtcaagtcctcaaaagcgaagcctattcaactggtgacctaggcactgctgtccatagagctttcttcagaatggatgaaatgatgcaaggacagagaggttggcgagaactatctgcacttggagacaaaataaacaagtttagtggtatgatagaaggattgatttggtctccaaggggcagtgattcaaataatcaacaagatgattgggcttcagaggagggacctcactctgactttgctgggccaacatgtgggagtacagcgtgtgtagcattaataagaaacacccaacttgttgtggcaaatgctggtgattcccgatgtgttatttcaaggggtgggaaggcatacaatttatcgagggaccacaaaccagagcttgcagctgagagagaaaggataatgaaagcagggggcttcatccatatgggacgagtaaatggaagtttaaacttgtcaagggcaattggagacgtggaattgaaacagaacaaattcctgcctcccgagaagcaaattgtgacggccaatcctgatatcaacgtcgtggagctctgcgatgatgacgactttgttgttgtagcatgtgatggcatttgggactgcatgtcaagccaacagctggtggattttatccacgagcgtataaacacggagagcagcctgtctgccgtgtgcgagagagtgctggacagatgcctggctccatcaacgatcgctggagacgggtgcgacaacatgaccatgatcctggtgcagttcaaaaaacctgtcgatcggaacaagaaggccgaagcagcagggcaatctgccagcaatgtggacgaagccaagagtcgtgttgctgaggagtgaagcatggctggcactcaccagggcgcaaccatttgctttcataaggcaggtgaaaaaaaggaacgaagaaacctgcagtgtacgtatctcaactgtacgtggcatgccatgcaaatcctgcctaagttaccccggacaatggcattgcctagtgcagtggtggatcttcagatcacaacctttcttgtgccagctttcggtcatctccactctccagccctcggaaccatggctgagtctgtctattctttgtgtggtgtgtagcattcctcgtgttttcgttgtccaaaatggtgtcaaatccagttttttgttgcgagaatgaaccgtgacgttagtgtgttttgctggcggttaggtgcaaaatactcgaaacctgaattgcccgctcgctatttcgggttgtaagtatatgatggatctgattttagttgcatggtgtacccatcttatctgaaaataatgaaagatctgtttgtggttgactaattacgtgtgtgtttttttctaatg

SEQ ID NO: 1424 - DNA, 1265 bp, Zea mays
cctttgtcaggttcagtcgctcaccattctgccgttcacacctctctcgctgcctttatttcctgttggcgacgctctcgccaggtcttcggcggcccgttcggcggcgactagcgcctccgtttgccaggtcttcgtcgtccgtttcgccgtcgactggtgcccagcaggtacatctggaagaatgggggtttaccttagcacaccgaaaactgacaaggtatccgaagatggggaaaacgataaacttaaattcggactttcatctatgcaagggtggcgtgcaactatggaagacgctcactcggctttgctagatcttgacaatgacactgcattctttggtgtttttgatggacatggaggaaaagtagttgccaaattctgtgcaaaatatctacacagagaagttctccataccgaagcctatgctgctggtgacctgggtgctgctgtccacagagcttacttaagaatggatgaaatgatgcggggtcaaagaggatggcgggaactccaagcacttggagataagataaatcagttcactggcataatagaaggcttgatttggtcccctaaagcaagtgattcaaatgatagacatgatgattgggctttcgaggagggaccacactctgactttactgggccaaattgtgggagtacagcatgtgtagcattagtcagaaataggcaactcgttgtggcaaatgctggtgactcccgctgcgtcatctcaaggaatggccaggcatacaatttgtcaagagaccataaaccagagcttgaggcagagagagaaaggatacaaagtgccgggggttacattaaaatggggcgtgtaaatggaagtttaaatttgtcaagagctattggagacatggagcttaaacaaaacaagttcttgtcccctgataagcaaattttgaccgcaaaccctgacataaacattgtcgagctatgtgacgacgacgaattcattgttttggcatgtgatggcatttgggactgcatgtcaagccagcagttggttgatttcatccgtgaacatataaacacagaggaaagcctttctgcagtatgtgaaagagtgcttgatagatgcctggctccatcgacggctggcgagggatgcgataacatgacgatgatcctggtgcagttcaagaagccatttgctcaggtaaaggatgccagtggtgcggaacaactaactggagatgcgggatgctctgagacccagtgagttacctgtgattgtg

SEQ ID NO: 1425 - DNA, 1320 bp, Pennisetum glaucum
ggagaatggggggtttaccttagcactccaaagactgagaagctatctgaagatggggaaaatgataagcttaaatttggcccttcatctatgcaaggatggcgtgcaactatggaagatgctcactcagctttgctagatctagacaacgacactgcattcttggtgtttttgatggacatggaggaaaagtagttgccaaattctgtgcaaaatatctacacagagaagttatcaacagtgaagcctatgcagctggtgacctgggtgctgctgtacacagagctttcttcagaatggatgaaatgatgcgtgggcaaagaggatggcgggaacttcaagcacttggagataagataaatcagtttactggcataatagaaggcttgatttggtcccctaaaggaagtgattcaaatgatagacatgacgaatgggctttcaaggagggaccacactctgattttattgggccaaattgtgggagtacggcctgtgtagcattagtgagaaataggcaacttattgtggcaaatgctggtgattcgcgctgtgtcatctcaaggaatggccaggcatacaatttgtcgagagaccataaaccagagcttgaagcagagagagaaaggatacaaagtgcagggggttacatccaaatgggtcgtgtaaatggaactttaaacttgtcaagggctattggagacatggaatttaaacagaacaaattcttgtcccctgataagcaaattttgactgcgaaccctgacataaacattgttgagctttgtgatgatgatgactttcttgttttggcatgtgatggcatttgggattgcatgtcaagccaacagttggttgatttcatccatgagcatatagacaaagaggaaaccctttccgcagtatgtgaaagagtgctcgacagatgcctggctccatcgaccatgggcggtgagggatgtgataacatgacgatgatcctggtgcagttcaagaagccaattactcagaccaaggatgccagcagcgcggagcaatcagctggagacacagaaccgtctgagacgcatgtggccgaggagaatggctcatgaggaaatggctcttgaagcagggcctgctgctggacctggcttaaacaggagtgcgatgctgcaatgtacataccaaccatgtgtcgaattggcgcgaacactattatttgttccaattgttgtctgtaacccaacctgctgttttctcccggttgtgatttttggccatctgacataaccgaactgtacatttgtgggtggaaatggtgttcccttgttatacgat

SEQ ID NO: 1426 - DNA, 2590 bp, Oryza sativa
catatgcaaaggcacacttacatcccacgaatgtctcaatacatgttttaacttgatctcacaaaaatccagctgaaatcctatctacatgcccttctgaaagttttgacatctaaaactaagatcaagaatcttccatatattaaatgttgcgtttatgactgacaatatcacactccctccatcccataaaaaacaaacctgttgcacttgtcacactaaaaaacatcccataaaataagtaaatattcatgaaaattggacttacaaattctctaaaattatgaaaaaaataatagagattggtataagcatggaatacatttacaccacggccagtgtctccaagtacactggcatggcatggcatgcagtgcacctagcaaatacactaaaaaagccaaaagaaaaataatataataataataaaccagctgcctttgtgacaacagcccaacccaacccacaaaaatatcccttcccctcacgaaatccatttcatccatttttccgctctctctctctccgaatgcgcgtgatctcgcactcgcagcctcagcatcagctgcatcactccccgcctctccgcgatcgcaagggccgcgccgatcccccccgcaccagaagccctcgagattccgatctcccagaaaacctccgcctcgcagcgcgacggatccatccatctcgccacctttctcccacaaggaatttactagctctcggagaaactacggttgaggcttgcggtttggatgcaccttcatgtttataagaaggctcagagctacctgatataactcctgttctgtcataaacagcttatcaacatgggaatctacctcagtacccccaaaaccgataagttctctgaagacggggaaaatgataagcttaaacttggtctttcgtctatgcaaggatggcgtgcaaacatggaagatgctcattcagcattgctaaatcttgacaatgagacatcgttctttggtgtttttgatggccatggaggaagagtggttgccaaattctgtgcaaaatatttacactctcaagttctcagaagtgaagcctattcagctggtgacttaggcactgctgttcatagagctttcttcaggatggacgaaatgatgcgaggacagagaggctggagagaactatctgcacttggagataagataaacaagattggtggtatgattgaagggttgatttggtctccgagaggcagtgattcgaataatggacaagatgattggtctttcgaagagggaccccactccgattttgctgggccaacatgcggatgcacagcatgtgtagcgctaataagaaataaccaacttgttgtggcgaacgctggtgattcccgttgtgttatttctagggctggccaggcatacaatttgtcaagagaccacaagccagagcttgaagctgagagagacagaatagtaaaagcagggggtttcattcatatgggacgaataaatggaagtttaaacttgacaagagcaattggagatatggaatttaaacagaacaaattcttgcctcctgagaagcaaatcgtgactgcaaatcctgacatcaacgttgttgagctttgcgacgacgacgactttcttgttttagcatgtgacggcatttgggactgcatgtcaagccaacagctggtggatttcatccacgagcatatacagaaggagagcagtctttctgcagtgtgcgaaagagtgctcgacagatgcctagctccatcaacaattggtggagagggatgtgacaacatgaccatggttctggtgcagttcaaaaagcctattactcagaataaaaaagccgacgtaggggagcaatctgtgaaaggtgtggaagaggctgagatcaatgctgctgaggagaatggttcttgacgccgatgattatgcagacatttgctttcataagcaggccgagtggagcagcagtcactgtgtgtgtgtgtgtgtgtgtgtgtatatatatatatatagatatatatatatatatatatatatatatatatatatatatatatatatatatatatatatatatatatatatcaattgtttgtcaaatgatgtatctgcacacattctgctcaagaactcggagataaatggcactgaatggagcaactgtgaaaacctaatgcgcagtttttgtgcgccatccaccattcgttgtcatgccaaaaagttgaccgtcctgattgtggatatgatcacaattgtcgacaattagaactgatcaagttgctgttttctgttctttgcatacgctgtaaacgtgggcgagttttttgttctgctgtttttttttgggtgtgtgcgtgtgatagatatgtcaattgcaattcatgccccatttgggttattgcttcagatcatgtccaatctgaatccagtttatcatgtgatatctgttggttagttcagtgccgtgctgctgcggtgctgccctggtgtggtgaaaatgtatgcctgttatgcatatggaagtatggaacaatttggggattttgcaaaaaggaggcaatgcaattacatttcatattataaaa

SEQ ID NO: 1427 - DNA, 4871 bp, Sorghum bicolor
ccgcctccggaggagctagagtcggacccgggccaaaccggccctaaattgcccttgcccgcacgccccttgcccaccgcctggagtcgtctcgcccgcggccgatctcctgcatccactcgccgcgccgcaacccggaggccggaggagactgcgttcagtcgagcaccacctcccagcatcctcgcgaccatctccggcacgacgtccgccctctgcagccccggtgttcctgcgaccgtcgctgctgtcctacttcgccgctggccagtttgccccgcgacgagcaccaccagaacaaagtgcccagatgagttcgaagaaggttccgtaccacaagcatcgggaggctgaggaggcgaggaagaagagggaggaagatgaagcggcgcgtgtatatgcggagtttgttgagtccttcaaaggtgacagctcatctggggctaagtttgtccgaggtggtgtgatcgaccccaatgcaaagctgaagattgactcagaaggtggaaagtccaaagatggggggtctgttccaaagaagggcagtaggtatgttccatcgttcttgccaccatcgtttgcgaaagagcctgagaaaaagaaagaagaggagaggccaaaggaaaaggaaaaaggaaagccacgagtaatagataaattcttggaggaactcaagtttgaacaagagcaacggaaaaagcgcaatcaggatcgagatcaccgccatgaaggtcgtcacagcgacagctccatgccctctagccggtttgatgaactaccagatgaatttgatccgactggaagatttccaggatcatttgatgatggtgatcctcaaaccacgaacttatatgtcggcaatctatctcctaaggtcgatgagaattttcttttgaggacctttggtcggtttggacctattgctagtgtcaagattatgtggcctagaacagaagaggaacgcagaaggcaaagaaattgtggttttgttgccttcatgaatagaacagacggacaggcagcaaaggatgaaatgcaaggtgttgttgtgtatgactatgaactgaagattggatggggtaaatctgttgctcttccatcacaagctttgcctgctcctcctccaggacacatggcaatcagaaataaggagggtggtacagtcgtactttctggtcctggtggccctgctgttgcatctgttacaccacaaacctcagagctggtccttacaccaaatgttcctgatattgtggttgctccacctgatgatggacgtcttcggcatgtgattgacacaatggctctgcacgtacttgatggtggatgtgcttttgaacaagctgtaatggagagagggcgaggaaatcctatatttgatttcttgtttgatcttaaatctaaagagcacacatattacgtttggaggctatactcatttgctcagggtgatactttacaacgatggagaacagaaccatacatcatgatcacaggaagtggaagatgggttccacctcccttgtcatccaacagaagccctgaacgtgaaaaggaatctacatttgctgctggtagaagcaggcgtgttgaagtggagcggacattgactgagtcacaacgtgatgaatttgaggacatgctgcgagctttgacattagagaggagccaaataaaagatgccatgggatttgccttggataatgctgatgcagctggggagattgttgaggttcttacagaatccttgacactcaaggagacgtctattccaacaaaggttgctcggcttatgctagtgtctgacatccttcataacagtagtgctcctgtgaagaatgcatctgcattccgaacgaaattcgaagcttctttgccagatgttatggagagcttcaatgacttgtaccgcagtatcactggaaggataactgctgaagctctgaaggagagggttatgaaagttctacaagtttgggcagactggttcctgttttctgatgcatttctgaatgggctgagggctacttttctgagatcaggcaactctggtgtcgttccgtttcactcgttatgcggtgatgcacctgaaattgaaaagaaaggtagctctgaggatggaaatgatggatttaagcttaatgaagatggtgccttggctactggaaaggcagcagcaacaaaggagctattagggctcccactagctgaacttgagcgtcgttgtagacataatggcctctctctgtgtggtggtaaagaaatgatggtcgccaggctgcttaacttggaagaggctgagaaagaacgagtatatgagaaggatgttgacatgaaatatgtgcagggtgaacagcatacgattggaagtggtgtgaatacttcaaaatttggtgaaagtcctaatgttgatgaattagatgtctctcggaacaatatgagagctggtaaaggacgttctggagaatctgcttttgccgaacttgaatcatttccaagcaagaagccgaaatatgatcctgttttgccagcttctaaatggagtcgagaggatgacatcagtgacgatgaagatagaaaaggtggtcgaggcttgggattaagctattcatctggaagcgatattgctgatgatcttggaaaggtcgatacaacagaagctagtaccgaccacacaagtcatcatcacgatacgattgttgatgaagagcacaggcagaagttgaggcagattgaaatttctgtcatgcaataccgtgaatctcttgaggagcagggtctgcgtaacttggatgagattgagaggaaggttgccagccatcgaaggcggcttcagtcagaatacggtttatccacttcagctgatggtgctaacaggcgatcttctgaaagaacatcatcagagcggaaagagaggcgtgacgatgcacatgattatcctaggaaacggcgtcggagccagagtagaagccgcagccctccaaggaagtcacaggagagggatcgagagcacaatcgaagtagagaccgatcgcatggcaacgatgccgggagggataggcttataaggatgggggtttacctcagcactccaaaaactgataagctatctgaaaatggagaaaatgatagacttaaatttggtctttcatctatgcaaggatggcgagcaaccatggaagatgctcattcagcattgctagatcttgatagcgagacagcattctttggtgtttttgatggtcatggaggaagagtggttgccaaattctgtgcaaaatatctgcatggtcaagttctcaaaagtgaagcctattcagcgggtgacctaggagctgctgtccatagagctttcttcagaatggatgaaatgatgcgagggcagagaggttggcgagaactttctgcacttggagacaaaataaacaagtttagtggtatgatagaaggattgatttggtctccaaggggcagtgattcgaatagtcaacaagatgattgggcttcagaggagggacctcactctgactttgctgggccaacatgtgggagtacagcatgtgtagcactaataagaaactcccaacttgttgtggcaaatgctggtgattcccgatgtgttatttcaaggggtggaaaggcatacaatctatcaagggaccacaaaccagagcttgcagttgagagagaaagaataatgaaagcaggggggttcatccatatgggacgagtaaatggaagtctaaacttgtctagagcaattggagatgtggaattgaaacagaacaaattcctgcctcccgagaagcaaattgtgacagccaatcctgacattaacgttgtggagctctgcgatgatgacgactttgttgttgtagcatgtgatggcatttgggactgcatgtcaagccaacagctggtggatttcatccatgagcgtataaacatggagagcagcctatctgccgtgtgtgaaagagtgctggacagatgcctggctccatcaacgatcggtggagatgggtgcgataacatgaccatgatcctggtgcagataaaaaaaccagtcaatcggaataaaaaggccgaagtagcgggtcaatctgccaacaatgcggatgaagtcaagagtcgtgtcgctgaggagtgaaacgtggttgacactcacaaaggtgcaaccatttgctttcataagggcaggaaaaaaactaagaaatgtgcactgtacatatctcaactatatgtggcatgctatgcacatcctgcataagaacctccgataatggcattgcctagtgcagtggtggatcttcagaatcacaaccgtgtgccccgtcatcctccgtttatcgcccgtcgagcatttcagctgcagctttcggtcatctacagcccttgaaactgcagcaaagtcggtgtattctttctgtggtgtagcattcctcgtgtgctgtaaacaagcttggttccatggctcaccaggctgtgctttccttcaatatggtgtgtcaaaatccagtttttgttgcgagaatgaaccgtgaccttagtgctttttggtggttgtttggtgcaactaggggttggcataaaatccgatacctggacctgactccgaatactcgaacctgaattaccggctcgctattttcggattgtaagtatacgatcaatctgattttagtttgggtgattcggctattagcccccagtacctgatgtacccattttatatgaaaaaaatgggaagactatatgctatttggttgtgattgactaattatgtggtttcctaatgtcaatttttgaggtaattgggaactactcatctttctttttccttaaatgctgctaaagaactgctgtttata

SEQ ID NO: 1428 - DNA, 1599 bp, Sorghum bicolor
cccgttcagtcgttctcgatcacctttctggcgtcgggcgttcacatcacacctctctgtctctttggcttcatttcctgctgacgactgagcgggcgagcgccggcgccctttgccaggtcttcgtcggcccgttcgccggcgactagcgtctccctttgccaggtctcgacgcccccttcgccgtcgactggcacccagcaggtacatttggaagaatgggggtttaccttagcactccgaaaaccgagaaggtatcggaagatggggaaaatgataaacttaaattcggactttcttctatgcaagggtggcgtgcaactatggaagatgctcactcggctttgctagatcttgacaatgacactgcattctttggtgtttttgatggacatggaggaaaagtagttgccaaattctgtgcaaaatatctacacagagaagttctccatagtgaggcctatgcagctggtgacctgggtgctgctgtccacagagcttacttcagaatggatgaaatgatgcggggtcaaagaggatggcgggaactccaagcacttggagataagataaatcagtttactggcataatagaagggttgatttggtcccctaaagcaagtgattcaaatgatagacatgatgattgggctttcgaggagggaccacactctgattttactgggccaaattgtgggagtacagcctgtgtagcattagtcagaaataggcaacttgttgtgggaaatgctggtgactcccgctgtgtcatctcaaggaatggccaggcatacaatttgtctagagaccataaaccagagctggaggcagagagagaaaggatacaaagtgcagggggttacattcaaatggggcgtgtaaatggaactttaaatttgtcaagagctattggagacatggagtttaaacaaaacaagttcttgtcccctgataagcaaattttgaccgcgaaccccgacataaacattattgagttatgtgatgacgacgaattcatggttttggcatgtgatggcatttgggactgcatgtcaagccaacagttggttgatttcatccgtgagcatataaacacagaggaaagcctttctgcagtatgtgaacgagtgcttgatagatgcctggctccatcaaccatgggcggcgagggatgtgataacatgaccatgatcctggtgcagttcaagaagctgactgctcagcacaaggacgccagtggtgcacaacaaccagctggagacgcgggatgctccgagacccatggggccgaggagaacggatctggtaagcaggtatagcaaagacgtggctgttggagtcttggtacatggcctgacgctggacttgggtaaaaacaggagtatgatgacgatattgcgatgtacatacaaccgagtgctgaattggcgtaaaggattattctttgttccattgttgtctgtaacccaatctgctggtttcttccggttgtgattttttgccatctgacaacacctaattgtacatttggggtgcaaatgatgttacaatagttcttgtgatcaagcggatcctgtgctctgcccttttgagttcttg

SEQ ID NO: 1429 - DNA, 2120 bp, Saccharum officinarum
cctctctcagtctctcgtgggagggcctccacccatctccctcagtagtcagcatctctctctcggctctctcctcctttctctccactccacccccgctcatccttcgctgttcgttcgttctggtcgccgctatcctcgtcctcagccccgactgaggcggcggccggcgctccccaagcacgcacgagttgacgggttcagcggcggcgggatcttgctgccagcggcagtggcaatccggccgggccacgcaggatttcgtggatacaccggtctaagttgtcaagttcttgacctgaccttatcagttttgcttataaggatgggggtttacctgagtactccaaaaactgacaagctatctgaaaatggagaaaatgatagacttaagtttggtctatcatctatgcaaggatggcgagcaaccatggaagatgctcattcagcattgctagatcttgataacgagacagcattctttggtgtttttgatggtcatggaggaagagtggttgccaaattctgtgcaaaatatctgcatggtcaagttctcaaaagtgaagcctattcagctggtgacctaggagctgctgtccatagagctttcttcagaatggatgaaatgatgcgaggacagagaggttggcgagaactatctgcacttggagacaaaataaacaagtttagtggtatgatagaaggattgatttggtctccaaggggcagtgattcgaatagtcaacaagatgattgggcttcagaggagggacctcattctgactttgctgggccaacatgtgggagtacagcatgtgtagcactaataagaaactcccaacttgttgtggcaaatgctggtgattcccgatgtgttatttcaaggggtggaaaggcatacaatctatcaagggaccacaaaccagagcttgcggttgagagagaaaggataatgaaagcaggggggttcatccatatgggacgagtaaatggaagtttaaacttgtcaagagcaattggagatgtggaattgaaacagaacaaattcctgcctcccgagaagcaaattgtgacggccaatcctgatattaacgttgtggagctctgcgatgatgatgactttgttgttgtagcatgtgatggcatttgggactgcatgtcaagccaacagttggtggatttcatccatgagcgtataaacatggagagcagcctatctgccgtgtgtgaaagagtgctggacagatgcctggctccatcaacgatcgctggagatgggtgcgataacatgaccatgatcctggtgcagttcaaaaaaccagtcgatcggaacaaaaaggccgaagtagcagggcaatctgccaacaatgcagatgaagtcaagagtcgtgttgctgaggagtgaaacgtggttgacactcacaagggcgcaaccatttgctttcataagggcaggaaaaaatgaagaaatgtgcactgtacatatctcaactgtatgtggcatgctattgctatgcacatcctgcataagaacctcagataatggcattacccagtgcagtggtggatcttccgatcacaaccgtgtgccccatcatcctccttttatcgcctgtcgagcatttcagctgcagctttcggtcatctacagccctctgaactgcggcaaagtcggtgtattctttctgtggtgtagcattcctcgtgtgctgtaaacaagcttgcttccatgcctcaccaggctttgctttccttcaatatggtgcgtcaaatccagtttctgttgcgagaatgaaccgtgacctttgtgttttggtggccgtttggtgcaactaggggttggcataaaatccgatacctggacctgactactcgaacctgaattaccggctcgctatttcggattgtaagtatatatgatgaatctgattttagtttgggtaattcggctattagtccccggtacctgatgtacccattttatctgaaataatggaaagactatgctatttggatgtgattgactaattatgtggtttcctaatgtcaaatttgaggtaattgggaactactcatgtttcctttttctgaaatgctactaaagaactgctgtttatatt

SEQ ID NO: 1430 - DNA, 2096 bp, Panicum virgatum
gtggcctccacccatctcagcattctcgctcgctttcctctctcttccccaccccacccccgcccgccgcatccttctttgttcgctccgatcgccgctctccccgactgaagcggcggccggcgctccaaggcacgagctgacggtggggtctgtggatcttgccgcgagcggcggcagcggcgctccggtccacccaggtgcgcgtggcgggacatcgtgaatacgtcaagttcttgatcggaccatattaattcctgttcgtaaggatgggagtttacctcagtactccaaaaactgataagctatctgaaaatggagaaaatgatagacttaaatttggtctttcatctatgcaaggatggcgagcaagcatggaagatgctcactcggcattgctagatcttgatagtgagacagcattctttggtgtttttgatggtcatggaggaagagtggttgccaaattctgtgcaaaatatcttcacagtcaagttctcaaaagtgatgcctattcaactggtgacctaggcagtgccgtgcatagagctttcttcagaatggatgaaatgatgcgaggacagagaggttggcgagaactatctgcacttggagataaaataaacaagtttagtggcatgatagaagggttgatttggtccccaagaggcagtgattcgaataatcaacaagatgattgggcttctgaggagggacctcactctgattttgctgggccgacatgtgggtgtacagcatgtgtagcactaataagaaataaccaacttattgtggcgaatgctggtgattcacggtgtgtcatttcaagggctgggcaggcatacaatctttcacgggaccacaaacctgagcttgcagctgagagagaaagaattatgaaggcagggggtttcatccatatggggcgagtaaatgggagtttaaatttatcaagagcaattggtgatgtggaatttaaacagaacaaatttctgcctcctgagaagcaaattgtgacagcaaatcctgacattaacgttgtggagctctgcgatgaagacgactttgttgttgtcgcatgtgatggcatttgggattgcatgtcaagccaacaactggtaaatttcatccacgagcatataaacaaggagagcagcctatctgctgtgtgtgaaaaagtactggacagatgcctggctccatcaacaatcaccggagaggggtgtgataacatgaccatgatcctggtgcaattcaaaaaaccagttaatcggaacaaaatgtccgatatggctgagcaatctaccagcagcgcagatgaaactgagattcatgttgctgaggagtaaatcgagcttgacactcgcaaaggtgcagccatctggattgagaagagcaggaaaggcaaagaaatgtgtagtgtacatatcccaactatatgtggcacccgtgcagttcctgactgaaaggacctcagataatggtgttggttgctgcgatggtggacctccagggtatgcacgtacgccatcctccattcgtcgtcgagcaggtcgcagttttcggtcattgccccggctccaaactgcggcgcagtctgtgtattctgtggtgtaagattccaagtgtgctgctgcaaacaagtttggttccgtgcctggctcactaggttgcgctttctttctgaatgatatgcgttgaatctgaatccggatcgggatggtcctgggctgtgtgttgtttgttgtattggcacctgatggttaggatgaaccctgaacttagcatatttcaggtacagtcggtgccgactgtgaagtcagtgtgctgatgctgggatttttggttatgaggattcaaattgttgcattagccgttgccttctctgtctgcgagtacgaactgtttattggttcctgttcaccttaaagcgtcctattgctgaatgctgacgcttcatggagctggaatgctcgccctattccccatggctttcccagcaacctgcctgggaagggagctgtaattggcgtccccggcgccactgtaaactcttcttattattaatgaatgctggacaacgtgcctgatctttc

SEQ ID NO: 1431 - DNA, 1874 bp, Triticum aestivum
  misc_feature (44)..(44): n is a, c, g, or t
  misc_feature (46)..(46): n is a, c, g, or t
gaaatcaaattccatctcacgctgcatcttatcaccttccttgncnctccgcaaccgcaagggccgccctcctccgtcccgcgccgcttccaaaactccaaatcggaatctcctccccccctccccgcgacagcccggcacacgcgcacccggccgtgatccgccaccttcagctgcgcgcgccagccgtcatgcaaggaactttttagcttcctatggaactgtaatcgaagcttgagatttgatgcactggaatgttgttaacaaggttcagagctacttgaactgtggtatccattctacatcacagatttctttccttgccaagatgggagtttacctcagtactccaaagaccgataagctatccgaagacggggaaaatgataaactcaaatttggtctttcatctatgcaaggatggcgtgcaagcatggaagatgctcattcagcattgctagatcttgacaatgagacggcattcttcggtgtttttgatggccatggaggaagggtggttgccaaattctgtgcaaaatatctacactctcaagttctcaaaagtgaagcatattcttctggtgatctaggaactgctgttcataaagctttctttagaatggatgaaatgatgcgaggacagagaggttggagagaactatctgcactaggagataagatgaacaagttcagtggcatgatagaagggttgatttggtctccgagaggcagtgattcgaagaatgcagaagatgactgggctctagaggagggaccccactctgactttgatgggccaacatgtggaagtacagcatgcgtagcactagtaaggaataaccaacttgtcgtggcaaacgctggtgattcccggtgtgttatttctagggctggccaggcatacaatttgtccagagaccacaagccagagcttgtagctgagagagaaagaatactaaaagcaggcgggttcatacgcatggggcggataaatggaagtttgaacttagcgagagcgattgggagatatggaatttaagcagaacaaattcttgcctcctgagaagcaaatagtgacttcaaatcctgacatcaatgttgtggagctttgcaatgaggatgactttcttgttttagcatgtgatggcatttgggactgtatgtcaagccagcagttggtggatttcatccatgagcatatacacacggagagcagcctttctgcagtgtgtgaaagagtgctcgacagatgcctggctccatcaacaatgggcggagacggatgcgacaacatgaccatgatcttggtgcagttcaaaaaaccagtcagtgacaagaaaaaggctgacgtgggggagcaatctgcaaaaggcaaggaagagtcttgaggttcagtgagtatacgtgttatgcgaaggctccactggtgctgaggtctacggctcttgacacgggctaggatgctaagttgtcaatgtgaaattgtgtgcactctgtggctggggtatcgactgtatatcagtcgattgctgtggttggcgtgcattctgcctgcgaacccaggataaatcacattgcttggcgcaacatcgaaatcctggcactcaacttctcttagccgctctgttcgtcattgtacaatccatggtttggatcatccacgcctcccaaattcataatttggtgttttgttatagtttgtgtgtatgctgtaaacgtggctggggtgttcctttgttctttggtggtatattccatgcctcagtggctgtggctgttgttctgatcttgtaatgtatcaaatctgaatccagtgtgtttctgttctttgccacgaatatattctttagttgtttgccaagaaaaaaaaaaaa

SEQ ID NO: 1432 - DNA, 2160 bp, Triticum aestivum
cacactgtcagctgacagcccacactccaatcaatccttccttccttccttccgtccgtcctcaccccctcctcctccctcccggcgatcgcagagaattcgccgccgccgcgactccgcgccccgcctcgcgcccctcggagccggtccgcctcagctccagcgccaagagcatattgacgaccaaggggccttgagagataggatatactggtacacatattggcatgttaagaagaagcattggagctacttggtgtagccattatcggacgtgcgctacgccgttatccgcaacattgtgagtagaagttacgaccgtaatctgtttccaaccttattaattctggacctggtgcattcacgaagatgggagtttaccttagtacccccaaaactgagaagctatctgaagatggggaaaatgatcaacttaaatttggactttcatctatgcaagggtggcgtgcgagtatggaagatgctcattcagccttgctagatatcgatgaggacacatcattcttcggtgtttttgatggacatggaggaaaagtggttgccaaattctgtgcaaaatatctacacagggaagttctcaaaagcgaagtttatttagctggtgacctgggagctgctgtccatggagctttcttcagaatggatgagatgatgcggggtcaaagaggctggcgagaactacaggcacttggagataaaataaaccagtttactggcatgatagaagggctgatctggtctccgagaggcagtgattcaaatgatcgacatgatgattgggcttttgaggagggacctcactctgattttagcgggccaacctgcgggagtacagcctgtgttgcaatgataaggaatagtcaacttgttgtggcaaacgccggagattcccgctgtgttatctcaaggaatggccaggcatacaatttatcaagagatcacaaaccagagcttgaagcagagagagaacggatattgaaagcagggggttacatccaaatgggacgagtaaatggaactataaacttgtcaagagcaattggagatatggaatttaaacagaataaattcttgtctcctgataagcaaatgttgacagcaaaccctgatgtaaacactgtcgagctttgtgatgatgatgactttcttgttttagcatgtgatggcatttgggactgcatgtcgagccaacagctagtcgatttcatccatgagcacctaaagacagagagcagcctttctgcagtgtgtgaaaaggtgctcgatagatgcctggctccatcaacattaggtggagaaggatgcgacaacatgacgatgatcctagtgcagttcaagaagccaattgaccatggcaaaaatgccagtgctggtgaacaatcagctgttggggataagaatgtaagtgctggtgaacaatcaacggccgaggataagaatgctagtgctagcgatcaatcagctgtcgaggacaagaatgctagtgctggtggacaatcagctgtcggggacaagaatgctagtgctggaggacaatcgcctggtgacatagaacagtccgcgaacgaggagaagaactcgtgatgtcatgtcgtagcctggtaaaccctgtgtactaaacaatgacttctgaatcctggtgtgatgtactgatgttgtagtgggttgagcatgcatggtgaagaaattcatgtgtaaatatcaaccgtgtgttgaattgttgatacaaccagtggatacccccatcagtgaggggggcacgctggttttttgtgctgtttctctgtaactaatcgattatgtcttgtctcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttctttgggcccttttagagggcccaatttttttccccccgggtgttgtgaaaagaaaagattttttatttgtggggccctcaaaattaaaatttccgcggggcccgggtttttaacaacaaccggtgggtgttgggaagaaaacacctcggggggggttccccccaatttttatatccgcgcttgtgtggaaaaa

SEQ ID NO: 1433 - DNA, 2636 bp, Panicum virgatum
catttccatccgtggagagcctctccctcccaccctgctctgttgagaagacaggaggcacagccaccaccagagccaccagtccaccgccgaaaccaggcactccccccacctcgtccctccgccgcctccccccgcgccggtttccctcctccgcgtccgccgagcccgccccctcccccgccgcgcgcgcgcgagcccaagactgtcaaactgcaacgaatctggacgctcctgcctatgcgtgatgtctaccagggatattgtttagtgctggggaagttgtgtggttttggatcataaattccccaggaacaaggcaactatggaccgtgcggacacatcaggatttgtcagtggtggttgctttggtactacactcctgatattcttccatttcgtctattctacagtccatttctgaaagatcattaagccttcagctatctgggcagaaagatcaccaggccctgttctttgagctctctagtgtttgatcttattttgttttccacgattagtcttgtcttgattctgatggatgacagcttcatgaacatcccccacccgcctccgatgaatgacccctttgtgttgggatgctcagcaccaagctccactatggagaacattggccaaagcacattctgtatggacggtctgagcccaacaacagcaaactgtagccatgtcaatggaaatacgcagataatgaatgacatagcagcaagagatgatggcagcagattagtccttggattgggtccaacacccaatttttattctgcagattgtcagtccattgggtcaaaacaagctcagaggttgtctggtcagagttccactttcattgatccagggatgctgaggcttggccttcaaatggatggtggagaagctattcaatgtctgcaattaccaaatggaacagtccattctttctgtgtcgttgatgaggcttcaacatctgctactgtaagaaacatgggcggttacatgccatctctactctttgctccccgctccaattctactgttaatgaggcacaagtagaaatcccagattctctagacctcacacatagcaccaatagcagccaacatcttcaacatcatcttcagctcagccctgagccttctgcaatgaccgaatcttcatttggtgtgagttctgatgttgtcacggcagcaactacatcagaacaacgcagccatccccgacaccctaagaaatgcaggttcaagggttgctccaaaggtgcaagaggcgcatcaggattgtgtattgctcacggaggcgggcagagatgtcataaacctggatgccacaaaggtgctgaaagcagctctgcctactgcaaagcacatggtggtggtcgtcggtgtgaggagcttggttgcacgaaaagtgcagaaggaaaaacagattattgcattgctcatggtggaggccaccgctgcgaacatcctggctgtcctaaagctgcacggggtaagtcagggcggtgcatcaagcatggaggtggcaagagatgctcggttaaaggttgcattcggagcgccgaggggaaggctggactgtgcatttctcatggtggtggccgacgatgccagtacccggactgtggcaagggggctcagggtagcacattgtactgcaaggggcatggtggtggcaagaggtgcatctttgatggctgcagcaaaggcgcggagggtagcacacctctgtgcaaagctcatggtggtggtaagcgatgcatgtttgaaggaggcggcgtctgtgcaaagagtgtgcacggggctactgaatactgcgtggcacatggaggagggaagcgctgttccgtgcctggctgcaccaagagcgcccgtggccgcactgactgctgtgtgaagcatggtggtggcaagcggtgcaaggttgacaactgcggcaagagcgcccaggggagcacagacttctgtaaagcccatggtggaggcaaacggtgcacatggagcacaggctgtgagaagttctcccgtggcaagagtggcttctgtgctgcacatggtaccttgatggctaggcagcgagaacaagaggcggtgaagaatgtaggaagcatgattggaccaggtctcttcagcagcatcgtggtgtcatctgccaccatgggaagcagcatgacgaatgagctctcatcctcaggtatcagcaccgcgtcagattgtgatggcaccgttaggagccaatcgatgattcctccgcaggtgctggttcctcgctccatgatgcccccttggtcatctgagcctgtagatgggggcagagagggaggtcatgttgttcctgaggggagggtgcatggtggtggcctcctatcacttctcggtggcagcttcaggaacgctgatgtggaaaagctttgaagctagtgcttttccatctgcaaatttggtctgtttgtttgtatataaacagaggcgctttgccatctattgaattcttattgtaccttttcttgtctagataaacgtttagattttcatgtattgttagtccattgtaaagtggtgactggcaattgttatgaactcttttggctcgtcggttcattcatggtcagtactgcaataaaatttgtgtattt

SEQ ID NO: 1434 - DNA, 1243 bp, Zea mays
gggagagtatggccgccccagcgtcgccgtactgttcccagtaaagacggccactccttccctccccccttctcccctccgtcttcttcccccaggggcatccgtgttttcactttttgctcccccacgttgaaccttgatcctcgtgctccctttcttgattctttctccgtaggatctcttgctaggagtagcctgccccgtgtgcgcgctcgcacggacatgcttgtttccgcgtcttgaaaggcgagaaaaagtggagatgggtgcttgcgcttcggtacacaaggacccggggcaccccaagaagcagtttcttgactcgcccaccaaggcgaaggccgccaacgggaagggtggcgggggcggcggtgttgctccggttggtgatggcttcggtgatctcaagtccaaggtcgacgctgaggctgagcagctgcgggcagagtttaaccccaagaacccggattctggtagcaaggatgaagtgttcttcgaatctcgagcctggttagattccgactgcgaggatgacttctacagcgtgaatggagatttcactccgtctcgtggcagcacacccgtctaccagcccagagcgcagacggtgatgagcagcatctttcagccagacacgcgcagttccaaatcaccggagccttctccgaccggacggaggaagctcgctgagctgctgcaggaggcaatgcaagacggtcccgaagaaagcgccgacgaggaggagcagcagcagcagtcgctatctgctgccgctgatgggaagccgccggtgtctgagtccacgtccagctccgcttgcagcaccgtgccgactccggtcgcagtcgccaagagccggaaggagaaggcgtggtacaccggacgctgttgcctgccgagctttgttcatagcctgaccttagacgagagtgagagggggcagaagatgagctctaggccatgtgctgtttgactgtggggctccagtgccctcctgagtcctgccctgagctgtatttagcgcgatatgttatctgaatgcccgattgggacgctgaagctactgtattgagagtactatatagtaatcaagtggataataggcactcgttaaatcctgtggagaccatgtgtatgtgtcgaccaatttgcgcgggtagagcatctacctcaaggaattgcccttccctgtgcatgtctaactgaatctttgaataaataaacacactgtataatttttcag

SEQ ID NO: 1435 - DNA, 1161 bp, Zea mays
gtttcctagtaaaagacgcccactctttggctcctcgcctccctcctcccctccgtctcatctcctccctgtaggctgtaggagcattcgtgtgttcaccttttgctcccccacgttgatccttgaccctcgtactcctttcttgattccttctccgtgggatctcttgccaggagtaacctgccccgtgtccgcgctcgcactcgcacagacatgcttcttgccgcgtcttgaaaggggagaaagtgaagatgggtgcttgcgcttcagttcacaaggacccggggtaccccaaggagcagtttcttgactcgcccaccaaggcggaagctgcaaacgagaagggcggctgcggcggcggtgacgatgactttgctgatttcaagtccaaggtcgacgctgagcagcagcgggcagagttgaaccccaagagcccggattctggtagcaaggatgaagtgttcttcgaatctcgagcttggttagattccgactgcgaggatgacttctacagcgtgaatggagatttcactccatctcgtggcagcacacccatccatcagcccagagcgcagacggtgatgagcaacatctttcaaccagacacgcacggttccaaatcaccggagccttctccaactggacggaggaagctagctgagctcctgcaggaggcaatgcaaaacggccccgaagaaagcaccgaccaggagctgcagttgcggtctgttgccgcagatgggaagccggtgtctgaatccacatccagctccgcttgcagcactgtgacgactccgatcgcagtcgctaacgccaagagccggaaggagaaggcgtggtacaccggacgctgttgcctgccgagctttgttcatagcctgaccttagatgagagtgagagggcgcagaagatgagctctaggccatgtgctgtttgacagtggggctccagtgccctcacggctcatgccctgagctatactgtaaaggagaagtattaagagtactgtatgtatagagagagggtaatcaagtggataatagctactagttaaatgctctgcacaccatgtttatcaattgcccttacctgtgtatatatatctaatcgaatctcaaatgtcaacagccagctgagctgtcctcttggcacttgcattt

SEQ ID NO: 1436 - DNA, 1069 bp, Saccharum officinarum
  misc_feature (137)..(137): n is a, c, g, or t
  misc_feature (370)..(370): n is a, c, g, or t
  misc_feature (696)..(697): n is a, c, g, or t
  misc_feature (1038)..(1038): n is a, c, g, or t
ccagtaaagacgcccacaccttccctcccctcccctcgacctctcccctccgtcgtctcccccaggagcatcgtgtcttcaccttttgttcccccacgttgatcgttgatcctcgtgccccctttcttgattctttncccgtaggatctcttgttaggagtagcctgccccgtgtgcgcgctcgcacggacatgcttcttgccgcgtcttgaaaggggagaaaaagtggagatgggtgcttgcgcttcggttcacaaggacccggagtaccccaagaagcagtttcttgactcgcccacaaaggcgaaggcagccaacgggaagggcggcggcggcggtggcggtacggcggcgttgctccggttggtgntggctttggtgacctcaaggccaaggtcgacgctgagcagcagcgggcagagtttaaccccaagagcccggattctggtagcaaggatgaagtgttcttcgagtctcgagcttggttagattctgactgcgaggatgacttttacagcgtgaatggagatttcactccatctcgtggcagcacacccatctatcagcccagagtacagacggtgatgagcaacatctttcacccagacacgcacagctccaaatcaccggagccttctccaactggacggaggaagctagctgagctcctgcaggaggcaatgcaagatggccctnnagaaagcaccgacgaggagcagcagttgcaatctgttgccgcagatgggaagccggtgtctgaatccacatccagctccccttgcagcactgtaccgactcctaccgcagtcaccaagagccggaaggagaaggcgtggtacaccggacgctgttgcctcccgagctttgttcatagcctgaccttagatgagagtgagagggggcagaagatgagctctaggccatgtgctgtttgatagtggggctcaagtgccctcctgccctgagctgtatttagcgcgatatagtacccgattgggacgctgaagctactgtaaagaagtggagagtattaagagnactatatatatatatatatatatatatatat

SEQ ID NO: 1437 - DNA, 1363 bp, Panicum virgatum
ggccgcactgctcccactcgcagtaaagaagcctactccccttcccctcccgtcctccccttggcttctggccttcgtttcttccccgcacgagcatccgcctcttcaccttttcctaccccgcgtcgatccttctctcgctccttttctcgattctttctccgtaggatctttggataggagtagcctgcctcgtgtgcgcacttgcacggacatgcttattgttgcggcttgaaaggggagaaaaacggggatgggttcttgcgcatcggttgacaagaaggatccagggtttcccaagaagcagtttcttgcgtcgaccaccaaggcgaaggccgccaacggcaagggcggcggcgttgctccggttggcgatggctttggtgatctcaattccaagatcgaggcggagcaacagcggggagggtttggccccaagagcccggattctggtagcaatgatgaaatgttctttgaatctcgagcttggttagattcagactgcgaggatgacttttacagtgtgaatggagatttcactccatctcgtggcagcacaccaaactatcaacccagaacgcaaacagtgatgactaacatcttccgacctgacaatttggacaagtccaaatcatcggaagcctctccaactggccggaggaaattagctgagctcttgcaggaggcaatgcagagcggcgatgaagaaagcacctatgttgtcagcaaggacgagaagcagcaattacaatctgtcgccgtagatgggaagccggtgtctgaatccacatccagctccgcttgcagtacagaaccgacgccgaccatggtcaccaagggccggaaggagaaggcgtggtacaccgggcgctgttgcctgccgagttttgttcatagcctgaccttagatgagggtgagagggggcagaaagtgagctccaggccatgtgctgtttgacagtggtgctccagtgccatcctgccctgagcggctgtatttagcatgacatattacccgatccggaccctgaagctactgtaaagaagggggagggggtattaagagtactatatccttgtaggaatcaagtggatgtactcgtaaaattgatgtgcactgcatgttgatcagctgtgagagtagagcatttagctcaagaaattacccctatctgtgcgtaccttctcgaatttttatgggtataaacatatatttttccagatgtcaaaaaaaaaaaaaaagggcggccgcccttttttttttttttttacacgggaagccatatatatgtgaatcaaattaacgcacctactacagtatagagatgcaattaacactactagatatactaaaatacatcat

SEQ ID NO: 1438 - DNA, 1851 bp, Zea mays
ctctctgccagctccagcttcttccaccgcggggccacacccacaccacaccacgacctccgcgacgctcgcggccgtgtttctctcgcctcgctccctcggatcgcccgttcgcccccgcccatcgctcgctcatcagaaggagggcctagccttccgcagcagcgctcgtcagactccgccgcccgcaattccccccttgccccggcttttaatgggctttccctcccaccgaaatggccggcgatccctgcacccgcgccgccggtgaccgccccacctcctccgtcgccttcttctccgccgggggcgggctcggcctcggcccctccagcctgctgctccacctgctcctcctccactccctcttatagcctccagcctcccctcgcctcccgccaccccctatggccgccgttttcttccaccacgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccggacgacccgccctcgggggccaggttcatcggcatgatctccgcgctcgacatcgctgccttcgtcgcctccgcgggggtcggggatcgctccatgcgcgccgtcgtcggcgaggtcgtgcagcccaatcctgcgctgctcagggagatcgatccgggtaccaggttgatcgatgctctggaactgatgaggcatggagtgaagcgctttcttgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattcagaagatccctcaagacccatgcgccgttgctgtagtggagacgatgccagatggaactcgtagcatactaggagacatctctacttacaagctgtggaaatgtgactatgtttcagctgcatgggcactggcaaacctgtcagctgggcagtttgtcatcggtgccgacgagaatgggtcaacacccatctcagtcttcccagagcctcccatcagcccatcgtcaccggtggaggagatcagtcctgggcgctcgccaagggcgaagaagttcagcagcaggagcatcgggtttctgaacaacacccagatgtcagcgtggcggacacggagcatgtaccaccggggcaggagcaccccactgatgtgcaagaccacaagcaccctcgcggccgtcatggcgcagatgttgtcccatcgggccacacacgtctgggtgacggacgcagagtcggaggaggacggcgtcgtcgtcggcgtggtgggctacaccgagatcttcaatgccgccaccaggagcacctgcccaagtccgacagcatcttgatgcaccacatcgtgctgtacagtatactgctgttggttgatccgttggtgccccggtgcacgctgttgcactgaactgtacaatgtactttgctcatttgttggtttgtctggagagtttttagtcttttagatattcttggtctgcatggagcaggacttggtggtatattgttgcattcgttgtggacggtacgaataagaattcgggtttgcctcgg

SEQ ID NO: 1439 - DNA, 1753 bp, Oryza sativa
cagacacagccgagctcaggcgacgacgcccccgcctttaatgggctttccctcccaccgacatggccggcgatccccacacccgcgccgcccccggtgacctctcctcctcctccttctccttctccccctccccttccgccgccgcggttgcgcttggagttgggggtggcctcggcctcggcccctctaggctcctcctccacctcctcctcctccactccctcttatagcccaccgccaccggccgccgcgcgcccatggccgccgtgttcttccaccatgttgtcggcgacctcaccgtcgggaagcccgaggtcgtggagctgcacgacaccgacacgccccgggcggcgcccgacgagccgccgtcgggcgccaggttcctcgggatgatctccgcgctcgacatcgccacgttcgtggccgcttccggcgtcggtgaccgggccatggccgccgtggtcggggaggtcgtgcagcccaaccctggcctgctccgggaggtcgatccaggcacgaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacggacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacactgcgcctggttggttcttttttgtctttcgagagttggggagttttttgtccgcatgagactgaaactgaagggtatattgtgaattccttgtggatcggtgctactatggcagactcaggcttgtgctttggtacggtggaatgatagtctactcattcgtatatgtataatgtatcgtttctctgtgctcccttaccaatggcccaatgggatcagagatggggtaattaacccagcagctgccatttcttgtcaa

SEQ ID NO: 1440 - DNA, 2099 bp, Sorghum bicolor
atccgctctctgccagcttcttccccgcgggaccccctaccacacctccgcgacgctcgcggccgtgtttctctcgcctcgcctcgtctcgtcttgctcccttggatcacccgttcggccccgcccgtcgctcgctcatcagaaggagagcctagcgttccgcagcagcgctcgtcagactccgccgcccgcaattccccccctgctccggcttttaatgggctttccctcccaccgaaatggccggcgatcccagcacccgcgccgccggtgaccgccccacccccgccgccacctcctcctcctcctcctcctcctccgccgccgccttcttctccgccgggggcgggctcggcctcggcccctccagcctgctgctccacctgcttctcctccactccctcttatagcctccagcacccgtcccaccccctccccactatggccgccgtcttcttccaccacgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccctacgatccgccctccggggccaggttcatcggcatgatctccgctctcgacatcgccgccttcgtcgccgccgcgggggtcggggaccgcgccatgcgcgccgtcgtcggcgaagtcgtgcagcccaatcctgcgctgctcagggagatcgatccgggtaccaggttgatcgatgctctggagttgatgagacatggagtgaagcgcttccttgttcgcaagagtgggagctggaaaggcattaccaagagattttcagtgctttttaatggcaaatggctgaagaacatggaatcaacatctccaaatgcagccagcagcagcagcatgccgctatccccgccttctggttctgcagacaagttttgctgcctatcaagggaagatgttctccggtttctcattggatgccttggtgctcttgctcccatcccgctgactcagatatcttcccttggagccatcaacccgcagtacagttacgtggaagcatctgcacctgccatggaagcaattcagaagatccctcaagacccatgcgccgttgctgttgtggagacggcgccagatggaactcgtaagatactaggagacatctctacttacaagctgtggaaatgtgactatgtttcagctgcatgggcactggcaaacctgtcggctgggcagttcgtcctcggtgccgacgagaatgggtcgatgcccatctcagtcttcccagagcctcccatcagcccatcctcaccagtggaggagatcagtcctgggcgctcgccaagggcgaagaagttcagcagcaggagcatcgggtttctgagcaacacccaggctagccagatgtcagcgtggcggacacggagcgcgtaccaccgtggcaggagcaccccgctgatgtgcaagaccacgagcaccctcgcggcggtcatggcacagatgctgtcccaccgggccacgcacgtctgggtgacggacgcagaatcggaggacggcgtcctcgtcggcgtggtgggctacaccgagatcttcaatgctgccaccaggagcacctgcgcgagtccgacaacatcttgatgcaccactccgtgctgtacagtagactgtacttggttgatctgttggtgattgccgccagtgcacaacgttgcactgaactgtacaatgtacttggctcatttgttggtttgtccggagagttctagtcttttagatatccttggtttgcattggagcaagacttggtggtatattggtttgcattcgttgtggacggtacaaataagaattcgggcttgcctgggaatctagtccattttgcatgctcacctacagctgcagctgtcaatgcaccctatgagcatatggaatgttctctgtttcctttcacatgcttgcatcctttccctgtatgtctaattgattcatgtgcatgttttgagggggtgatcggttgggccctaagcagcttttcctggtgctatgctcgctctcaagcgtctgat

SEQ ID NO: 1441 - DNA, 1756 bp, Zea mays
ggagtataaaagctagctccggtccccgggggccgcggcctcgggctgccgctggttccgaacgcgtggtgcgacccgggattccctcgcgcttctctgtgtccccttcctccggcctgaggggaggaccccgcagatcccatcgaaattcacggccggcctaacccaagccggtcctccccgactcccggcgacgaccaatttctccttgttctcgcccctccaacccttcatgatgcttagataatatacagtgctgggttttagcactgttttgagtttttaaattgagctaaggcttcagtgttagtcttgaaagatgaacggttcaagtggttcccaagggcatcatgtcagtggagagaagaagcaagtgtgtcatgttagccggcccattcttaacaatggaccaaagcaccgtccattgacccccatgaggcgatgccgtggtgtagcatgtgtagtgattatactgtcaacagcattcctgttggtagtttacttggctcctattactacttttgctgtgcggctgttcagtgtgcattacagccgaaaggcgacttcctttctatttggaatgtggttatctttatggccgttcttgtttgagaagataaacaaaaccaaggttgtcttctccggtgaaaatgtgcctccaaaacgacgtgtattgttatttgctaaccacaggaccgaggttgactggatgtacttgtgggatcttgcactgaggaaaggccatttaggatatatcaagtacatacttaagagcagcttgatgaagttgcctatttttagctgggcatttcacatttttgagtttatcccggtagaacggaaatgggagattgatgaagcaattattcagaacaagctatcaaaatttaagaacccgagagatcctatctggttggcggtttttcctgaaggcacggattatactgagaagaaatgcatcatgagtcaagagtatgcttcagaacatggcttgcctatgctagaacatgtcctccttccaaagacaaagggcttcatttgttgtttgcaagagctgaggagttccttagatgcagtttatgatgtcacaatagcatacaagcatcgactcccagattttctggacaatgtgtatggcgttgatccttctgaagtccacatccacgtcagaatggttcagctccatcacatccccacaacagaagacaagataacagaatggatggtagagaggtttaggcagaaggaccagctcctggcagatttcttcatgaaggggcactttcctgatgaaggaactgaaggagatctgtcgacgccgaagtgcctggcaaacttcttaacagtagtatgcttgacggccatctgtttgtacctaactcttttctcatttgtgtggttcaaggtctatgttgtagcaagctgcgcttacctctcatttgttacctattactccatactaccaccccaactgataggttcaccagagggtgatgtcaaggccaaaaaggttgtgtagatgttgatgtaacttgccatgaaaactgtacatccgcaaacgatttttactgctggagtttctgccttgtgacatttaaggttccctttctgcagtaggaggtatgaatgtatgatagtgcgtatgtaggaattttctgtgattcatcagtgtgtgagggccctatctgaaggcagtaaactgattttagatatatgttcttaacatttttataaacaaaactagaccacatttgtt

SEQ ID NO: 1442 - DNA, 1898 bp, Sorghum bicolor
atgccaccgtcgcgagtcgcgacccgcggccggccggggccggctggccgccgctcaaccgcgaccgcgcccctgacgcgggacgctcccgcaccgcagccgcccgagagagagagagagagagagagagagcggcctgcgcctacctacctgcctgcctgccctgcagcctgcagcagactgatgattagagcgcgtgcgcaggagtataaagctatctccgctcgccccggggccgcgccatcgggctgccgctgcttcctatcgcgtggtgcgacccgggattccctcgtgctccttctgtccccttcctccgccctgaggggagcgggaggaccccgcagatcccatcgaaattcacggccgaccgaaacccaggccggccccctcccccggctcccggcgacgaccgattcctccctgttctcgttcctcctacccttcatgatgtttagataatctgtggtgctgggttttagccctgttttgaatttttaaattgagctaaggattcagtattagtcttgaaagatgaatggttcaagtggttcccaagggcatcatgtcagtggagagaagcagcaagtgcatcatgttagccgacccattcttaacaatggaccaaagcaccgtccattgacccctatgaggcgatgccgtggtgtagcatgtgtagctattatactgtcaacagcattcctattgatagtttacttggctcctattactacttttgttgtgcggctgttcagtgtgcattacagccgaaaggcgacttcctttctatttggaatatggttatctttatggccattcttgtttgagaagataaacaaaaccaaggttgtcttctctggtgaaaatgtgcctccaaaaaggcgtgtattgttatttgctaaccacaggaccgaggttgactggatgtacttgtgggatcttgcactgaggaaaggccatttaggatatatcaagtatatacttaagagcagcttgatgaagttgcctatttttagctgggcatttcacatttttgagtttatcccggtagaaaggaaatgggagattgatgaagcaattatccagaacaaactatcaaaatttaagaaccccagagatcctatctggttggcggtttttcctgaaggcacggattatactgagaagaaatgcatcaagagtcaagagtatgcttcagaacatggtttgcctaagttagaacatgtcctccttccaaagacaaaggggttcatttgttgtttgcaagagctgaggagttccttagatgaagtttatgatgtcacaatagcttacaagcatcgactgccagattttctggacaacgtatatggtgttgatccttctgaagtacatatccacattagaacggttcagctccatcacatccccacatcagaagacgagataacagaatggatgatagagaggtttaggcagaaggaccagctcctgtcagattttttcgtgaagggccactttcctgatgaaggaatggaaggagatctatcgacgccaaagtgcctggcaaactttttaacagtagtaggcttgacggtcatctgcttgtacctaactcttttctcatctgtgtggttcaaggtctatgttctagcaagctgtgcttacctctcatttgttacctattactccatactaccaccccaactgataggttcaccggagggtgatgtcaaggccaaaaaggctgtgtagatgttgatgtaacttgcgatgaaaacttatatgcgcgaaggatgtttactgctggaattcatggattgtgccgttaaggttgcctttctgcagtagtaggagaactttcttgtgcttcatcagtgtatgagggcccttatctgaaggcattagctagtgaagtgtac

SEQ ID NO: 1443 - DNA, 1766 bp, Panicum virgatum
gccagcggctgcctgcagtggactgacgattagagcgcgtgcgcagtataaagctccgctcgccccgggggcgcggctccagtgtgcctgccccttgttcctatcgcgtggtgcgacccgggatcccctcgtgctcccctgtccccctccgccgccccgagggcgaggaccccgcagatcccatcgaaattcacggccgcatccaggccggccctcacccggctcccggcgacgaccaattctccccctgttgtcgtttctcctaccttcatgatgtttagataatcagcggtgctgggttttagccctgttttgaaattttaaattctgctaaggattcagtcctagccgtgaaagatgaatggctcaaatggttcccaagagcatcatgtcaatggagaggagaaggtagtgcatcatgttaaccggcccattctgaacaatggaccaaagcaccgtccatttacccccatgaggcgttgccgtggtgtagcatgtgtagcgattatactgtcaacagcattcttattgatagtctacttggcccctattactacttttgttgtgcggctgttcagcgtgcattacagccgaaaggcgacttccattctgtttggaatttggttatctttatggccattcttgtttgaaaagataaacaaaaccaaggttgtcttctctggtgaaaatgtgactccaaaaaggcgtgtattgttatttgctaaccacaggactgaagttgactggatgtacttgtgggatcttgcactgaggaaaggctatttaggatatatcaagtacatacttaagagcagcttgatgaagttacctatttttagctgggcatttcacattttcgagtttatcccggtagaacggaaatgggagattgatgaagcaattatccagaacaaattatcaaaatttaagaaccccagagatcctatctggttgtcggtttttcctgaaggcacggattatactgagaagaaatgcatcatgagccaagagtacgcttcagagcatggtttgcctaagctagaacatgtcctccttccaaagacaaaggggttcatttgttgcttgcaacagctgagaagttccttagatgcagtttatgatgtcacaatcgcatacaagcatcgactgccagattttctggacaatgtatatggcgttgatccctctgaagtccacatccacatcaggacggttcagctctctgacatccccacatcagaggacgaaataactgaatggatgatagagaggttcaggcagaaggacaagctcctgtcagattttctcgcaaagggccacttccctgacgaaggaactgaaggagatctatccacaccgaagtgcctagcaaactttttcaccatagtcggcttgacaggcatctgcctctacctaactctttgctcgtctgtgtggttcaaggtatatgtcgtagcaagctgcgcttacctctcctttgttacctattactccatactaccaccacaactggtagggtcaccggagggtgccaaaaaggctgtgtagaagatgatgtagcttgtgactgaaaattgtatatccgccaaagatgtttttactgctggaagtcatggcgtgtgaccttttctctctaaggcgtgtgccatctcaaggtttcctttctgctgtagagcgatatgtgtattgagaatttttctggtggttcatcagtgtagaagggctattatctgaaggcagtgaaacgtgctgggagctggagattg

SEQ ID NO: 1444 - DNA, 1543 bp, Brachypodium distachyon
ttcttcgcctttctctggctctcgcgtctcgcctcgtcttccccaactaccttcctctctccttcaccacccgcgtcggcaccaaatccctccacgcctctcgatccctcgccgtcgccagcgtcgcagctaaaactctacgtcgctctggtggccgcctccgggtacgtaaagaattaattaccatgagctctctctgccctttcgcaaaagctaccactggtggtggtggtgtatgccccatgaaatctgacaagaacagcagcacggtcaaatctaacaagaatgacagcagcagtgtatgcccagtaaccggcaagaataacggcgaagagcacaaggaaagtggcaccgaccatgccggagaagagagtcctgaccctcgtatggtgcctgccaagtgcccctttggctatgactccaacacgttcaagctcggtcccctcagttgcatggtctgccaggcactgctccatgacacaagcaaatgcaaaccatgctcgcataagttctgcaagacatgcatatcacgatttaaagactgcccgttatgtggtgctgacatagagggggtcgagccagatcccgaactccaggcccttgttgatcgcttcattgacggccatgcccgaatcaagagatcacttgctggagggggcgtggaagaagtcgatggcaagagcaaggtgatatatgaggatgtctccatggaaagaggtgcttttctggtgcagcaggctatgagggcttttcgtgcacagaacattgaaagtgccaagtcaaggctcagtatgtgtgcagaagacatcagggaggagttgaaatctgcagaagataacctagatctatgttctcagcttggggcagtcttaggaatgcttggggattgctgtcggaccttgggagacgcttcttcagcgatcacttactatgaagaaagtgctgagtttctctcaaaattgcccacaaaggatcttgagttggtccatacactctcagtttcactcaataaagttggagaccttcgctactatggtggggacctacaatctgcaagaagttactatgctcgttcattgagtgttcgccaaaaggcagtaaaggaacacccgtctgtggcctcccaggtaattgatctagcaacttctctagccaaagtcgcggatgttgatagaaatctaggtaaccaagatgcggcagtcgaaggttttgaggaagccatcaagtcccttgagaagttgaatctggattctgagcaagctggtcttgagcaacggcgccgctccgttcttgactttctgcacaaacagttggattcgaagtaatgcagatggtctgccaggccgaggtatcgttgggggagtacaagtctgaagaccatgcatcgtcgatcatagatctaataccaacatattagtctgcaccgtatcatgcatgctgtttcgcttctgccagtgtaaatgtgctggtcttgtatatgcaccatcgtgtataacttcatgtgcatctctgctgcttataaagtcaccaacacattcatttc

SEQ ID NO: 1445 - DNA, 1159 bp, Brachypodium distachyon
aattaattacaatgagctctctctgcccttttgcaaaagctaccactggtggtggtggtgtatgccccatgaaatcgaacaagaacagcacggtcaaatctaacaagaatgacagcagcagtgtatgcccggtaaccggcaagaataacggcgaagagcacgaggaaagtggcaccgaccatgccggagaagagagccctgaccctcgtgtggtgcccgccaagtgcccctttggctatgactccaacactttcaagctcggtcccctcagttgcatggtctgccaagcactgctccatgacacaagcaaatgcaaaccgtgctcgcataagttctgcaaggcatgcatatcacgctttaaagactgcccgttatgtggtgctgacatagagggggttgagccagatcccgaactccaggcccttgatgatcgcttcattgacggccatgcccgaatcaagagatcacttgctggagggggcgaggaagaagtcgatggcaagagcaaggtgatatatgaggatgtctccatggaaagaggtgcttttctggtgcagcaggctatgagggcttttcgtgcacagaacattgaaagtgcaaagtcaaggctcagtatgtgtgcagaagacatcagggaggagttgaaatctgcagaagataaccttgatctatgttctcagcttggggcagtcttaggaatgcttggggattgctgtcggaccttgggagacgcttcttcagcgatcacttactatgaagaaagtgctgagtttctctcaaaattgcccacaaaggatcttgagttggtccacacactctcagtttcactaaataaagttggagaccttcgctactatggtggggacctacaatctgcaagaagttactatgctcgttcattgagtgttcgccaaagggcagtaaaggaacactcatctgtggcctcccaggtaattgatctagcaacttctctagccaaagttgcggatgttgatagaaatcttggtaaccaagaagcggcagttgaaggttttgaggaagccatcaagtgccttgagaagttaaatctggaagattctgagcaagctggtcttgagcaacggcgccgctccgttcttgactttctacacaaacagttggatgcgaagtactaatgcac

SEQ ID NO: 1446 - DNA, 1261 bp, Festuca arundinacea
  misc_feature (129)..(130): n is a, c, g, or t
  misc_feature (136)..(136): n is a, c, g, or t
  misc_feature (228)..(228): n is a, c, g, or t
  misc_feature (236)..(236): n is a, c, g, or t
  misc_feature (243)..(243): n is a, c, g, or t
  misc_feature (255)..(255): n is a, c, g, or t
  misc_feature (537)..(537): n is a, c, g, or t
  misc_feature (845)..(845): n is a, c, g, or t
ggcacgaggcatcgccattcgatttgcttcttcctatccacgagaggagaccagaagaggcgtcgtcgcagtcgcagtcgccgtcgccggccgatcaaccgcccgcccgcacaccaacgagagcctgcnnagaaanaatctcagtaaagaatcggcatgagctccctctgcccgttcgcgaaagccaccaccggcggcgtgtgccccatgaagtctgacaagaagccngacaagancggcagnggtgcgtgcccngtggccggcaagagccacgacaaggaaagcggcgccgaagaccgtgccggaggagatgaagaccctcggctggtgcccgccaagtgcccctttggctacgactccaacaccttcaagctcgggcccctcagctgcatggtctgccaggcactgctccacgacgccagcaagtgcaagccgtgcttgcacaagttctgcaaggcgtgcatatcgcgcttcaaggactgcccattgtgcggtgccgacgtagaggggatcgagcccgacaccgagctccaggcnctcgtcgaccgcttcatcgacggccatgcccggatcaagaggtcgcttgctggaggggatggggaggcagcggggggcaagggcaaggtgatatatgaggatgtctccatggagaggggtgcctttctggtgcagcaggctatgagggcttttcgtgcacagaacattgaaagtgcaaagtcaaggctcagcatgtgtgcagaagacatcagggaggagttgaaatcttcacaagacaacctagacctgtgttctcagcttggggcggtattgggaatgcttggggattgctgtcgaaccttgggagncgctccttcagcgatcacttactatgaagaaagtgctgagtttctctcgaaattgcccacaaaggatcttgagttggtccatacgctctcggtttcacttaataaagttggagaccttcgctactatgatggggaccttcaatctgcaagaagttattatgctcgttcattagaagttcgcagaaattcagtaaaggaacactcagctgtggcctcccaggtcatcgatctagcaacttctctagccaaagttgcggatgttgacagaaatctcggcaacgaagaagcggctgtcaagggtttcgaggaagcaattaagtgccttgagaacttgaagctggattctgagcaggctagtctggaacaacggcggtgttcggttctcgacttcctgcagaaacagttggatggcaagt

SEQ ID NO: 1447 - DNA, 1506 bp, Leymus cinereus x Leymus triticoides
  misc_feature (23)..(23): n is a, c, g, or t
  misc_feature (27)..(27): n is a, c, g, or t
  misc_feature (34)..(34): n is a, c, g, or t
  misc_feature (46)..(46): n is a, c, g, or t
  misc_feature (53)..(53): n is a, c, g, or t
  misc_feature (58)..(58): n is a, c, g, or t
  misc_feature (60)..(60): n is a, c, g, or t
  misc_feature (73)..(73): n is a, c, g, or t
  misc_feature (83)..(83): n is a, c, g, or t
  misc_feature (86)..(86): n is a, c, g, or t
  misc_feature (108)..(108): n is a, c, g, or t
  misc_feature (121)..(121): n is a, c, g, or t
  misc_feature (141)..(142): n is a, c, g, or t
  misc_feature (153)..(153): n is a, c, g, or t
  misc_feature (190)..(194): n is a, c, g, or t
  misc_feature (199)..(199): n is a, c, g, or t
  misc_feature (201)..(201): n is a, c, g, or t
  misc_feature (203)..(204): n is a, c, g, or t
  misc_feature (209)..(213): n is a, c, g, or t
  misc_feature (217)..(217): n is a, c, g, or t
  misc_feature (223)..(223): n is a, c, g, or t
  misc_feature (228)..(228): n is a, c, g, or t
  misc_feature (236)..(236): n is a, c, g, or t
  misc_feature (244)..(244): n is a, c, g, or t
  misc_feature (254)..(254): n is a, c, g, or t
  misc_feature (271)..(271): n is a, c, g, or t
  misc_feature (280)..(280): n is a, c, g, or t
  misc_feature (334)..(334): n is a, c, g, or t
  misc_feature (364)..(364): n is a, c, g, or t
  misc_feature (397)..(397): n is a, c, g, or t
  misc_feature (409)..(409): n is a, c, g, or t
  misc_feature (442)..(442): n is a, c, g, or t
  misc_feature (452)..(452): n is a, c, g, or t
  misc_feature (455)..(455): n is a, c, g, or t
  misc_feature (475)..(475): n is a, c, g, or t
  misc_feature (487)..(487): n is a, c, g, or t
  misc_feature (511)..(511): n is a, c, g, or t
  misc_feature (837)..(837): n is a, c, g, or t
  misc_feature (859)..(859): n is a, c, g, or t
  misc_feature (931)..(931): n is a, c, g, or t
  misc_feature (987)..(989): n is a, c, g, or t
  misc_feature (997)..(997): n is a, c, g, or t
  misc_feature (1054)..(1054): n is a, c, g, or t
  misc_feature (1099)..(1099): n is a, c, g, or t
  misc_feature (1133)..(1133): n is a, c, g, or t
  misc_feature (1147)..(1147): n is a, c, g, or t
  misc_feature (1291)..(1291): n is a, c, g, or t
  misc_feature (1294)..(1294): n is a, c, g, or t
  misc_feature (1297)..(1299): n is a, c, g, or t
  misc_feature (1305)..(1305): n is a, c, g, or t
  misc_feature (1307)..(1307): n is a, c, g, or t
  misc_feature (1309)..(1311): n is a, c, g, or t
  misc_feature (1316)..(1316): n is a, c, g, or t
  misc_feature (1322)..(1323): n is a, c, g, or t
  misc_feature (1383)..(1383): n is a, c, g, or t
  misc_feature (1402)..(1402): n is a, c, g, or t
  misc_feature (1424)..(1424): n is a, c, g, or t
  misc_feature (1431)..(1431): n is a, c, g, or t
  misc_feature (1436)..(1436): n is a, c, g, or t
  misc_feature (1451)..(1451): n is a, c, g, or t
  misc_feature (1479)..(1479): n is a, c, g, or t
gccgcctccgccgccgtcgtcgncgcncgatccnaccgcccgccgncccgccngcccnancacggaaccaccngcaaagaatnaancgccatgagctccctctgcccnttcgcgaaagccnccaccggcggcgtgtgcccnntgaaatccganaagagcagcggcgctgcgtgccccgtgaccggcaagnnnnncggcncngnngagcnnnnnggancgtgcngccgnagaagagngcgccgangaccctcgcntggtgcctgcaaagtgncccttcggntacgactccaacaccttcaagctcggccccctcagctgcatggtctgccaggcnctgctccacgacgccagcaaatgcaagccntgctcgcataagttctgcaaggcatgcatatcncgctttaaggantgcccgttgtgcggtgctgacatagaggggttngagccggatnccnagctccaggccctcgtcgancgcttcattganggccatgcccgaatcaagagatcncttgctggaggggacgaccaagcagcggatggcaagagcaaggtgatatacgaggatgtctccatggagagaggtgcttttctagtgcaacaagccatgagggcttttcgcgcacagaacattgaaagcgcaaagtcgaggctcagtatgtgtgcagaagacatcagggaggagttgaaatcttcagaagataacctagacctatgttctcagcttggggcagtgttgggaatgcttggggactgctgtcggaccttgggagatgcgccttcagcgatcacttactacgaagaaagtgctgagcttctgtcgaaattgcccaaaanggatcttgagttggtccatacnctctcagtttcgcttaacaaagttggagaccttcgctactatgacggggacctgcaatccgcaagaagttantatgcccgttcattagatgttcgcagaaattcagtaaaggaacactcagctgtggnnncccaggtnattgatctagcaacctctctagccaaagttgcggatgttgatagaaacctcggtaangaagatgcggctgtcgagggttttgaggaagcaatcaagtgcctngagaagttgaagctagattctgagcaggctagcntagaacaacgggtngctacaatttgcccctttgtctttgtgtcttggtgtgtgttgttctggactaactttcggtctgtacttttttcagcgtcgctcggttctcgacttcctgcagaagcaattgcacgacaagtaagacagatggccccagtgtgnacnacnnntaagangntnnncccancgtgtnntgttgcaatataggagttgttgtggtgcataagggaggagggaggtgctctagaaatggngccttgtgtgtaattccanccacttgaattctgtcgcggcncaaacgngaagnaaggccgcgttgtangtattctaggagagttctcttcactgtngccaatatacggtccaggctctagcta

SEQ ID NO: 1448 - DNA, 2145 bp, Zea mays
aaaaaaataaaaagaaaaaaaataaaaaaaagagaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagccaccactggtggtggtgtatgccctgtgaaatctgataagagcaacactggggtgtgccctgcaaaatctgacaagagcatcagtggtgtatgccctgtcactggcaaggatcatggtagcaagctcaaggaaagtggtgatcatggtgaagaaaagggcaccgatcctcgtgtcgtaccagcaaaatgcccattcggctatgactccaacactttcaagctgggtccgcttagctgcattgtctgccaggcactactccatgaaagtagcaaatgcaagccgtgtgcccataaattttgcaaggcatgtatatcacgctttaaagactgcccactatgtggtgctgatatagagggtattgagcctgatgcggaacttcaagctcttgttgaccgcttcattgatggtcatgccagaatcaagcgatcacatgctgcaggggatgtggaagcagcagatggcaagaacaaagtcatatatgaggatgtttccatggagagaggggcttttctggtgcagcaagctatgagggcttttcgtgcccgaaacattgaaagtgcaaagtcaaggctcactatgtgtgcagacgacatcagggaggagttaaaatcttcagaagataacttagacctatgttcacagcttggagctgtgttaggaatgcttggggactgctgtcggaccttgggagatgttcctgcagcaatcacctactatgaagaaagtgctgagttcctctcaaagccccctgcaaaagatcttgagctggttcatactctctctgtttcactaaataaaatcggtgaccttcgctactatgatggcgacctccaatctgcaagaagctattatgcccgttcattggatgttcgcagaaatgcagtaaaagaacactctgctgtggcttcccaggtcattgatctagcaacttctcttgcaaaagttgcggatgtggatagaaatcttggtaacgaaagtaccgcagttgagggttttgaggaagcaattcgatgccttgagaagttgaagctggattctgaacaaactaccctcgaacagcggcgcctctcggttctcgacttcctgcacaaccagttggccgataagtaagacatagtcttctcctaagaatgcacaaccagcagatgtctcctcatggtaatgttcaactctactacataaggttccctttggaaggagttggtctagaagcagcgatgagtgtgtgtttaccatcgtttgaaactttgtcacggcacaaaataagagctcctgcactgtaaatgtaatcatatatatgctcatcgagtattcttgatgattgccgatatggtttagtagtctaagcactctggtttgtcaatgtcatagcctggagcagcgcataagatgttagttaacttgtggcaagttccatctcgctttgaagtgtcatgtgtgaagacctatcctgttgtatatttgacaataagacagggaggtagtaatcaaaaccgtggccgtcgtttctcataccatattcccgggtcaagctgtttgcatattttaggtgcgcctctggtgaatctgggccttggatcccaaaaagtcgggaaggattcgtgtccatgtatttcttgtgagagacggttgtttgactggaagccagttctccggtggcggtcacagatctatctctggtgcagctgcaaattggagtcacttgtgaaggctatagagacacacgtc

SEQ ID NO: 1449 - DNA, 1608 bp, Pennisetum glaucum
gagtggcgtctggcgcgcaggaaggcgaaggctagtagccgcgggaacaaccagtgaataaacatgagctcactctgcccttttgctggagctacctctggtagtggagtatgccctgtgaaatccgataagagcggtgctggggtgtgccctgccaaatctgacaagagcataagtggtgtgtgccctgtgaccggcaaggataacactagcgagcacaaggaaagtactgacaatgctgaggaaaagggcactgatcctcgtatggtgccagcaaaatgcccatttggctacgatagcaacacattcaagctgggtccgctcagctgcattatctgccaggcactgctccatgaaagcagcaaatgcaagccgtgtgcccataaattctgcaaggcatgtatatcacgttttaaagactgtccgctgtgtggtgctgatatagaggggatcgagcctgatgccgagcttcaagctcttgtcgatcgcttcattgatggtcatgccagaatcaagcgatcacacgctgccggggatgtggaagcagcgggtggcaagaacaaagtcatatacgaggatgtttccatggaaagaggagcctttctagtgcagcaagctatgagggcttttcgtgcccagaacattgaaagtgcaaaatcaaggctcactatgtgcgcagatgacatcagggaggagttgaagtcgtcagaagataacctagatctgtgttctcagcttggagctgtgttggggatgcttggggactgctgtcggaccttgggagacgctccttcagcaatcacttactatgaagaaagttctgagttcctctcgaaactgcccacaaaagatctcgagttggttcatactctctctgtttcactaaataaaattggtgaccttcgctactatgatggggacctccaatctgcaagaaactattatgcccgttcattggatgttcgcagaaatgcagtaaaagaacactccgcagtggcttcccaggtcattgatctagcaacttctcttgccaaagttgcggatgtggagagaaatcttgggaacgaaagtgctgcagttgagggttttgaggaagcaattcgatgccttgagaagttgaagctggattctgaacaagctaatcttgagcaaaagcgcctctcggttcttgacttcttgcacaagcagttggcagataagtaggacttcattcaccgactacagttatcttctcctggtaatggcgtccggctccactatttttttttctggtttcctatggaaggagttgcaccagaaacgggcgattagcgccttttatcaccacctggaactttgctgcgtcacaaaataagtactcaagtactgtaaatgtatcatatgcatgcttagcgaggagagtacttttgatctgcgaatatgcgccagcagcctacagccctctggttagtggtttgtccttgtcatagccttgaatagcgcgtaagatgtaacttgtgggaagttccatctcgctttaccgtgtcatgtgtgaacactaatcccgttgtatattgacaataagacagggaaatgtactaatgaaagcatggccactgtttgttcaaa

SEQ ID NO: 1450 - DNA, 1611 bp, Pseudoroegneria spicata
  misc_feature (1386)..(1386): n is a, c, g, or t
  misc_feature (1480)..(1480): n is a, c, g, or t
  misc_feature (1516)..(1516): n is a, c, g, or t
  misc_feature (1566)..(1566): n is a, c, g, or t
  misc_feature (1589)..(1589): n is a, c, g, or t
aagaggctcgccccgccgcctccgcctccgcctccgtcgccgtcgtcgccgcccgatccaacctccagcccccacgcacggaacaacctgcaaagacttaatcgccatgagctcgctctgcccgttcgcgaaagccaccaccggcggcgtgtgccccgtgaaatccgacaagaagcccgacaagagcggcggctctgcgtgccccgtgacgggcaagagtcatggcagcgagaacaaggagagcggcgccgaccgtgccgccggagaagagagcgccgaagaccctcacgtggtgcctgccaagtgccccttcggctacgactccaacaccttcaagctaggccccctcagctgcatggtctgccaggccctgctccacgacgccagcaaatgcaagccgtgctcccataagttctgcaaggcgtgcatatcacgctttaaggactgcccgttgtgcggtgctgacatagaggggttcgagccggataccgagctccaggccctcgtcgatcgcttcattgacggtcatgcccgaatcaagagatcgcttgctggagaaagcaaggaagcaggagcggatggcaagagcaaagtgatatacgaggatgtttccatggagagaggtgcttttctggtgcaacaagccatgagggcctttcgcgcacagaacattgaaagcgcaaagtcgaggctcagtatgtgtgcagaagacatcagggaggagttgaaatcttcagaagataacctagatctatgttctcagcttggggcagtgttgggaatgcttggggactgctgtcggaccttgggagatgcgccttcagcgatcacttactacgaagaaagtgctgagcttctgtcgaaattgcccaaaaaggatcttgagttggttcatacgctctcagtttctcttaacaaagttggagaccttcgctactatgacggggacctgcaatccgcaagaagttattatgcccgttcattagatgttcgtagaaattcagtaaaggaacactcagctgtggcctcccaggtcattgatctagcaacttctctagccaaagttgcggatgttgatagaaacctcggcaacgaagatgcggctgtcgggggttttgaggaagcaatcaaatgcctggagaagttgaagctagattctgagcaggctagcctagaacaacggcggcgctcggttcttgatttcctgcagaagcaattgcacgacaagtaaggcagatggccccagcgtgtactacccataacgccgcaccgttgttgtgttgcaatataaaaggagttgttgtggtgcataagggaggagggaggtgctctagaatggttgcgccctatgtgtaattccaaccacttgaattctgtcgggcacanacgtgaacaaagtccgcgttgtacgtattctaggagagttctcctcactgtcgccagtatatgccccaggctctagctagctccctgtggtctnctcccaacccgaaacaacaggggtaaggtgaaactngtctgaagctccctgttgaatgttgaatccgaccgacccgttgtatattnacaataacacacataaaactgcnagaatctggccatttctcttga

SEQ ID NO: 1451 - DNA, 2390 bp, Sorghum bicolor
aaagatcaaaaggaaccaccaacaacaaccagaatatcgccgtcgcgagtcgtcgtcgatctctccgccccgcccgcgccgcggaatctgacctctctttctttccgagccgaggaccgggcgcccttacatccgcgccgccacgtgaatcgacgtcctgagccctcgcggtctctcgtctccccgtgcgagaggacgccggcggcagcggtggcaggggggaggaggaccggaggcggcagcagggccttgcgcccagaggtggacggcggcgggcctgttctcggcgtcgcgtggggaggtccgcgggggaaggcccggagtagccgcgggaagcacgagtgaaatcatgagctcgctctgtcctttcgcgcgagccaccaatggtggtggcgtatgccctgtgaaatctgataagagcaacgctggggtgtgccctgcaaaatctgacaagagcatcagcggcgtatgccctgtcactgggaaggatcatggtagcgagctcaaggaaagtagtgaccatggtgaggaaaagagcactgatcctcgtgttgtgccagcaaaatgcccatttggctatgactccaacatgttcaagcttggtccgctcagctgcattgtctgccaggcactgctccatgagagtagcaaatgcaagccgtgtgcccataaattctgcaaggcatgtatatcacgctttaaagactgcccactatgtggtgctgatatagagggtattgagcctgatgctgagcttcaaactcttgttgatcgcttcattgatggccatgccagaatcaagcgatcacatgctaaaggggatgtagaagcagcaggtggcaagaataaagtcatatatgaggatgtctccatggagagaggagcttttctggtgcagcaagctatgagggcttttcgcgcccagaacattgaaagtgcaaaatcaaggcttactatgtgtgcggatgacatcagggaggagttgaaatcttcagaagctaacctagacttatgttcacagcttggagctgtattaggaatgcttggggactgctgtcggaccttgggagatgttccttcagcaatcacttactatgaagaaagtgctgagttcctctcgaaaccccctgcaaaagatcttgagctggttcatactctctctgtttcactaaataaaattggtgaccttcgctactatgatggcgatcttcaatctgcaagaaactactatgcccgttcattggatgttcgcagaaatgcagtaaaagaacactctgcagtggcttctcaggtcattgatctagcaacttctcttgccaaagtcgcggatgtggatagaaatcttgggaatgaaagtgcagcagttgagggttttgaggaagcaattcaatgccttgagaagttgaagctggattctgaacaagctagccttgaacagcggcgcctttcggttcttgacttcctaaacaaccaattggcagataaataagacatggtcttctcctaagaatgcaccaatgacagatgtcttctcatggtaatgttcaactccactacttaaggctccctttggaaggagctggcctagaagcagcgatcagtatgtgtgtttaccaccgtttgaaacttttgtcacggcacaaaataagtactcatgcactataaatgtatcatatatatatgcccatcgagtactcttgatgattgccgatatggtttggtagtctaagcactctaggttgtcaatgtcagcctggagcagcgcgtaagatgtaacttgtgggaagttccatctcgctttaccgtgtcatgtgtgaacacttatcctgttgtatattgacaataaggcagggagatgccaatcaaaagcatgtctgttgtttcttttagaggagattcccaggtcaagctgtttgcatattttaggtgcgtctctggtaaatctgggtcagaaacccaaaaagtcagaaagaattcgtgtcttggtataaccatgtattccttgtgagagacggttgtttgactggatgccaggtctcgcctggcgcctggcgatcgcagatctgtcgctggtgcaaatttgactcgtgaagaatacagtggcgcacgttttagctgtccacttttgatttgctcttttctggaaggagtccgtgactgattcagcctatattgcaagtgctcgtctgcaggctatgttgaatgttttagcactgaacagattcgtctgtactgagtactgactcatactgatgtggtcgattactttcgctgcgctcgattgttcgcagctatctgttcctcctgggcatctgatttagggggtgtttggtttccttcggtaaactttaccgtccgtcatatcaaatatttgaatacatgcatacagt

SEQ ID NO: 1452 - DNA, 1774 bp, Sorghum bicolor
gtgccccaaatttgctgtcgcgccgatcccgccgccgcccacgcgacctcacctgtcgccgaggactgggcgcgcttccacccacgccgccgcgcgagttcgccgtcccaggccctcctggagcttcatacaggcgagtaacgttggtgggtgattgacaagagaagggaacaacatcgaataccatgagctcgtgctgcccttttgcaggagctaccactggtggcggcgtatgccctgtgaaagccaccgatcagagcagcgctgggttatgccccgcagcaaaatctgacaagagcatcactggtgtatgccctgtgaccggcaagggtcatggcagtgagcacaaggaaagtatcgatggtggtgaagaaaagggcaccgatgatcctcgtatggtgccggcaaagtgcccgtttggctacgactccaacaccttcaagctgggtccgctcagctgcattgtctgccaggcgctgctccatgaaagcagcaaatgcaagccgtgtgcccataaattctgcaaggcatgtatttcacgctttaaggactgcccgctgtgtggtgctgatatagaggggattgagcctgatgctgagcttcaagcgcttgttgatcggttcattgatggccatgccagaatcaagcggttacatgctacaggggatgtggaagcagcagatttcaaggacaaagtcatatatgaggatgtttcgatggagaggggagcttttctggtgcagcaggctatgagggcttttcgcgccaagaacattgaaagcgcaaaatcaaggctcactatgtgtgctgacgacatcagggaggagttgaaatcttcagaagataatctagacctatgttcgcagcttggagctgtattaggaatgcttggggactgctgtcggaccttaggagattctccttcagcaatcacacactatgaagaaagtgctgagatactctcgaaactccccacaaaagatcttgagctagttcatactctctctgtttcactaaataaaattggtgaccttcgctactatgatggggacctccaatctgcaaggaactattatgcccgttcattggatgttcgcagaaatgcagtaaaagagcactcagcagtggcttcccaggtcattgatctagcaacttctcttgccaaagttgcggacgtggatagaaatcttgggaatgagagcactgcagttcaaggttttgaggaagcaattcaatgccttgagaagttgaagctggattctgaacaagctagccttgaacaacggcgcctctcagttctcgacttcctgcacaaccagttggcagataagtgaggcatggtcttctcacatcatatatcttgtcatggttactgatggaagaggtgttcaacaccacaattcttttttctgtttacctatcgaaggagttgctcgagaaatagctcgtgttttttttgtgtgttttaccaccacttagaaacacttttcgtggcacataatgtgtagcactgtaaatgtatgtatgctcagctcagcctcagcgcataagatggctgccaatatgatctattagtgtcatcatgctaaacctgcctcttgtatatatagaatacaagaagacagggaaatagtaacggaagcatggctgacgtgtgaatgtgtgatgtgttctgtatataagcgaagcgatgcattcacaggtgactgcatattttagctgcctttctggtaatcctgggccatgaaatctctaaagtcaggaagacttcgtg

SEQ ID NO: 1453 - DNA, 1767 bp, Saccharum officinarum
  misc_feature (845)..(845): n is a, c, g, or t
  misc_feature (1408)..(1408): n is a, c, g, or t
  misc_feature (1420)..(1420): n is a, c, g, or t
  misc_feature (1432)..(1432): n is a, c, g, or t
  misc_feature (1570)..(1570): n is a, c, g, or t
cggacgcgtgggttctgcttctgcttgtgccccaaatttgctgtcgtgtcgatcccgccgccgccgccgccgcccgcgccggccgcgctacctcacctctcgccgaggagtgggcgcgcttccacccaggccgccgcgcgaactcgccgtcccaggccctcgtggagcttcatacagcgcacaggaaggcgagtaggaagggaagcgaacaacgatcaaataccatgagctcgcgctgcccttttgcgggagctaccactggtggtggcgtatgccctgtgaaagccgccgataagagcagcgctgagttatgccccgcagcaaaatctgacaagagcatcactggtgtatgccctgtcaccggcaagggtcatggcagtgagcacaaggagagtaccgatggcggtgaagaaaagggcaccgatgatcctcgcatggtgccggcgaagtgcccgtttggctacgactccaacacgttcaagctgggtccgctcagctgcattgtctgccaggcgctgctccatgaaagcagcaaatgcaaaccatgtgcccataaattctgcaaggcatgtatttcacgctttaaggactgcccactgtgtggtgctgatatagaggggattgagcctgatgctgagcttcaagcgcttgttgatcggttcgttgatggccatgccagaatcaagcggtcacatgctacaggggatgtggaagcagcagattgcaaggacaaagtcatatatgaggatgtttcgatggagagaggagcttttctggtgcagcaagctatgagggcttttcgtgcccagaacattgaaagtgcaaaatcaaggctcactatgtgngcagacgacatcagggaggagttgaaatcttcagaagataatctagacctatgttcgcagcttggagctgtattaggaatgcttggggactgctgtcggaccttgggagatgctccttcagcaatcacacactatgaagaaagtgctgagatactctcgaaactccccacaaaagatcttgagctggttcatactctctctgtttcactaaataaaattggtgaccttcgctactatgatggggacctccaatctgcaagaaactattatgcccgttcattggatgttcgcagaaatgcagtaaaagagcactcagcagtggcttcccaggtcattgatctagcaacttctcttgccaaagttgcggatgtggatagaaatcttgggaatgagagcaccgcagttgatggttttgaggaagcaatccaatgccttgagaagctgaagctggattctgaacaagctagccttgaacaacggcgcctctcggttctccaattcctgcacaaccagttggcagataagtaaggcatggtcttctccgatcctaagaatgcatacanatcacatgtctnctcatggttacntatggaaggggtgtttaatttcacaattctttttttctggttacctatggaaggagttgctcgagaaatagcgcacggtttgagtgtgttttaccaccacttagaaacttttttcgtggcacaaaatgtgtagcactntaaatgtaccatatgtatgctcagctcagcgcataagatggctgccaatatgatctagtagtgtggtagtctggaacaacgcgtattacatctggctttacagtgtcatgctaaccctcttgtatatattgacaagaagtcatgctaaccctcttgtatatatcgccaaaacgatctcaaataaaaaagttttaact

SEQ ID NO: 1454 - DNA, 1899 bp, Saccharum officinarum
  misc_feature (29)..(29): n is a, c, g, or t
  misc_feature (117)..(117): n is a, c, g, or t
  misc_feature (483)..(483): n is a, c, g, or t
  misc_feature (778)..(778): n is a, c, g, or t
  misc_feature (839)..(839): n is a, c, g, or t
  misc_feature (1824)..(1824): n is a, c, g, or t
  misc_feature (1895)..(1895): n is a, c, g, or t
aaagaaaccaacaacaaccagaatatcgncgtcgcgtcgtcgtcgatctccccgccccgccccgcccgcgccgcggaatctgacctctctctctctctctctccgaggaccgggcgnccttacatccacgccgccgcgcgaatcgccgtcccgagccctcgcggtctctcgtctccccgtgcgagaggacgccggcggtagcggcgggccagtgcggtggcagggggggaggaccggaggcggcagcagggcttgcgcccagaggtggacggcgggcctgttcttggcgtcgcgtggggaggtccgcgggggaaggcgagtagccgcgggaaggacgagtgaataatcatgagctcgctctgccctttcgcgggagccaccactggtggcgtatgccctgtgaaatccgataagagcaacgctggggtgtgccctgcaaaatctgacaagagcatcagtggtgtatgccctgtcactggaaangatcatggtagcgagctcaaggaaagtagtgaccatggtgaggaaaagggtactgatcctcgtatggtgccagcaaaatgcccatttggctatgactccaacacgttcaagctgggtccgctcagctgcattgtctgccaggcactgctccatgaaagtagcaagtgcaagccgtgtgcccataaattctgcaaggcatgtatatcacgctttaaagactgcccactatgtggtgctgatatagagggtattgagcctgatgccgaacttcaagctcttgttgaccgcttcattnatggccatgccagaatcaagcgatcacatgctacaggggatgtagaagcagcaggtggcangaataaagtcatatatgaggatgtctccatggagagaggagcttttctggtgcagcaagctatgagggcttttcgcgcccagaacattgaaagtgcaaaatcaaggcttactatgtgtgcggatgacatcagggaggagttgaaatcttcagaagctaacctagacctatgttcacagcttggagctgtattaggaatgcttggggactgctgtcggaccttgggagatgttccttcagcaatcacttactatgaagaaagtgctgagttcctctcgaaaccccgtgcaaaagatcttgagctggttcatactctctctgtttcactaaataaaattggtgaccttcgctactatgatggcgatctccaatctgcaagaaactactatgcccgttcattggatgttcgcagaaatgcagtaaaagaacactctgcagtggcttctcaggtcattgatctagcaacttctcttgccaaagtcgcggatgtggatagaaatcttgggaatgaaagtgcagctgttgagggttttgaggaagcaattcaatgccttgagaagttgaagctggattctgaacaagctagccttgaacagcggcgcctctcggttcttgacttcttacacaaccaactggcagataaataaggcatggtcttctcctaagaatacaccaacaacaggtgtcttctcatggtaatgttcaactccactacttaaggttccctttggaaggagttggcctagaagcagcgatcagtatgtgtgtttaccaccgtttgaaacttttgtcactgcacaaaataagtactcctgcactgtacatgtatcatatatataatgctgatcgagtactcttgatgattgccgatatggttcggtagtctaagcactctaggttgtcaatgtcgtagcctggagcagcgcgtaagatgtaacttgtgggaagttccatctcgctttaccgtgtcatgtgtgaacacttancctgttgtatattgacaataaggctgggagatgccaatcaaaagcatggcccattgtttctttttaaaaanaaaa

SEQ ID NO: 1455 - DNA, 1975 bp, Panicum virgatum
ccctctcgctcgtgaccactcacgacgagtcacgcctcccccggtccccggaacaccgcccacctcgtcgcgtcgatctcgaactctcgccgccgccgcccgccccgcgcgacctcgcctcggccggacccgcgccgccccgagcgaatcgccgtccagagccctcgtgctccctccgcctcctcgggcgagaggacgcaggcggtggcggccgtagcagcagacgtgcggggcggtccggaggcatcggcacttgcgcgccctgcggcggcggagggcgggccttgtttctcggcgcgcggcggcggcgcgtggggaggccgcggggagcgcggcgatttaggagcggcgtccggcgcgcaggagaaacgagtgcccgcgggaacaaccattgaataatcatgagctcgctctgcccttttgctggagctaccactggtggtggcgtatgccctgcaaaatccgacaagagcagtgccggagtatgccctgcaaaatctgacaagagcataagtggtgtttgccctgtcaccggcaaggatcacagtagcgagcacaagggaagtactggccatgctgaggataagggcaccgatccccgtatggtgccagcaaagtgcccatttggctacgacagcaacacgttcaagctggggccgctcagctgcattatctgccaggcactgctccatgaaagcagcaaatgcaagccatgtgcccataaattctgcaaggcatgtatatcacgctttaaagactgtccactgtgtggtgctgacatagaggggattgagcctgataccgagcttcaagctctcgttgatcgcttcattgatggccatgccagaatcaaacgatcacatgctgcaggggatgtggaagcagcaggtggcaataacaaagtcatatatgaggatgtttctatggaaagaggagcttttctggtgcagcaagctatgagggcttttcgtgcccagaacattgaaagtgcaaaatcaagattcactatgtgtgcagatgacatcagggaggagttgaaatcgtcagaagataatttagatctatgttctcagcttggagctgtgttaggaatgcttggggactgctgtcggaccttgggagatgctccttcagcaatcacttactatgaagaaagtgctgaattcctttcaaaactccccacaaaagatcttgagttggttcatactctctcggtttcactaaataaaattggtgaccttcgctactatgatggggacctccaatctgcaagaaactattatgcccgttcattggatgttcgcagaaatgcagtaaaagaacattcaacagtagcttcccaggtcatagatctagcaacttctcttgcaaaagttgcggatgttgatagaaatcttgggaacgaaagtgctgccgttgagggttttgaggaagcgattcagtgccttgagaagttgaagctggattctaaacaagctaatcttgagcaacggcgcttctcggttcttgacttcctgcacaaccagttggcagataagtaagactttgtcatcctaagaatacaccaactacagatgtgtcttctcctggtgtgcaactccactatttttttcttgttgcctacggaaagagttgtactagaaatggcaattagcgcattttattgccacatgaaagtttgccgtggcacaaaataagtactcaagcactgtaaatttatcatatgtattctcagcgaggagagtgctcttgatggctgcgaatatgctccagcagcctatatccctggttagtggtttgtccttgtcatagcctgggacagcgcgtaagatgtaacttgtgggaagttccatctcgccttaacgtgtcatgcctgaacgctaatcccgttgtgtattgacaataagacagggcggtactaaagaaagcatggcctttgtttgttttagagattcccaggtcaagctgtttgcat

SEQ ID NO: 1456 - DNA, 1761 bp, Triticum aestivum
atttccttgctcctatccatccaccaccgccacaagacaccagaagaggcccggctcgccccgccgcctccgcctccgcctccgcctccgtcgccgtcgtcgccgcccgatccaaccgcccgcccgccacgcccccacgcacgggccagggagccacctgcgaagagacaatcgccatgagctcgctctgcccgttcgcgaaagccaccaccggcggcgtgtgccccatgaaatccgacaagaagcccgacaagagcggcggcggcgctgcgtgccccgtgacgggcaagagccatggcagcgagaacaaggagagcggcgccgaccgcgccgccggagaagagggcgcagaagaggaccctcgcgtggtgcccgcaaagtgccccttcggctacgactccaacaccttcaagctcggcccccttagctgcatggtctgccaggccctgctccacgacgccagcaaatgcatgccgtgctcacataagttctgcaaggcgtgcatatcacgctttaaggactgcccgttgtgcggtgctgacatagaggggatcgagccggatgccgagctccaggcccttgtcgatcgcttcattgacggccatgcccgaatcaagagatcgcttgctggagaaaacaaccaagcagcggatggcaagagcaaagtgatatacgaggatgtctccatggagagaggtgcttttctagtgcaacaagccatgagggcttttcgcgcacagaacattgaaagtgcaaagtcgaggctcagtatgtgtgcagaagacatcagggaggagttgaaatcttcagaagataacctagacctgtgttctcagcttggggcagtgttgggaatgctcggggattgctgtcggaccttgggagatgcgccttcagcgatcacttactatgaagaaagtgccgagcttctgtcgaaattgcccaaaaaggatcttgagttggtccatacgctctcagtttctcttaacaaagttggagaccttcgctactatggcggggacctgcaatcggcaagaagttattatgcccgttcattagatgttcgcagaaattcagtaaaggaacattcagctgtggcctcccaggtcattgatctagcaacctctctagccaaagtcgcggatgttgatagaaacctcggtaacgaagatgcggctgtcgagggttttgaggaagcaatcaagtgccttgagaagttgaagctagattctgagcaagctagcctagaacaacggcggtgctcggttctcgacttcctgcagaagcaattgcacgacaagtaagacagatggtcccagtgtgtactatccataacgaggttcgaccgaccgcatcgttgttgtgttgcaatatggaatggtgcataagggaggagggaggtgctctagaatggttgcgccctgtgtgtaattccaacctctgtcgtggcacaaacaatcttaaacaaggccgcgttgtacgtattctaggagagttctcttcagtgtcgccaatatatgctccaggctctagctagctccctgtggtcttctcccaagccgaaacaacaggggtaaggtgaaacttgtctgaagctccttgttgcatgttgaatccgatcgaccccgttgtatatcgacaataacacacatagaactgctagaatctggccattttgcttgaattttctgtcgagctgtctgcataatattattattatggtcataatcgggaatctccaaaataaagtcagcaagaagg

SEQ ID NO: 1457 - DNA, 1824 bp, Sorghum bicolor
gcttggtcggtgttgagcggagcgggaatcgggccggaccctagttgaattcgtccttaccttgtcgtcgttgctgatgccagaagccgagtggaacgatgaacgcactaggcttgtctgtgaactctttgaagaacaggttcaggctgggaacaggccgaatacgcacctgaacaacattggttaccgccaagttgcggctaagtttcagcagaggacacaacttctctatacaaaattgcagcttaagaacaaatgggacaagtttaagaatgattatatcacttggaggaagttgcttgtagtggggaagggtttaccctgggacaatgctaaggggacatttgttgctgacgaagaatggtggaagaagatcaataaggaactgccaggtgcaaggaaatttcgacatggcggtctacaacatgaggataagttgaaagtaatgttcgactacatcaccagtaatggtgtggatccttcaccacctgctccggaaagcccgaagaatggggtggatcattcgccaccggccgcaactggtttgccggagcattcgcctgtgactgcacatgggttgccatctggtccagacagccacgtgaatggcacagatcatttgccactggccacacgtgatttgccacgtattcaagaaacccccatgaatggtgtgaacctcgatggatcggacaacactgaagataatgattacactcatcgagagcctgtgtttcattatccttcaaacaggaagaagataccgatccatttcagtgctgcaaagaagaagaagaaaaacaagtccgaaactgctctgctcatgcaagctcatttgtaccgcataactgagctggctcagaaagcacaggacactttcgaaaagttcagctcccaggctgactcagcgccatggcctagcatccaggatgttatgacactggtccgggagtgcggagcacggtgtgggagcaatgagcatttcattgcaactgaactttttgtcagtagagaacagagggagatgttcctgaccatggaaacggccgaggaacggttccagtggcttagaagaaagtacatcgtcaagtatttgtcaggtacaacaggtacaagtctgggtactaggtaaagtgatcctgggcgtttacattaggttttctcccaagtcttttaggctttgatatccaacatgacacattttgtattggatcctgatatagcatactctgcatcctgacaagtttggttgtatgaatgtgtagcttatcctctggtttcacctgttcctgtgtagtaacagttatcttttgcaaagcctctgattcttcctgcaatgggcacatgtgtttttgggcctgtgagaattcactgcagaaattaggcccatattcactttgtttaagcaatggagcccacattgagaaaaccgcaggaaaggaaagggccgaagaggagtagtttgtccgtgccggcgcagcgcagggaaggcctggcccggcatcgctcgctgcactgctgatgccagctggcaccggatggggagggagagctccgcgctgatgagcatccacgcaagttcttttctggggcgctgttggatctttcctggtcttgctcatgctgcataaacccacttttatagctcgaactatcaatgaactatttaagagatcaatttggtgaatgcttggcttttatgtatgcaagttcatgaataatgaccattcaccaatatttttgtataatgtcaaactatgatgattgtatgactgccatgtgaattatattaattttgagaagtgggcttggcccacgtgtgct

SEQ ID NO: 1458 - DNA, 2098 bp, Brachypodium distachyon
ctcgtcgtatcgacgccgcgcgaatgtcgacagggggcttgtcgtttgtgcgccgcgccgtcgaggccgtgcgccgcacgccgcgctggcaaaagaggatcgtcttcttcaccgtaggagttggcactttaagctatgcttgccaggataatcgggttctgcaaattaatgatggaacaggcaagaaaaaattggttatacttggaactggttgggcaggtgcaagtttcttgagaaatatagacacttctttgtatgatgtgcatgtcgtatctcctcgcaactatttcatgttcactcctttgttgccgagtgtgacatgtggcactgttgaagcacgtagcattgtggagccaattcgcaatatcgtgagaaagaatggtggtgcattcagattctgggaagcagagtgctacaagattgacccagcaagcaagaagatccactgcaggtcaggtgacgggaccaatgttgatggaaatggagaatttgctgtggattatgattaccttgttgtgactgttggagctagaccaaatactttcaacaccccaggtgtcgtcgaaaattgccatttcctaaaggaagtagaagatgctcaaaagatcaggaagagtgtcatgaaatgttttgaaaaagccgctcttcctaaccttactgaggaagaacggaagaagaatgttcattttgttgttattggtggtggcccaacaggggttgaatttgctgcagagttgcatgactttgtcaatgaggatttggcaaagttgtatcctgacgtaaagaagtatgtgaacatttcagtaattgaagctggagaccatatccttacgatgtttgacaaaagaatcacccattttgctgaggataagttcaagagggaaggtatagatttgaagacaaattttaaggtcgtgaaggtgtctgataagactatcaccatgagtaatcctgcaactggagagattgctgttccttatggtttggccgtttggtcaaccggaattggaacccgtccgattattatggatttcatgaagcaagttggtcaggcaaaccgacgtgtgctagcaactgatgagtggctcagggttcatggatgtgaggatgtgtatgcacttggtgattgtgcaactataacacaaagaaaagtgatggaagacgttgatgcaatatttcgggtagcagacaaggataattctggcactctgactgtaaagaaaatcaaagatgttcttggcgacatctacgtaaggtacccacaggtggagctgtatcttaaaaccaaccaaatgaagggcttccatgacctactgaaagataaggagtcagaagaactgaacatcgaagaattaaaaaaggcccttgctcaagtggactcacaagtcaagcttctcccagcaacagctcaggttgctgcacaagagggagcttatcttgcggactgtttcaataggatgaacatatgtgaagaatctcctgaaggtcctctaaggatcaggggtgcagggcgtcatcggttcaaacctttcaggtacaggcatctcggccagttcgctccgctgggtggagaacaaacagctgcgcaattgccgggtgattggatacatgtaggccacagcactcaatggctgtggtattctgtctatgcaagcaaacaattcagctggcgcacaaggatgctggtcgtctctgattggggaaggcggtttatctttggaagggactccagcagcctataaattgaactttcggctcgtcttgccaactgaagatctacgagactacgatgctactttctccatatatagcggcattctttttgttccacaattttgcaagcttccaactgaagatctatgagactacgatgctactttctccatgcagcgggtttctttttgttccacaattttgaaagctcgatttccacctaggctagtaagggttttttgcgaattttttgccttatttcagagtggtaaagataaactcgcaggccgaacgggttattacctttttatgccttatctcgatgcacctccatcaattgagtgccactaggcaagactcagtaaagagcattatttgcacttaa

SEQ ID NO: 1459 - DNA, 1829 bp, Zea mays
gagcaaaccgctcctccccatccttgttctaccattgccccgcgcgtatcccacgtcgacgcggtcgagggagtccaggctgttgccagcgagcgatggcgagcaacggctcgtcgctggtgcgccgagccgccgcagcggtgcgccgcatgcctcgttggaagaagcggcttgtcttcttcgccgtcggagctagcaccttaacttatgcttgtcaagataatcgtgttcttcaaatttgtgatgttactggaaacaagaagaaggtggttatccttggaactggatgggctggtgcaagtttcttgagaaatattgacacatctttgtatgatgtccatgtggtatcacctcgcaattacttcaccttcactcctttgttgccaagtgtgacatgtggcacagtcgaagcacgtagtatcgtggagccaattcgcaatatcgtgagaaagagaaatggtgcattccgattttgggaggcggagtgcttcaagattgatccaacaaacaaaaaagtccactgcagatcagatgttgggacaaacattaatggaaacggtgaatttgtggtggattatgattacctgattgtcagtgttggggctagacctaatactttcaacacgcctggtgttactgagaattgccatttcctaaaggaagtagaggatgctcaaaagatcaggaagagtgtcatgaaatgttttgaaagagctgcccttccaaatctttctgaggaagaacgaaagaagaaccttcattttgttattattggtggtggcccaacaggggtagaatttgctgcagagttgcacgactttgtgaatgaagacttggcaaagttgtatcctgatgttaagaagcacgtaaacatttcagtaattgaagcaggaggtcatatccttacaatgtttgacaaaagaatcacccaatttgctgaagagaagttcaagagggatggcatagatttgaagacaaattttaaagtcgtgaaggtgtctaataaggatattctcatgaccaatcctgctacaggagaggtcgccgttccttatgggatggcagtttggtcaactggaattggaacccgtcccatcattatggattttatgaagcaagttggtcaggagaaccggcgtgtgctagctactgatgagtggcttagggttcaagggtgtgaggatgtatatgctcttggtgattgcgcaacgattgctcaaagaaaagttatggaagatgttgctgccatattccgagtagcagacaaggataactctggcactttaactgtgaagaaaataaaagatgttcttggagacatctatgagagatacccacaagtggaattgtatcttaaatccaaccaaatgaagggcttccatgatctacttaaagactcagatggtagctccaaggagttcaaagaactggacatcgaacagttcaaaagggcccttgctcaagtggactctcaagtcaagatgctcccagcaacagctcaggttgctgcacaagagggaagttacctagcggattgcttcaacagaatgaagatgtgtgaagaatatcctgaggggcctataaggatcagaggtgcagggcgccatcggttcaaacctttcaggtacaagcatcttgggcaattcgctccactgggtggagagcaaactgcttaccaattgccaggtgactgggtacatgttggacacagcacccaatggctgtggtattctgtctatgcaagcaaacaattcagttggcgcacaaggatgctagtcgtatcagattgggggaggcgattcatctttggaagggactccagtagcata

SEQ ID NO: 1460 - DNA, 2194 bp, Oryza sativa
acgtcgccctcgtccgccgccgcgtgttcgcaagcgagcaaaccgctcctcctccgccgccgcctccgcgcctcgcctcgtctcctcctcctcctcctccctgctccgtcccacaccacccgtagtaggggccgtggccggatcgcaatgtcggcgtcggggggattgagcttggtgcgccgcgccgtcgaggccgcgcgccgcacgccgcggtggcagaagaggctcctcgtcctcaccgccggtgttggttctttgacttatgcttgccaggataatcaagtacttcaaataaatgatggaactggcaagaagagggtggttatcgttggaactggttgggcaggcgcaagtttcttgagaaatattgacacttccttgtacgatgttcatgtcgtatcacctcgcaactattttaccttcacacctttgttgcctagtgtgacatgtggcacagttgaagcacgtagtattgtagagcctatccgtaatattgtgagaaagagaggcggcgcatttagattttgggaagcagagtgctacaagattgatccaactaacaaaaagatccactgcagatcagactcagatggaaatagtgaatttgttgtagattatgattacctggtcgtcagtgttggagctagacctaatacattcaatacccctggtgttgttgaaaactgccattttctaaaggaagtagaagatgctcaaaaaattaggaagagtgtcctgaaatgtttcgaaagagcgtcccttccaaacctaactgaggaagagaggaagaagaatcttcattttgttgttattggtggtggcccaacaggtgtagaatttgctgcagagcttcatgactttgtcaatgaggacttggcaaagttgtatcctgatgtgaagaagtatgcgaatatttcagtaattgaagctggagatcatatccttacaatgtttgacaagagaattacccaatttgctgaagataaattcaagaggacaggcatagatttgaagacgaattttaaggttgtgaaggtgtctgataaggctatcactatgactaattctgcaactggagagattgctgtgccttatggcatggctgtttggtccactggtattggaacccgtcccctcataatggatttcatgaagcaagttggtcaggcaaaccgacgagtgctagctactgatgaatggctcagggttcatggatgtgatgatgtatatgctctcggtgattgcgcgacaataactcaaagaaaagttatggaagatattgcttcaattttccgggtagcagacaaggacaattctggctctttgactgtcaagaaaattaaaaatgttcttggcgacatctatgaaaggtacccacaggttgagttgtaccttaaaactaaccaaatgaaggacttccatgacctactcaaagattcagacgggaatgctattaaggagtcaaaagagctgaacatagaggaattcaagaaagcccttgctcgagtggactcgcaagttaagatgctcccagcaacagctcaggttgcttcacaagagggagcctatctggcaaactgcttcaacaagatgaaatactgtgaagagaaccctgaaggtccgttgaggatcagaggcacagggcgtcatcggttcaaacctttcaggtacaggcaccttggccagtttgctccactgggtggagagcaaacagccgctcaattgccgggtgattggatacatgttggtcacagcacccaatggctatggtattctgtctatgccagtaagcaattcagctggcgcaccaggatgctggtagtatctgattggggcaggcggttcatctatggaagggactcaagcagcctataaattgaactaggatggtgttgttcaccgccctgcattttgccaactgaagctctattagacttggataatacaatttttgcataccttcggaaacaactatttttgcatacagcatcattttttttagagagagagagcatcgttatatttgttcggctattttcacaagctcaggtttctgtagcgtagcaaggttttgtcaccaatttttgatcttgccgatatttctatgacacaatggaggttaaatgatttatacatcagtactttataatacagttcagtatcctagtaatttaaatgttgatgttatgtgttt

SEQ ID NO: 1461 - DNA, 2047 bp, Sorghum bicolor
atcccacgtcgacgcgatcgagggagtccgggctgttgccagcgagcgatggcgagcaacggcttgtcgctggtgcgccgagccgccgaggcggtgcgccgcacgccgcgatggaagaaggggctcgtcttcttcgccgtcggagctagcaccttaacttttgcttgtcaagataatcgggttcttcaaatttgtgatgggactggaaacaagaagaaggtggttatccttggaactggttgggcaggtgcaagtttcttgagaaatatcgacacatctttgtatgaggtccatgtggtatcacctcgcaattacttcaccttcactcctttgttgccaaatgtgacatgtggcacagtagaagcacgtagtatcgtggagccaattcgcaatatcgtgagaaagagaaatggtgcattccgattttgggaggctgagtgcttcaagattgatccagcaaacaaaaaagtccactgcagatcagatgttgggacgaacattaatggaaatggcgaatttgttgtggattatgattacttgattgtcagtgttggggctagacctaatactttcaacacccctggtgttactgagaattgccatttcctaaaggaagtagaagatgctcaaaagatcaggaagagtgtcatgaaatgttttgaaagagctgcccttccaaacctttctgaggaagagcgaaagaagaaccttcattttgttgtcattggtggtggcccaacaggggttgaatttgctgcagagttgcacgactttgtgaatgaagacttggcaaagctgtatcctgatgtaaagaagtatgtaaacatttcagtaattgaagcaggaggtcatatccttacaatgtttgacaaaagaatcacccaatttgctgaagagaagttcaagagggatggcatagatttgaaaacaaattttaaggtcgtgaaggtgtctgataacgatattaccatgaccaatactgctacaggagaggtcactgttccttatgggatggcagtttggtcaactggaattggaacccgtcccataattatggatttcatgaagcaagttggtcaggggaatcggcgtgtgctagctactgatgagtggcttagggttcaagggtgtgaggatgtatatgctcttggtgattgcgcaacaattgctcaaagaaaagttatggaagatgttgctgccatattccgagtagcagacaaggataactctggcactttaactgtgaagaaaataaaagatgttcttggagacatctatgagagatacccgcaagtggaattgtatcttaaatccaaccaaatgaagggcttccacgatctacttaaagactcggatggtagctccaaggagttgaaagaactggatatcgaacagttcaagaaggccctggctcaagtggactctcaagtcaagatgctcccagcaacagctcaggttgccttacaagagggacgttacctagcagactgcttcaacagaatgaagacgtgtgaagaatatcctgagggtcctataaggatcagaggtacagggcgccatcggttcaaacctttcaggtacaggcatcttgggcaattcgccccactgggtggagagcaaactgcttatcaattgcctggtgactgggtacatgttggacacagcacccaatggctttggtattctgtctatgcaagcaaacaattcagttggcgtacaaggatgctggtcgtatcagattgggggaagcggttcatctttggaagggactcaagtagcatatagattcaaatctcccgatttcgtagtccacctacgtttgagagattcttgcatcagttttgctgccccagtattttggaagcttagcctagcaaggtttctgataccaaattttgaccttgccaattcttttgttacctcgtgatgcacactgagcgattcagatgttattcgttttgccttggacatatgcatttgtttttgatgtagggcaatagggcaatatgttatctgttttgattctgtcagttttgagttatgttgc

SEQ ID NO: 1462 - DNA, 2768 bp, Zea mays
tcgttctcgtctcccagccccgtcgccgctgacgtggcgcccaccgcgcggaaaaaaatattgcagatattttcctcaccgctccttcccccctctctgctcgtccttgcctcccaccgcaccgccggctcttgctctgctcggttcctcctggcagcaaccgaatgtctcccgacgccgacgccgccgccgggggaggaggaggtggagaggcgagcgccggcgccggcgccggcgcgtcgtcgcctcccgcgtccgcgtccgcggcggcgaacggccgggcgctggtgcggtgggaccagatcctgccgcgccgctccctgcgggtgcttctcgtcgagcacgacgactccacgcgccagatcgtcaccgcgctcctccgcaagtgcggctaccgcgtggccgcggtcgcggacgggatgaaggcgtgggaggtcatgcgggagcgtgcctacgacttcgacctcgtcctcaccgaggtcgccatgccctccctctccggcatccagctgctctccaggatcgccgccgccgccgagtgcaagaacatccccgtcatcatgatgtcatcccaagattctattggcacggtgctcaagtgtatgcagaagggtgcggtggacttccttgtgaaaccagtaagaaagaatgagctgggtaacctgtggcaacatgtgtggaggaggcatgcaatgaattgccagacaaatggatcagaaaataatgcagccagcaatcatgtaagtaccaatgttgctaatgggtcaaagacaggagaaaacaatgatgaggaaagtgatgcccaaagctttggtaacaaaagggagactgaaattaagagtgctgagacgttaccagatattcgtagagatgaaatggctggctcatccaaaaaaattgaactacaaaataagtctaatgatggagtaaacacaaaagtggatgcgtcaaaagatagcgatggtgctccaagtgaaagtgagaagaatgtgcgttccaaatgccttaatggtattacttctgcaaaggtggctgagcaaataatggataatgccttgaggatcacggatgcaagttcacgtcgtccaaccaatcttggcaaagatttggctatgactgaaccagcagctgatagaaaatgccaatctttagtgatggaaaataatgctgtcaaagaaaagaaccctggtgaaaagtcgaagagtgctgtaataggtcatgctgattcttacccctcccaatttctcgagaccaacttgggaaaacaacagtatcgtaatggttacaagaatcaagaattcagggaaaaagatatctttaatcactcgaattcttctgccttctcgagatatggcaatagaaggatagaatcatcaggtgagatacagtttcttccttctcgttgcattgttgggcaagagcagcatgttcatggcaaggacccagttttccaacccaatggggtcttgctgcctcccaatgaccataatacaggtgagagtacaaggcaagctcgaattactctggacagtagcatggagggtgctgacatcatttgctccagtagtgctagggaagatgctggtgcaagtagttcttcccatagaaaggacagtatgagccatccctcatatgggtttgtacctgttccaattcctgtcggtgccatgatgccctatcattgtggtgcaattctgcagccagtatactacccacagggtccacttatgcactgtaattcatctgcaatcaacaaggcaacaattcatcaaacctctggccaatctaactaccgtgaagattgtggtagtggtagaccatctcaggttgatgaacacaaacagtcagaggaaaagcaccagttgcatcattcaagacaaattcatcgggaatcaggacaaccagttgacatggttagagctcacatggatcatgctaaccagagtgcaagctgcagccgggatatctgtaaaggaagcggatgcacgggtagcggtgaagccgataccaatgcgaacacgacggttgccctagagagtggcaacgagagtggcatccaaaatagtgacaggtctcaccgagaagctgctttgatgaagttccgcatgaaaaggaaagacagatgcttcgataaaaaggtcaggtatcatagcaggaagaagcttgcggagcagaggccaagagttaaggggcagtttgtaagccagaagctgaaagcagctatggcaacggaagccgaaactgactcgtgacgggcgctagtccagaactgtaattttggttcttcccttcgcgccaggtgtgggcgattggactggtaagtctgaaggctggcaaaagtttttttttcttccttccatggttagcctttctgtacaaaggtgaactccacgtcgggtgtttgttggcatccaagccttattttttgcgaggtacatcaagttgacaaaatgttcggagggatagggtgaaaacggtgcaagcgccatatttcgtccatacgcttaggtgtttgtggagtgtgaaagcagagcctgtacagcatattcaccacccattctgttgccattacaattgtagtaacttgtaattactactatgacaaaagtagacactgttgtagaacttacagccagcaggtcttttccatatgggacagtagcattttatttattaattggttgatcatatgaggacagtcccgaatgcaggacagttaagatttgtttgatccaatccaatcatccagcattttgcttgccttaaac

SEQ ID NO: 1463 - DNA, 2654 bp, Sorghum bicolor
cccagacgactcctgctctgctccgcagcaatcaaatgtctcccgacgccgacgccaccgccggagccggaggcggcgacggcggcggaggagaggcgggcggcggcgccggcgccggcgcgtcgtcgtctccggcgtccgcggcggcgaacgggcgggcgctggtgcggtgggaccagatcctgccgcgccgctcgctgcgggtgctcctcgtcgagcacgacgactccacgcgccaggtcgtcaccgcgctgctccgcaagtgcggctaccgcgtggcggcggtcgcggacgggatgaaggcgtgggaggtgatgcgaggccgcgcatacgccttcgacctcgtcctcaccgaggtcgccatgccctcgctctccggcatccagctgctctccaggatcgtcgccgccgacgagtgcaagaacatccccgtcatcatgatgtcgtcccaagattctattggcacggtgctcaagtgcatgcagaaaggtgcggtggacttccttgtgaaaccggtgagaaagaacgagctgcgtaacttatggcaacatgtatggaggcgccatgcaatgaattgccagacaaatggatcagaaaataatgcagccagcaatcatataagtgcaaatgttgctaatgggtcaaagacaggagaaaacagcgatgaggaaagtgatgcacaaagctttggtagcaagagggagaccgaaattcagagtgttgagaagttaccagacattcgtagagatgaagatgaagtggctggctcatccaaaaaaactgaatcacaaaataagtcttatgatgtcagagtaaacacaaaagtggatgcgtcaaaagatagcgatggtgctccaagtggaagtgagaagaatgtacactccaaatgccttaatggtattacttctgcaaaagtggctgagcaaattatggataatgccttgaggatcacggatgcaagttcacgtcgtccaagcaatcttggcaaagatttggctatgactgagccagaagctgacagaaaatgccaatcttcagtcatggaaaataatgctgtcacagaaaataaccttggtgtaaagtcaaagggtgctgcaatatgtcctgctgattcttgcccctcccagtttctggagaccaacttgggaaagcaacaccatcttaatggttacaaaaaccaagaattcagggaaaaagatatctttaatcactcgaattcctctgccttttcaagatatggcaataaaaggatagaaccatcaggggaaatacaattttttccttctctctgcatcactgggcaagagcatgttcatggcaaggacccagttttccaacccaatggggtgttgctgcctcccaatgaacataatacaggtgagagtacaaggcaaactcgaattactttggacagtagcccggagggtgctgccatcatgtgttccagtagtgctagggaagatgctggtgtaagtagttcttcccatagaaaggacagcatgagccatccgtcatatgggtttattcctgttccaattcctgtcggtcctgggatgccctaccattatggtgcaattctgcagccagtatactacccacagggtcctcttatgcactgtgattcagctggaatcaacaaggcagcaatccagcatggctctggtcaatctaattaccatgaagctcctggtaaaccatctcaggatgatgagcacaaacagtcagaggaaaaccaccagttgcatcattcaagacaaattcttcgggaatcaggagaaccaattgagatggcgagagctcacatggatcgcgctaaccagagtgcaagttgcagccaagatatctgcaaaggaagtggatgcacgggtagtggtgaagccgatatcaatgcaaatacaatggttgcccttgagagtggcaacgaaagtggcatccaaaatggtgataggtctcgccgtgaagccgcgttgatgaagttccgcatgaaaaggaaagatagatgcttcgagaaaaaggttaggtatcatagcaggaagaagcttgcagagcaaaggccaagagttaagggacaatttgtaagccaaaagcagaaatctgctacaacaacagaagcagaaactgacttgtgaccggcgttaatttgtaactgtaattttgattcttgcttgcccaccaggtgtgggcaattggactgataatactgaaggctggcaacagtttttcccttacatggttagcctttctgtacaatggtgaactctttagtctttatgtctagtgtttgttggcattcaagccttattttgtaaagtacatcaaattgacgacaaatgttcagagtgaaaggggggtgtgggggattaggaaaacggtgcaaccaccagatttcctctatgtacttagatgtttgtggagtgagaaagcagagcctgtacagcttattcacccattttgttgccattaaaatagtagtaacttgtaactactaactactgctatgacaacaacagacactgttgtagaacttagaacagccttacagtcagctggtctttcccattgggaccatgacattttcatttagtgcttaatcctgtgagtaatcccctcgataagacgccctcctgtatgcaggacagtcaagatttgtttga

SEQ ID NO: 1464 - DNA, 4278 bp, Zea mays
agcagtagccataggaggagtgcattctcccctgggctggctgtgttattatctggcgatgaagctaagattagctcccagaagtcgcacctggtgtcctatcatgacgaaattgggcaccaggctgttgagaggacgatagagcacatctttgatctccctcacaagtcagtggtccggcctcctggaccagttgacacaggcttcgtgcactcagtggtgaggaatcaagctagaaaatttgatcttgactgggaaaactgcattcggggataccatcgcagcgtcttcattgtggacaaaggtgctgggcagaggaaggtggttcttgatgattcgagcatttgtggtagcttcaggaatgtccggggaccttcacttgttgagagttccgcccctttcagcagtgccagggctaatgcttgtgtgtggaaaggcaaatggatgtatgaggtgacccttgagacgtctggagttcagcagcttggatgggctactctctcttgtcctttcactgatcagaaaggtgttggtgatgctgatgattcatattcctttgatggccggagggtgactaagtggaacaatgacccaaagccatatggccagccatgggcagtaggtgatgtcatcggttgctgcatcaacttggatgcaggagaaatttccttttacaggaacgggacttctcttggtgttgcatttgatggaattcgcagcgtggaacctaagaagggatattatgctgcagtatccctctcggaaggagagcgttgtcatcttaatttcggctcacatccattcaggtatcctgttgatgggtttgatccattagaggcgccaccacgctcttggtcgtttgtcacataccttcttagatgcctgttccggttgctagaagttcacaacctggagaaatctgaatcagcatacttcgagaaactgaggagggtgaaaaaatttgcaccactacaagaactctttggacccatttcagaagggatctgtgcagaaattttcagtgctattgaagcaagccaggggtgccttgagtatattgcctggggctcgttgatcactctactcttagatgttttcagaactcgtgagccgcatgatttctcatgccttgatcaggttcttgaccttttcctccggttcccaggttgcacttcattatttcaggagctcattgtggccctttcttgcatgtgcaaagttgcaccacttgtgttgacagaatgcccatattctgggtcatatccatttttagcgctggtttgccaccttcttaggcataaggatgtaatgtgtttatggtggaaagcagaagatttcgttttctcgtttgaaggcttccttacaaggaagattccaaataagcaggatctacagtgccttgtgccatctgtttggtggcctggttcttctgaggatgaagttagcatgacactgacgatgacaacactctcagatgcaataaaaaagattgaggagatgcatcgtgaactttgcagcttggtaatatgctttattccaccaatgtctacgcctcagcctccaggctctgtatttaggtcctttgtacaaagtttggtgctcaaagctagaggtggagatcataggatggttgtcaatgggactttcaacaacactgtgcttgtttcattgtacacagtaatcctgcatttgttgtctgaaggattttctatggattctgctggatctgcatcatcctctaaagcgaactttgggaatggtgttggatttcttcacaaaggtggaaaacgcaagtttccgacacaattatttttcaggaatgatgcctatcacagtgtaattcctagaatcggtggaccaccaagtattttgatgcatcaccaatttgatgctgtggaaaatgaagtgcagtgggatgaaggctgcatgaatgatgaagagacacgtgttacacacactacagcacagaagccttgttgctgctcagtgacagatgttgctgttggcctaagatacaaagaaactgctaagtatgtgccatcaacttcaaaaggctcatgtaagcctatgcctgaaagatctcctcatgttgctgctgagtgcaatggtagaggtctgagtgatgagatcgaagacaaacctagcacaatactcatttcaattagttctctacaggcattttatttcatgtctcagcagtcgcagtccatttctttactagaagaaactgacaggcagatacgagaaaaatcatgctcagagcaagtaaggcgtttgaaagaagcccggaatagctatcacgaggatttggtagattgtgtacggcattgtgtttggtaccgggccacccttttctcccagtggaagcaaaggggaatgtacgcaacttgcatgtgggtcgtggagcttcttttggtccttagtaactcaaatagcatgttccactatgttcctgagttctatgtggaatcactggtggattgtttccatgcactgcgaaggagcgatcctccttttgtttcccctgcattatttctcatgcaagggttggcctcgtttgtcactttggttgtcaagcacttcgatgatacaaggatagtgaaccctgacttgaaagatcttcttcttcaatcaatatcagttctcgtacagtataaagaattcatgcttgttttcgagaacaatcgggaggctataaataaaatgcctagatcactgttatcagcttttgacaacagatcatggattcctgttacaaacatactttcccggttctgcaaaggctcaggatttgcttcctataagaatggtgaatccgcatcatctgcaacttttcaggttctactgagggagacatgtattcatgaacaagagctgttcttttcctttcttaatcgacttttcaatacactcagctggacaatgaccgagttctctatgtccatccgggagatgcaagataaaaaccaggttgctgatttgcagcagaggaagtgcagtgtaatttttgatatctcatgtagccttgcgagaatcttggaattctgtacccgagagattccttgtgcttttctcatgggaccagatatgaatttgcggaggttgactgaattggttgtctttattctcaaccacatcatatcagtagctgatgcagagttctttgacatgacactaagacggccagggcagcatcaagagaaaacaaatcgtactatgatcttggctcctcttgtgggcattatcctcagtcttatggaatgtagcagcacatcagaacgaagggagctaaatgatgtgattgcagtgttcgccagcatggattgccctgccacaatccattttgggctgcagtacctactgagctacaactggagcaatgttcttcgaggggattcatcccttgcaaagctagcgcagcttaaagagttctcccattacttccgacgcattacagcgtccgtggatggtgaagaagaagaccatagcctaaacgcgggcgatgaagacgacgaccacacttgttgcatttgctacaactgtgattccgatgcaacattccagccatgccatcaccggtcctgctttggctgcataagcaggcatctcctgaacaaccagaggtgtttcttctgcaatgcagtggtaacatcggttactagatagccgattcgcgagcgatgcgctgctctactcattgcctccttcggtatcgtgatccgaaggaagatggtgccactgatttgtcttaatctattttgcttgacctgagggctggggcgctggcggcccagagatctttccattgcttttccaggaagaacgcgttacctttgtgcacgagggtcagaagcggttcttcgttttccttgctgtatatgtaaaggccaggtaatagtagaaaggattcaataacattgccgcagaaggaggtttctgtacacggtgggaagccagtaccaccgaaaggaatttcatggaatcgcaatttttgtagggtgtagggggagattccacgactgtaaatatgatgagatatgaaacagaaaagggggtggcagatcaacatcgaccttctgtaattagccagaataaaagaactagatgctttatattgagcagagctctcgtctttttgatcctccccacggtgtagtatcaagaatgaataaatcttctgtttcttgtctggttgtagcatgccagcatctgtaagttgtaacaattcagtgaatttatttaccttcagcaaaaagggtaaaaaggttgcctcttcaa

SEQ ID NO: 1465 - DNA, 4679 bp, Sorghum bicolor
tttcgcgccatcgccgccgactatcgccggccacaggtcaacaggagagcccgttcatatccggggcctctcgattgagagtttcgtctctctctctcccccttgccctgttttgccgcctccccaatcggtgtgcatcagcagcgacatcaccgtcggcgatgggaggcgtcgccgaagtcctcgttccctcctcttattacgttgaagtggcgtggcgtggcgtggagattgcttgaccgatctcttgccagtttttcttttactccaccgtgcaagatcaatccttccttttctccgtcgtgcatggggttcaactgaatcagatgctccacgttaaggccaccgttgagcttgatggcggaaggaagcagtagccataggaggagtgcattctcccctgggctggctgtgttattgtctggtgacgaagctaagattagcccccagaagtcgcacttggtgtcctatcatgacgaaattgggcaccaggctgttgagaggacgatagagcacatttttgatctccctcacaagtcagtggtccggcctcctggaccaattgatacgggcttcgtgcgctcagtgttgaggaatcaagctagaaaatttgatattgactgggaaaaatgcatccatggataccagggcagcgtcttgattgtggacaaaggtgctgggcagagcaaggtggttcttgatgattcgagcatttgcggtagcttccggaatatcaggggacctttacttgttgagagctccgccccgttcagcagtgccagggctaatgcctgtgtgtggaaaggaaaatggatgtatgaggtgaccctggagacatctggagttcagcagcttggatgggctacactctcttgcccttttactgatcagaaaggtgttggggatgctgatgattcatattcctttgatggccggagggtgactaagtggaacaatgaccctaagccatatggccagccatgggcagtaggtgacgtgatcggttgctgcatcaacttggatgcaggagaaatctccttttacaggaatgggacttctcttggtgttgcttttgatggaattcgcaatgtggaacctaagaagggatattatgctgcaatctccctctcggaaggagagcgttgtcatctgaactttggttcacatccattcaggtatcctgttgatgggtttgatccattggaggtgccaccacgctcttggtcatttgtgacatatcttcttagatgtctgttcagactgctagaagtccacaacctggagaaatctgaatcagcatactttgagaaactgaggagggtcaaaaaattcgcaccactacaagaactctttcgaccaatctcagaagggatatgtgcagaacttttcagtgctattgaagtgagccaggggtgtcttgagtatattgcctggggctcgttgaccactctactcttagatgttttcagaactcgtgagccacatgatttctcatgccttgatcaggttcttgaccttttcctccggttcccaggttgcacttcattatttcaggagctcattgtggctctttcttgcatgtgcaaagctgcaccacttgtgttgacagaatgcccatattctgggtcatacccatttttagcgctggtttgccaccttcttaggcataaagatgtaatgtgtttatggtggaaagcagaagattttgctttctcgtttgaagggttccttacaaggaagattccaaataagcaggatctacagtgccttgtaccatctgtttggtggcctgggtcttctgaggatgaagttagcatgacactgacgatgacaacactctcagatgcaatcaaaaagattgaggagatgcattgtgagctttgcagcttagtaatacgctttattccaccaatgtctcagcctcagccaccaggctctgtatttaggtcctttgtacaaagtttggtgcttaaagctagaggtggagagcataggatggttgtcaatgggactttcaacaacactgtgcttgtttcattgtacacagtaatcctacatttgttgtctgaaggattttctatggattctgctggatctgcatcatcctctaaagcaaactgtgggaatggtgttggatttcttcacaaaggtggaaagcgcaagttcccgacacaattgctttttagaaatgatgcctattacagtgtaattcctagaatcggtggaccaccaagtattttgatgcatcacaaatttgatgctgtggaaaatgaagtacagtgggacgaaggctgcatgaatgatgaagagacacgtgttacacacactacagtacagaagccttgttgctgctcagtgacagatgttgctgttggtgtaagatacaaagaaactgctaagtatgtgccatcaacttcaaaaggcccatgtaaggctatgcctgaaaggtctgctcatgttgctgctgagtgcaatggtagaggtctgagtgatgagatcgaagacaaacctagcactagtgctcaatcagaaattgaatatggataccaggcactgcatattagttctgtacaggcgttttatttcatgtctcagcagtcgcagtccatttctttactagaagaaactgacaggcagatacgagaaaaatcatgctcagagcaagtaaggcgtttgaaagaagcccggaatagctatcatgaggatttggtggattgtgtacgccattgtgtttggtaccgggccgcccttttctcccagtggaagcaaaggggaatgtacgcaacttgcatgtgggtcgtggagcttcttttggtccttagtaactcaaataacattttccactatgttcctgagttctatgtggaatcactggtggattgtttccatgcactgcgaaggagcgatcctccttttgtttcccctgcattatttctcatgcaagggctggccccatttgtcactctggttgtcaagcacttcgatgatacgaggatagtgaatcctgacttgaaagatcttcttcttcaatccatatcagtccttgtacaatacaaagaattcatgcttgttttcgagaacaatcgggaggctataaataagatgcctagatcacttttatcagcttttaacaacagatcatggattcctgttacgaacatactttcccggttctgcaaaggctcaggatttgcttcctctaagaatggtgaatccttatcatctgcaactttccaggttctactgagggagacatgtattcatgaacaagagctgttcttttcctttctcaatcgacttttcaatacactcagctggacatgactgagttctctatgtccatccgggagatgcaagataaaaaccaggttgctgatttgcagcagaggaagtgcagtgtcatttttgatatatcatgctgtcttgcgcgaatcttggaattctgtacccgagagattccatgtgcatttctcatgggaccagatatgaatttgcggaggttggctgaattggttgtctttattctcaaccacatcatatcagcagctgatgcagagttctttgacatgacactgagacggccagggcagcatcaagagaaaacaaatcgcactatgatcttggctcctcttgtcggcattatcctcagtcttatggaatgtagcagcacatcagaacaaagggagctaaatgatgtgattgcagtgtttgccagcatggattgccctgccacaatccattttgggctgcagtacctactgagctacaactggagcaatgttcttcgaggggattcctcccttgcaaagctagcacaacttgaagagttctcccattacttccgacgcattacagtgtctgtggatggtgaagacgaccatagcctaaacatggttgatgaagaagaagatgacacctgttgcatttgctacaactgtgattctgatgcaacattccagccatgtcatcaccggtcctgttttggctgcataagcaggcatctcctgaacaaccagaggtgcttcttctgcaatgcagtggtaacatcagttactagggtagccgattcgtgagcgatgcactactctactcacggtccccttctgtatcgtgatccggaggaagatcgcaccactgatttgtctatctattttgcttgacctgagggctgaggcgctggcggctcggagttctttccattgcttttcgaggaagaccgcattacctttgtgcacataggtcagaaacggttcttctttttccttgtatgtaaaggtcaggtaatagtagaaaggattcaataacaattactgcagaaggaggtttctgtacacggtgggaagccagtaccaccgaaaggatccatggaatcacaatttttgtaggttgtaggttgattccacgattgtgtaaatatgagatatgaaacagaaaaaaggggtgagagatcaacatctaccttctgtaattagccaaaataaaagaactagatgctttatattgatcagagctctagtcttctttttgttcctccccgctgtgtagcgtcaacagtgaacaaattttctgttttctgcccggttgtaacatgctgtcagctgtaacaattcagtatcagccaaattggctgcttcaagctgtttttgggtatacgtcatacgtatacgtacgcctacacg

SEQ ID NO: 1466 - DNA, 2783 bp, Sorghum bicolor
gctggaggcggtcagcaaactcgggcgtcggcggtggcggcgacgctcagccctctgcgccggctcgaactcgaaggagggagatccagcgtttcagagttcagattctcccaaacccttgccgctgccgccgcagatggaagtctgcgacgagctgcggtcgtttgaggccaccggcgtctaccgcctcgatggcaccagcaccggagccactttcctcgacccggtccgcctcctcaacgcgtcctacgagcgcttccgcatcgtcccttctgcgtactactcccgaagcttcggcccccagcatcaggaaggcgagccagagattgagcggcccgagaaacggaggaagcgcaagcgtaatcagaagccgaaatccagggagcttaatcccatggagcaggtcgctgaagcccggcaccaggaagcgaggcctttactgttgaaagcacatgaatcactcattaaggctaaacatctactggagtacatttccaagacaatcaaagacaacaggcacacacttgatgcaggaagtggttctgagaataatttcgttgagcttgggacctcatggcgagcacctttctacgagatcactctttgcttccagaaatcccatgttctgggcaatgaggaaggttcctttcatgcacaaaagacatcttttcctctatttaatagcataatcagtgttgaagggatcgatgaggcagaaggagaattccagaataggcgttatattttaccaagagaaagttgcttcttgatgaccgacttcaaacgggttagagatctcattccttgtagtccaaatcaaggatataatcttatagttgttgaccctccttgggagaatgggtgtgttcgtcagaaagaagagtatcctacacttcccaacagatatttgttgtatcttccagtgcaagaacttgcccatccagctggagcgctgcttgttttgtggattacgaatagggagaaactgcgggtgtttgttgagaaagaactgcttccttcttggggggtcaaaaatcccagcgtgttttattggcttaaggtgaaacctgatggttctctaattggtgatttagacttgttccatcacaggccttatgagtgcctcctccttggctacatcaatgttaacacaaatggcgagcaagggtcaaacttcaagttgttagaaggaagccaagtaatcatgagtgtcccaggtgctcactcaaggaaacctccccttgagaaattactttcagaatatattccaggtcctaaaccttcaagatgcatcgagctttttgccagagagttgtttcccagatggacctcttgggggaatgagccgcttcattttcaggatacaatgtacttctcagagaaataatttgattgccaagagcatgatatgaacatatggactgttgatgcaactgccacctatggcaagtggttttgcaacagcattgtaccctgtgtttctcggtggtgaacaaccccatatccagatgagtgtgccgtctgccagtgctgacctactgtttattctacatgctggtatcacaagttttgtcgtatccagtgccgattctgttgctgatatcacatttcttccattatatgtgtccattcgtcttgccgtgttccttgcattgttacattacatctggaaggtgattctccaaggactactgcagagtacttgtcgaatgttcatgggaagatctttgccgacgagagctctgccggctgccgcaagcaaactaacggaagcccgggctgcaaatgggacgacgcgcgcgacggagactgactacgtgttgagactcaaggcggcgtcagagtcctccttgccggaggtacggcgcatccggatggccctacccaccgcttcctccaaggtagccagtgccagggcgaagctagcggagggagccaagacgccggccaattcgaaggcgaagggacgacgattggatgatcaagagaagcggtgcaagaatggaaggctcgttccgtcacttgggtgcaggacctcgcctcctctgatgccagttggcccggacgcggagaagaagaagtgttcctggataactgcaaactcggaacccctctatgtcacattccatgatgaagaatggggagttcccgttcacgatgacagaatgctattcgagctgctcacactttcactagccttaggtgaactcacctggccttctattttgagcaagagggaggaattcagcttttgtaccagggagattttcgatggcttcaactttgcattggtatctgaatttacggagaagaagataaacttattgagatccaatggaatcgtgctgctgtcagagcaaaagattcgggcagttgtaacaaatgctaagcaaatgcagaaggtggttaaggattttggatcgttcagcaactactgctggagctttgtgaaccacaggcccatcacaaacggcttccgctattctcgccaagtacctacaaagacaccaaaagctgaagccataagcagggacttgatgcgccgagggttccagtgtgttggacctacaacgatctactctttcatgcaggttgccgggatcgttaacgaccatctgtcatgttgcttcagatttcaggcttgcagccagcacaagggcagtgaaaacaatgtgagagcagagccagcattgcctgatacaaggctgggctcgctatcttcggaggattcagataccagggaggtgtagcaagtcactgaagtcaacctgagtcatcttttt

SEQ ID NO: 1467 - DNA, 349 bp, Sorghum bicolor
gctcacagtcacagcctcacaggaggtcgctgcggtggttcagtacttcagttcgccatggaaggtgcagtcggccaaatggtcgtcccggtcctcggcatcgttgccgcggccgccgtgaccttctacaccgtcagcttcatggagatgcgagacaaatctttcgaggagctcgacgagaagtactcggagctcgacgagtcaggcggacggcagcgccggtctcgccggagggccgagcgcgacaggaagagagcgaaatgattgaccaccacacacaccgccgatcttatgaatttgttgatttggagatatgccggttaattcataggggtgagtgtgcatgtac

SEQ ID NO: 1468 - DNA, 655 bp, Panicum virgatum
ggtcttggcagggtgttagtgtaaaaacacaggagcgagatgccgagatgtgtatttggatagggctgctggcaccggttgactcagcttcagcagatcgttcgtggtggtcgttcggttcagttcgccatggaaggcgcggctgcccagatggccgtcccggtcctcggcatcatcgccgccgccgccgtgaccttctacaccgtcagcttcatgcagctccgagacaaatctttcgaggagctcgacgagaagtactcggagttcgacgagtccggcggacggcagcggcgggcgcgccggagggccgagcgcgagaggaagaggcgaaacgactgagacctcgcctcgcctctatgttctgcctgatcgagaggaaacaagatgccgttgctgcttgatgagtactgtacttagctattggaacaatcgaaacgatgggtttgcgcttgtttacctgtagtgccacgacgtgcttaaaaatggctctatgtatcgcctacttcagttccagcaggagctgtaaaacaatctgcccttgcatttggaaacgatgttttatttttttgaacaaacatttggaaactattttacatctttctttgtacccggctgctgcctgtcgatcctgaattgcatttaaatttccccgcga

SEQ ID NO: 1469 - DNA, 746 bp, Panicum virgatum
ggagcgagatgccgccggagatgtgtatttggataaggctgctggcaccggccaccggttggctgagcttcagcagatcgtggtggtcgttcggttcagtccgccatggaaggtgcggctgcccagatggccgtcccagtcctcggcatcatcgccgccgccgccgtgaccttctacaccgtcagcttcatgcagctccgagacaaatctttcgaggagctcgacgagaagtactcggagttcgacgagtccggcggacggcagcggcgggcgcgccggagggccgagcgcgggaggaagaggcgaaacgactgaggcctagcctcgcctcgcctccatgttctgcctgatcgagagaggaaacaagatgccgttgctgctcgacgagtactgtacttagctactggaacaatcgaaacgatgggtttgcgcttgtttacctgcagtgccaacgacgtgcataaaaatggctctgtgtatcgcctgtatcccttgcatttgatttggaaacgatgttacatttttctttttacccggctgctgcctgtggatcctgaatcgcatctaaatttccccaagttgcatcatcgggattttgtgcaaagagcagagggaagttcccaaaattcaggtgctagactcctcaaacaatcctgaattaccggtgtgaggtgtgacacaacttggggcagatgggcttatattttcgaaaagaatatactactatggaagtcctaacttactac

SEQ ID NO: 1470 - DNA, 2253 bp, Zea mays
atggccggagtgccatcgtcgctagcgcgcctctacttcctcctcctcccgctagccaccggatgcctcctcctgctgtctgctgaagccgcgcggctcccgctgtccctcgctcccgccgacgccgcggccgacgcgctcctcaggctcaaggctggcatcaacgacagcggcggcgctctcggcagctggtcccccgacacgagcccctgcggcgacggagacggcgggggggccagctggaagggcgtcatgtgcaacagggacggcgtgcacggcctgcagctcgaggggatgggcctctccggcgtgctcgacctgcgcgccctcacgagcctgcccggccccggcctccgcacgctgagcttcatggacaacgatttcgccggcccgttgcccgacgtcaaggcgctgagcggcctccgcgctctttttctgtccgggaacaagttttccggcgtgatccccgccgatgcgttcgccgggatgggctcgctaaagaaggtggtcctctccaataatgacttcaccggccccatcccggcgtcgctcgccgacgcgccccggctcctcgagctgcagctcaatggcaacaagtttcaggggaagatccctgacctgaaacaggacgagctgacggcagtcaacctcgcaaacaatgagctcgagggggagatcccgccgagcctcaaattcacgccgcctgacatgtttgccggcaacaccaagctttgcggcccaccgcttggtgtcaaatgcgaggcccctccgccgccgtcagcgtcgccgtcgccatcaccgccgccgtcaccgaagacaccgcctccagcctccgtcaaagaaggcaccacgccatcccaaccagcagcagacaccgtggcgtccacaggcgcgtcgtcagctgacgatgcgaagcaagacgagggccataagcccgtcgagggctccacctccacgtcgttcggcgtcctcgccgcattcattggcacgcttgggatcgccggcgtggcgttcgtcgcgctgcggaggcgacgggggtacaagaccaagaacttcggcccgaccgcgtcgtcggctcggccctcggatccgccgagggtcgagccgcacccgccggcggcgaaggccgaagccagcgcggcgcaggcgccccctgccgccgccgggtgcgtggcgcgcgctggcggcgcggcgcggaaggtggagcaggggcggctgacgttcgtgcgcgacgaccgcggccggttcttcgagttgcaggacctgctcaaggccacggcggaggtgctcggcaccgccaacctcggcgtgtgctactgcgccacgctcacgacgggccactctgtcgtggtgaagcggttcaaggagatgaaccgggtgggcaaggaggacttcgaggagcacatgcggcggctgggccggctcagccaccccaacctcctcccgctcgtcgcctactactaccgcaaggaggagaagctgctcatccacgactacgtccccaaccggagcttggcgaacctcctccatggcggcggcgacgagcgcgggatgaagaaggcggcgctgcattgggcggcgcggctgaagatcgtcaagggcgtggcgcgggcgctcagctacctgtacgacgagctgtgcatgctcacggtgccgcacggccacctcaagtcgtccaacatcctgctcgacggccactacgagccgctgctgacggactacgcgctggtgcctgtgatgaaccagtcgcacgccgcgcagctcatggtggccttcaagtccccggagcggaagcagttcggccgctcgtccaagaagagcgatgtctggtgcctcggcctgctcatcctcgagatgctcaccgggaagccgccgacctacgacctgcccaaggcggcgggggcggtgccgtcggccgaatcgttgtcgtcaccgcagaagccgggtccggcggcgggcaacggcacggacctggtgaccgtcgtggggtcgacgccggagggcgagtggctggacaccgtggtggacccggacctgaggggcgaggaggaggaggacaaggaggagatggtgaagctgataagggtcggcatggcgtgctgcgagagtaacgtggacagccggtgggagctcaagaccgccatcgacaagatcgaggagctcaaggcgaaggagcgccccgcccccgacgaggagcaggccttctactcgacggtgaacaacgaggacttcaacgacgttgccatcaactga

SEQ ID NO: 1471 - DNA, 2498 bp, Sorghum bicolor
cgtcgtcaagcgctggcgccggcgggctggctccctggcaccggcgccgcggccgccccggacatggcccgagtgccatcgttgctgctagcgcgcctcatcttcctcctcttgctcctgctggtcgctgacgccgcgcggctcccgctgtccctcgcgcccggcgacgacgccgccgcctccgacgcgctcctcaagctcaaggccggcatcaaggacgaagacggcgcgctcggctcctggtcccccgacacgagcccctgcggaggagatggcaacggcggggggaccacctggatgggcgtcatgtgcaacaaggacggcgtgcacggcctgcagctcgaggggttgggcctctccggcaagctcgacctgcgcgccctcaagagcctgcctggccccggcctccgcacgctcagcttcatggacaacgagttcgccggaccgttgcccgacgtcaaggagctcagcggcctccgcgctgtctttctgtccgggaacaagttctccggggtcatccccgccgacgcgttcgccgggatgggctcgcttaagaaggtggtcctgtccaacaatgaattcaccggacccatcccgccgtcgctcgccgacgcgcccaggctcctggagctgcagctcaatgacaacaagtttcagggcaagatccctgacctgaaacagggcgagttgacgcaagtcaacctcgcaaacaatgagctcgagggggagatcccggcgagcctcaaatccatgtcacccgacatgttcgccggcaacaagaagctttgcggcccaccgctcggtgccaaatgcgaggcccctccgccgccgtcgccgtcaccaaaggcaccaccgccgtcgcagtcaccaaaggcgccgccggcgacctccgccaaagaagggaccacaccgtcggtaccagcagcagacatcgtggggtctacaggcgcgtcgtcagctgacgacgcgaagcaagacgaggcccagaagcccgccgagggctccacgtcgttcggcgtcctcgccgcgttccttggcgcgcttgcgatcgccggcgtggcgttcgtcgcgctgcgcagacggagtgggtacaagaacaagaacttcggcccgaccgcgtcgtcggctcggccctcggggccgccgagggtcgagccgcacccaccggcggcgaaggctcaagcaagcgcggcacaggcgaccggcgccgccgacgggtccgtgtcccgcggcggcggcgcggcgcggaaggtggagcaggggcggctgacattcgtgcgcgaagaccgcggtcggttcttcgagctgcaggacctgctcaaggcgacggcggaggtgctgggcacggccaacctcggcgtgtgctactgcgccacgctcacgtcgggccactccgtcgtcgtgaagcggttcaaggagatgaaccgggtgggcagggaggacttcgaggagcacatgcggcggctgggccggctcagccaccccaacctcctcccgctcgtcgcctactactaccgcaaggaggagaagctgctcatccacgactacgtccccaaccggagcttggcgaacctcctccatggcggcggagagggctgcgggatgaagaaggcggcggtgcactgggcggcgcggctgaagatcgtcaagggcgtggcgcgggcgctcagctacctgtacgacgagctgggcatgctcacggtgccgcacggccacctcaagtcgtccaacatcctgctcgacggccactacgagccgctgctgacggactacgcgctggtgccggtgatgaaccagtcgcacgccgcgcagctcatggtggccttcaaggccccggagcggaagcagttcggccgctcgtccaagaagagcgacgtctggtgcctcggcctgctcatcctcgagatgctcaccgggaagcagccgagctacgacctgcacaagccctcgggcgagtcgtcgtcgtcgtcaccgccgcagaagccgggtccggcggcgggcaacaccacggacctggtgaccgtcgtggcgtcgacgccggagggcgagtggctggacacggtggtggacccggacctgcggggcgaggaggaggaggacaagcaggagatggtgaagctgatcagggtcggcatggcgtgctgcgagaccaacgtggacagccggtgggagctcaggaccgccattgacaggatcgaggagctcaaggccaaggagcgccccgacgaggagcaggccttctacacgacggtgaacgaggaggaatacagcgacgttgccatcaactgaagatcgagagatgaaccggcaaggaatcgatcgatagggagggacagtgttgtgtgcatcaagctgatgatgagctcaaaattgtgaaaccataagcatgaactagtactgtgtgttcttatatgtctttgttgggttgttgccggcggtagattttggagagaaaagaagctacttatatataatcacacgaatcttagtttgctttt

SEQ ID NO: 1472 - DNA, 2235 bp, Oryza sativa
acacttggcagaggcagccggctttccctttccccttccctctcgtcgtcttcttcgtctccctacctcctcttacctcaacctccaataatccccatcttcaaacccccctcaaaatccatatttggtgttgctccactgattgattccactcaagattgtcgtcaatcggtctctgcatatggcagttggttcctcctgcccaccaccaccagccctagtttaggcctcccccatcaaatctactgccatccccgactagtatacctcaactcttcaatttctcttgattcaaattcaaatgagggggatgcttcctctgctctgctgcagtagcgcttaattgacaaggcgggggtcccgttgtttcgcgctgcgatctctcatcacttcttctccgcaatctctagctggtctactttgtccaatagcgaactgctgaccaaattcagtgtgccctgttcagttcatcaggatatccatgtctgaccatcgaacacacgcgagcgactgtcatccagttgccagccaaccagatgttcagtgcctagtttgcacaaggccgtttactttggatgctcaggtgaccgatacctttgaagctttagccatatgcagggactgcaagatgacagtactcaatgatgatgaaagagatgaaataaccagcacttatcggcagaacacacggaggaggcagatatccaggactgcaagcattgatttcctggaggacgcattcttgcaggagttttctcagctgatcgacttagcaagaagacaaggtcgtgaaacggatattgattcttcgtcggtcgcgccgcaacatgcatcgtttaattcaacaccaagccaatctcaaagatggcatgcttcagatgatgagagcgatggccttaattatgttgattctgtgtttggtgaaattgaatctgccatcagtcttggtgactatggtggagattcagatacctccatagaggaacatagcgtgatgacaaggaggaggatttccattcaacttgacaatgacagctacatgaacacagatactgatattgatcccatgaatgctagactggatcagtgggattcagatgaccaggaagatgtggaagagtctggttttgatgaaatagtcaacaccatgacccagcaccagcagcaatcacatgatattcagctaagtggattgagtgaggacgaatctgaagatggtgtatggaattggagtgtgagtgtacgtcaaagagcaaatgtgaccaacttgctagatgacatggaagagccagaaatgaggacaacttttgtcgggaatccagatgactatgttgatgcaaggcagtttgagatgctccttgagcaatttgctgaggacaacgattccagaagaggagctccaccagcagcgacatcctttattgaaaatctcccctccgtgattatctctgcaagccatcagacaaatggtgatgttatttgtccagtctgcaaagacccaattcctaccagagctagagcaaaacagctaccatgcatgcatctttatcattcatcgtgcatcttgccatggcttagttctagaaatacatgtcctgtctgccgatatgagcttcctacagatgatgcagagtatgaaaggtccaagcaagccacaaccaatgtaagagacattcaggttgtggaagaaatttctgatgaacaagaggtccaggtaactcgtcagatggctgctggtgtgatcgaagagactaatacaagtgaacacaatgttcgtgttgatgagcaaccaaacagtgcacgcaggcgcagtggatggctttttattgctgctgctccagttgtaagcctcatcggtttcgctctagttttatgctttacaaatcccgctaggagtggtagaaggcaactgtactgtagatccccaagtgccactgaagtacatgtggacaccaaaaagagttggtggtctatgttctagaatgttccgttggtacatctgataacaaaatgactatatggtggtgtgtgattgtttctttagaatagttttattttaaaattttcaaacgttgtagttgctgcagttaccggtcggagtgttgtaaaagaattcacatgccaccggttgtaaaagaattcacatgcctactttcttctgctactttgctcagtcaagcaaagtgtgtattgatacttgctatttgtttaacatatatgtgtcattggatgtcc

SEQ ID NO: 1473 - DNA, 2257 bp, Hordeum vulgare
ggaaaaagatgctgcgggtggaggaggcgctggcggcggtgctgtccgccgcggcggcctgccgcgccgccccgtcggccgtgccgctgctcgacgcgctcggcctcgtcctcgcggaggacgcccgcgcgcccgacccgctgccccccttccgcgcctccgtcaaggacgggtacgccgtggtggccgccgacgggcccggggagtacccggtcatcgcggaggccagggccggcgacgacgcgctcggcgtggtcgtcaccccaggcaccgtcgcctacgtcacgaccggagggccgattcccgacggcgcggatgctgtcgtgcaggtggaggacacggagcaggtcgccgccgcgccggatgggtcgaagagggtcaggatctcggcgcgggtacccgaggggcacgatatacgcagcgtgggatgtgacatagagaaagattctatagtcctgaaatccggtgagaacataggtcctgcagagattgggctacttgcaacagtgggagtaactactgtcaaggcataccgtcgaccaaccattgctgtattttctacaggggatgagttagttgagccagccactgcaactctcaatcgtggtcagattcgtgattccaaccgggccatgctacttgctgctgctattcagcagaagtgtaaagttgttgacttgggtattgcaaaagatactgaagaaagtcttatggagcatatggatgcagctctacattctgatgctgatataatccttacttctggtggtgtttccatgggtgatagagatcttgtcaaaccttgcttggcaaagatgggtaaaattcacttcgaaaagattcgaatgaaaccagggaagccattgacatttgctgagatcacatcaaatgacacaacaaagccatccaaaacagctcttgcttttggtttgcctggaaaccctgtgagttgtatggtttgcttcaatgtctttgttgttcctgcaatacgtctcgtctctggttggtcaaatcctcatctgcagagagtgcatgtgcgtatatcacatcctctaagggcagacccacatcgcatggagtttcatcgtgcagtgatcagatgggtgcttgacgatggatctggtaggccaggttatgttgctgagagcactggccatcaagctagtagccgccttctaagtatgaaatcggcaaatgccttgctggaagtgcaatcatctgggcagatattggcagctggggcatctgtccaagctatacttatttctgatataactagccctcctctggataagttgcctgctgcttccagccccctatcatctcatcttgtttcttctgcaaaaagtgctttggcgggtgcgccacaggctgcagcctctcagaatgccgaagttaaagtagcaattctgactgttagtgacactgtttcttctggagcaggcccagataggagtggcccaagagctgtatctgtagtgaactcttcatcagagaaattagggggagcagttgttgttgctactgctgtagttccagatgaagtggacaaaattaaggagattctggtgaagtggagcgatattgaccgcgtcaacctcatattgaccttaggtggcactggcttcacacctagagatgttacgccagaagcaactaaatgtgtaatagagaaagaagcacctggccttgcgtttgttatgattcaggagagtttgaaggtgacaccttttgcgatgctctcccgggccgcctgtggtataagaggatcgacacttatcatcaacatgcccggcaacccaaatgctgtcgcggagtgcatggaggctcttctcccggcgctgaagcatgccatgaagcagctgaagggtgacaagagggagaagaacccccgccacgtgcctcacgctgaagcggcgcccgtggaccagtgggagcgcagtttcagagctgcgtcgtcgggcggcggctgctcatgcgacccctgatcggcgcttcatctagaggtggtggaacactcctgtctcttgggaatctgctttcgcaatccagcttcgggcgcaggttggctatgtgccactcttttgagggctggcatgcgtgtcttgccaataaagcagtgagagttatttttatctggtcttgtatgtatcagtctattctctcacaacgacggttgtcattttgcctgtattatactgttacgtactgatactcatgatcggtggaaataaagtgcagtgaactttcaggaaaa

SEQ ID NO: 1474 - DNA, 2338 bp, Brachypodium distachyon
ggaaaaaaaaatgctgcaggtggaggatgcgctggcggccgtgctgtccgccgccgcgggccggcgcgccgccgcctccgcctcagccgccgtgccgctgctcgacgcgctcggcctcgtcctcgcggaggacgtccgcgcgcccgacccgctcccccccttccgcgcctccgtcaaggatgggtacgcggtcgtggcctcggacgggccaggggagtacgccgtcatcgcggaggcgagggccggcgacgacgcgctcggcgtggtcgtgacccccggcacggtcgcgtacgtcacgaccggagggccgatacctgacggcgcagatgccgtcgtgcaggtggaggacaccgagcaggtcgccgccccgccggatgggaccaagagggttaggatttcggtgcgggtagccgaggggcacgacatacgcaatgtggggtgtgacatagagaaagatttagtagtgctgaagtctggtgagcacctaggtcctgcagaaattgggctacttgcaaccgtgggagtaactgctgtcaaggcataccgtcgaccaacaattgctgtgttttctacaggggatgagttggtgcagccagacactgcaactctcagccgtggtcagattcgtgactctaaccgggccatgctacttgctgctgctattcagcataagtgtaaagtggttgacttgggtattgcgaaagacactgaagtaagccttaaggagctaatggatgcagctctacgttccgatgctgatataattcttacttctggtggtgtttccatgggtgatagagatcttgtcaaaccttgtttggcaaagatgggtaaaatttactttgacaagatccaaatgaaaccaggaaagccgttaacatttgctgagatcagcacggacgacacagcaaggtcatcgaaaacagctcttgcttttggcttgcctggaaaccctgtaagctgtatggtttgcttcaatctctttgttgttcctgcgatacgtcttctctctggttggtcaaaccctcatttgcaaagagttcatgtgcgtctatcacatcccttaagagcagactcacatcgtccagagttccatcgtgcagtgatcagatgggtgcttgatgatggatctggtagacctggttatgttgctgagagcactggccaacaagctagtagccgcctcctaagtatgaagtctgcaaatgccttgctggaagtaccagcatctggacagacattagcagccggagtatctatccaagctatagttatcgcggatataaccagccctcctttgtataagcaacctgctgccaccactaccagccttctaccaactcattttgtttcttctgcaaaaagcatgtccacagatgtctcccaggttgcggcctctcagaatgctgaagttaaagtagcaattctgactgttagcgatactgtatcttccggagcaggccccgataggagtggcccaagagctgtatctgtagtgaactcttcatcagagaaattagggggagcagttgttgttgctactgctgtagttccagatgaagtggaccaaattaaggacgttctggtaaagtggagtgatgttgaccgtgtcaacctcatcttgaccttaggcggcactggcttcacacctagagatgtcacaccagaggcaacaaaatgtgtgatagagaaagaagcacctggccttgcgtttgttatgattcaggagagtttgaaggtgacaccatttgcaatgctatcccgggctgcatctgggataagaggatcgacacttataatcaacatgcccggcaacccaaatgctgtcgcagagtgcatggaggctcttctcccagcgctgaagcatgccatcaagcagctgaagggtgacaagagggagaagaacccccgccatgtccctcatgccgatgccgcgcccgtggaccagtgggagcgaagttttaaagccgcatcctctggcggtggatgctcgtgtgacccctaatcgacggttcgacacagatccatacacctgggaaatctgtatgataagaatttgatcttgtgggaccaaacaactacttcctttgtgatcctgttctgtcagcttggactgcttgaggctcaagcctcaaagatgacggccttttgtttgctcgacgtgccatgtttcatactcctttttgcactaggcctcatttcacattgtgacagttgtcgcttttttgtaattacaccgagcttgatattgaataaattacctagtaatagtgataactgcactcaaaattacatacgtgcactacacaatacataaagtggcagggctcaatttgta

SEQ ID NO: 1475 - DNA, 2309 bp, Zea mays
gctcgcggcactgcaaccgcagtggtcaaacgtgggaaattgaagcggaggaagatagagagaaaaagaggagacgagagagggagagagatgctgcaggtggaggaggcgctggcggcggtgctgtccgcggcggcgggccacgcggagccgcacgccgtgccgctgcagggcgcgctcgggctcgtcctcgcggaggacgtctgcgcgcccgatccgctccctcccttccgcgcctccatcaaggacggatacgccgtcgtggcctccgatgggccaggggagtatcctgtggtcacggagtcgagggcgggcgacgacgccctcggagtggttgtcgtccccggcacggtcgcctacgtcaccaccggagggccggttcccgatggcgccgatgccgtcgtgcaggtggaggacaccgagcagctccctggcggagcggatgggtccaagagggttaggattcttgcgcgggcctcccaaagacaggacatccgcagtgtgggatgtgacatagagaaggattcgattgtgctcaagtctggtgagcatataggtcctgcagaaattgggctacttgcaacagtgggtgtaaccactgtcaaggtgtaccctcggccaacaatcgctgtattctccacaggggatgagctagtgcagccagccactgccaccctcagccgtggtcagattcgtgattccaatcgagccatgcttctagcttgtgctattcagcagaaatgcaaagtggttgacctaggtattgcagaggacactgaagaaagtctcaaggagcatatggatgcagctttgcgttctaatgctgatataatcattacttctggtggtgtttccatgggcgacagagatcttgtcaaaccttgcctggcaaagatgggtaaaattcactttgagaagatccagatgaaaccaggaaagccgttaacctttgctgagatcaccacacaagacacgccaaagccatctaaaacagttcttgcatttggtttgcctggaaatccagtgagctgtattgtttgctttaatctttttgttgttcctgcaatccgtcttctctctggctggtcaaaccctcatctgcaaagagtgcatgtgcgcatatcacatcctttaagagcagacccacatcgtacagagtttcaccgtgcagcaattagatgggtgcttgatgatggatctggtcgacctggttttgttgctgagagtactggccatcaggctagtagccgtcttcttagtatgaaatctgctaatgccctgctggaaataccatccactggacaaatattggcagctgggacatctatccaagccatacttatttcagacataataacttcttcagataaactgcctactccttcaaatccgtatccatctcgtggtccttctgcaaaaagtatttccgcagatgtatctcagattgcatctccacaggatgctgaagttaaagtcgcaattctgactgtaagtgacactgtttcatcaggtgctggccctgataggagtggcccaagagctgtatctgtagtgaattcttcatcagagaaactgggtggtgcaactgtggttgccactgcagttgttcctgatgaagtggacaagatcaagggcattctggtacaatggagtgatattgaccatgttaacctcattctgacattaggtgggactggcttcacacccagagatgtcacaccggaagcaacaaaaatggtgatacagaaagaagcgcctggtctcacatttgttatgcttcaagaaagtttgaagattacaccattcgcaatgctatcccgggccacagctggaatcagaggatcaacacttatcatcaacatgcctggcaacccaaatgctgtggcagaatgcctggaagcactcctcccagcgctcaagcacgccctgaagcagatcaagggtgacaagagggagaagcaccctcgccacactccacatgccgcagcggcgcctgtggaccagtgggagcggagcttcagagccgcatcatctggtagtggtgggtgctcatgtgatccctgaggagccctgatcgactgtgaaataccaaaagagtggaaccaaatacgagacagtaggagagctctgtgtcctccgtgctccattgcattgcctgcgtgcctgcgtccagttcgatgttgaagttttgatcttgttctttggtatgttatatggagatgcgggagtccttgattgttacttgctcacgaacttctttcactgtgctacaaataatgtataatatgtaatctcattgactggccgtt

SEQ ID NO: 1476 - DNA, 2371 bp, Sorghum bicolor
gagtcagccagatagacacacagccctcgcccgccgccgccggggctgacgagccgtgggaaattgaagcggaggaagagagagagagagagagagagagagagagagagagagagagagagatgctgcaggtggaggaggcgctggcggcggtgctgtccgcggcggcaggccacgcggcgccgcgtgccgtaccgctgcacgacgcgctggggctcgtcctcgcggaggacgtccgcgcccccgacccgctccctcccttccgcgcctccatcaaggacgggtacgccgtcgtggcctccgacgggccaggggagtacccggtggtcacggagtcgagggcgggcgacgacgccctcggcgtggtcgtcgctcctggtacggtcgcctacgtcaccaccggagggccgattcccgatggcgccgacgccgtcgtgcaggtggaggacaccgagcaggtcaccagcggagcggatggggccaagagggttaggattctggcgcgggccgccgaggggcaggacatccgcaatgtgggatgtgacatagagaaggattcattagtactcaactctggcgagcatataggtcccgcagaaattgggctgcttgcaacagtgggtgtaaccactgtcaaggtgtaccctcgaccaaccatcgctatattctccacaggggatgagctagtgcagccagccactgccaccctcagtcgtggtcagattcgtgattccaatcgagccatgcttctagctgctgctattcagcagaaatgcaaagtggttgacctgggtattgcagaagacactgaagaaagtctcaaggagcatatggatgcagctttgcgttctgatgctgatataatcattacttctggtggtgtttccatgggcgacagagatcttgtcaaaccttgcctggcaaagatgggtaaaattcactttgagaagatccagatgaaaccaggaaagccattaacatttgctgagatcaccacacaagacacgtcaaagccatctaaaacagttcttgcatttggtttgcctggaaatccagtgagctgtatggtttgcttcaatctttttgttgttcctgcaattcgtctcctctctggctggtcaaatcctaatctgcaaagggtgcatgtacgcctatcacatcctttaagagcagactcacatcgtacagagtttcaccgtgcagtaattagatgggtgcttgatgatggatctggtcgacctggttttgttgctgagagcactggccatcaggctagtagccgcctccttagtatgaaatctgctaatgctctgctagaagtaccatccactggacaaatattggcagctgggacatctatccaagccatacttatttcagacataataacttctcctttagataaactgcctgctccctcaaatccgcatccatcacattttggtccttctgcaaaaagtatttccacagatgtatctcagattgcatctccacaggatgctgaagttaaagttgcaattctgactgtaagtgacactgtttcatcaggtgctggccctgataggagtggcccaagagctgtatctattgtgaattcttcatcagagaaactgggtggtgcaactgtggttgccacttcagttgttcctgatgaagtggacaagatcaagggcattctgatacaatggagtgatattgaccatgttaacctcattctgacattaggtgggactggcttcacacccagggatgtcacaccagaagcaacaaaatctgtgatacagaaagaagcgcctggtctgacatttgttatgcttcaagaaagtttgaagattacaccattcgcaatgctatcccgggctacagctggaatcagaggatcgacactaatcatcaacatgcctggcaacccaaatgctgtggcagagtgcatggaagcacttctcccggcactcaagcacgccctgaagcagatcaagggtgacaagagggagaagcaccctcgccataccccacacgccgcagcagcacctgtggaccagtgggagcggagcttcagagccgcatcagctggtagtggcagggggtgctcgtgtgatccctgaggggccctgatcggctgtgagatacccaccagagtggggaaccaagacgagacagtaggagagctatgttctttgctccagtgcacgactgcgtccagcttgatgttgaagttttgatcttgttcgttgtgatgttatatgaagatgcgggagtctagcttgataccgtgctgttacttgatcgtgaacttctttcactgcgttattacaaataatgtacaatatggttctagtctcatttactggccgatgatgttttgccttca

SEQ ID NO: 1477 - DNA, 2185 bp, Triticum aestivum
  misc_feature (297)..(297): n is a, c, g, or t
  misc_feature (300)..(300): n is a, c, g, or t
  misc_feature (425)..(425): n is a, c, g, or t
  misc_feature (433)..(433): n is a, c, g, or t
ccacgcgtccgcggacgcgtgggcgagagggagagaaaaaaaatgctgcgggtggaggaggcgctggcggcggtgctgtccgccgcggcggcctgccgcgccgcgccgtcggccgtgccgctgctcgacgcgctcggcctcgtcctcgcggaggacgtccgcgcgcccgaccccctgccccccttccgcgcatccgtcaaggacgggtacgccgtggtggccgccgacgggcccggggagtacccggtcatcgcggaggccagggccggcgacgacgcgctcggcgtggtcgtgacnccnggcaccgtcgcgtacgtcacgaccggagggccgattcccgacggcgcggatgccgtcgtgcaggtggaggacacggagcaggtcgccgccgcgccggatgggtcgaagagggtcaggatctcggngcgggtanccgaggggcacgatatacgcagcgtgggatgtgacatagagaaagattatatagtgctgaaatctggtgagaacataggtcctgcagaaattgggctacttgcaacagtgggagtaactactgtcaaggcataccgtcgaccaaccattgctgtattttctacaggggatgagttagttcagccagccactgcaactctcaatcgtggtcagattcgtgattctaaccgggccatgctacttgctgctgctattcagcagaagtgtaaagtggttgacttgggtattgcaaaagatactgaagaaagtcttatggagcatatggatgcagctctacgttctgatgctgatataatccttacttctggtggtgtttccatgggtgatagagatcttgtcaaaccttgcttggcaaagatgggtaaaattcacttcgaaaagatccggatgaaaccagggaagccattgacatttgctgagatcacatcaaatgacccaacaaagccatccaaaacagctcttgcttttggcttgcctggaaacccagtgagctgtatggtttgcttcaatctctttgttgttcctgcaatacgtcttgtctctggttggtcaaatcctcatctggagagagtgcatgtgcgaatatcacatcctctaagagcagacccacatcgtatggagtttcatcgtgcagtgatcagatgggtgctcgacgatggatccggtagaccaggttatgttgctgagagcactggccaacaagctagtagccgccttctaagtatgaaatctgcaaatgccttgctggaagtgcaatcatctgagcagatattggcagctggagcatctgtccaagctatacttatttctgatataactagccctcctctggataagctgcctgctgcttccagccccttatcatctcatcttgtttcttctgcaaaaggtgctttggcggatgcaccacaggttgcagcttctcagaatgctgaagttaaagtagcaattctgactgttagtgacactgtttcttctggagcaggccccgacaggagtggcccaagagctgtatctgtagtgaactcttcatcggagaaattagggggagcagttgttgttgctactgccgtggttccagatgaagtggacaaaattaaggagattctggtgaagtggagcgatattgaccgtgttaacctcatcttgaccttaggtggcactggcttcacacctagagatgttactccagaagcaactaaatctgtaatacagaaagaagcacctggccttgcgtttgttatgattcaagagagcttgaaggtgacaccatttgcgatgctatcccgagccgcgtgtgggataagaggatcaacacttatcatcaacatgcctgggaacccgaatgctgtcgcggagtgcatggaggctcttctcccagcgctgaagcacgccatgaagcagttgaagggtgacaagagggagaagaaccctcgacacgtgcctcatgctgaagcggcacctgtggaccagtgggagcgcagcttcagagccgcgtcgtcgggcggtggctgctcatgcgacccttgattggcactcgtccagaggtggtggaacactcttcctggggaacctgctttcgtaatcctgctgcatctagtttgaagctgaaacagcgatggtttcgattttgatcgttatggccatttcgtgactctttggacatttgagaaccggcgtgtatgtgctacca

SEQ ID NO: 1478 - DNA, 6746 bp, Brachypodium distachyon
atggcagcggcattagcatggaggttcaatggaactaatggcagcagccacggtggcgcagatctggaaaggcatgtggataaagttcaagattcagagccgccaactcctgtctcagtcatgagaatgggcaaaaaccgagtcaacatggaggatgaggagacactttcaagtgttgctcaatgtattgagcagttgcggcagagttcttcatcctctcaagaaaaagaaagctcattgaagcagttattggatcttattcaagcacgtgataccgcatttggagctgttggatcacatccgcaggctgttccgatacttgtttctctcctcagatctggctcatctggagttaagatgctagctgctactgttctgggatctctttgcaaagaagaggagttaagagtgaaggttctgcttggtggttgcattcctccattgcttgctcttctcaggtccaaatcagctgaaagtcagactgcagctgccaaaactatttattctgtttctcaaggtgggataagggaccatgttggatcaaagattttctcaacggaaaatgttgttcctgtactgtgggagcaactcaaagttagcctcaagaatgagagtttggtggatagcctgctaactggagcactgaagaacttgtcaaaaaacacagaggggttttggtcagcaaccgtgcaatgtggcggagttgatatacttataaagctggttggatcaggacaaacaaatacccttgcaaatgtgtgcaatcttcttggggctctgatgatggaagactcgtctgtttgttcgaaagttttatcaggagaaacaacaaaacagctgctgaagttacttggtcctggtagcgaaacttccattagagcagaagctgctggtgctctcaaatccttttctgcacagagtaaggaagctcggcggcagatagctaattccaacggtattcctgctcttataaatgccactattgctccatcaaaagagttcatgcaaggagaatctgcccaagcactgcaagaaaatgcaatgtgtgcattagcaaatatatcaggtggtttatcttatgtaatctcaagccttggtgaaagtcttgaatcatgctcttcacctgcacagattgccgacactcttggtgcattggcctcagctttgatgatctatgacacaaatgcagaatcaaccagtgcttcagatcctctggtcattgagaaaacactgatgaaacagtttaagcccaaggcacccttccttgtacaggagcgtgtaattgaagcattggccagcttgtatagtaacccagttctctgcaagacacttgcagactccgatgcaaaacgcttgcttgttggtctgataaccatggcaggtactgaggtgcaagatgacctgatgacatcacttttttctctctgcaagaaggattgtgatctatggcaagctctgcaaggtcgtgagggtgttcagctattgatttctttacttggtctttcctcagaacagcagcaagaatgtgcagttgctctacttgcccttctatcaaaggagaatgatgagtgcaaatgggccatcactgctgctggtggcatacctcctcttgttcagatattagaaaccggttctcccaaagctaaagaagattcagcaaccatcattggcaatttgtgcaatcacagcgaagacataagggcatgtgttgaaagtgctgatgcagttcctgctttactgtggcttctcaaaaatggaagtgacaatggcaaagagatagcatccaaaacactgaatcatctaattcacaagtcagatactggaactattagtcagttgtctgctctgttgacaagtgaacagcctgaatcaaaagtttatgttctggatgctttgaaaagcttgctttctgttgcaccacttaatgatattctgcatgaaggaagtgccgcaaatgatgcggttgagacgatgatcaaaatactaagttccccaaaagaagaaactcaagctaaatcagcatctgctcttgctggtctattccattgtcgcaaagacttgcgagaaacacatattgcagtgaagacactttggtcagtcatgaaactgattgacacgcagtctgacagattactaatggagtcttcatgttgccttgctgccatttttctttcagtcaagcaaaataaggaggttgctgcagttggacgagatgcattagctacactagtctcacttgcaagttctacagttctggaagtagcagagcaagcaacccgagctttggccaacctctttcttgatcatgacatgtgtgcccaagtatcttttgaagaaattctgttccctttaacacgtgtacttagagagggatccattgatggaagaactcatggagcagcagcaatagctcgccttttgcagtgccgacctgttaaccagcctatctctgatactattaatcgctctggtgctgtccttgctctagctgggctcttggaagctgctaatggtgatgctactgcaacctcagaagttcttgatgcacttgtgctgttgtcaagatcaaaggtgtcaagtgggcataccaaggctccctgggcagctcttgcagaaaatccccacaccatattgccccttgtgtcttgtgtagctgatgcagcaccctccttgcaagataaagccattgaagttttgtcaaggctctgttccaagcaacatgatgttgtgggcggtttggtttctgaaatcccaggttgcatatcatcagtagcacggcgagtcattggctccaacatcctgaaagttaaagttggcggatgtgctcttcttgtttgtgcagcaaaagagcattgccagaagcagatagagatcttgtgtgattcaagcttatacattcagctaattcattctctagttggtatgatccaggcaacaaactttgcttctgaaaatgggaacggtgaaagcatatcagacatcaaaatttccaggcaatccaaagaaaataacagtgatggtgatatggtgtgccacactgctattatctcgggcaatatgattccactatggctgcttgctgtcttcactcgccatgacaataaaacaagagccgaaattctagaagctggagcggtcgaaatgctcactgagaagatttctcaaaatgcattcctatatgtgggtgaagaagataatactgcatgggtctgtgccttgcttctcgctttgctatttcaagaaagagagataaatcgatctaattcagcatcacattcaattcctgtgctctcaaacttattaaggtcagatgagccagcatacaggtactttgctgcacaagctttggcaagtctggttagcaacggtagcagagggactcttctggctgttgctaattctggggcggccactggactcatatctttgcttgggtgtgctgatgtcgatatagctgatctgttggagttatcggaggaattcatgttggtgcaaaatccggatgaaattacgctagagaggctattcagagttgatgatatcagggttggctcaacttccagaaaatctattcctcttcttgttgatctactcaaacccattccagaaagacctggtgctcctttcttggcactgggtcttcttacacaattggctgttgattgcacccaaaacatgctgctaatggctgaagttggagtcctagaagcacttacgaaatacctatcacttagcccacaagatgctacggaagaagctacaactgagttgttgggcattctttttagtagtacggaaataaggcaacatgaatcagcacttggtgctgtaaaccaacttgtggctgtccttcgtctaggaggaagaaattcacgctacagcgctgcaaaggcattagaaaacttgttttgtgctgaccatgtcaggagcagtgagtcagctcggcaggctattcagccacttgtagaagttctgagtactggcatggagagggagcagcatgcagctatatcagcacttgttaggctgctttgtgacaatccatcaagagcacttgctgttgcagatgttgagatgaatgcagtggatgttctgtgccggattctttcatcagattgttcagctgagttgcaaggtgatgctgctgaactgtgcggtgttctgtttgcaaatacaaggatccgttctacaatggctgcagctcgttgcgtggaacctttggtcagtttactggttagtgaagccaacccggctcagctttctgtagttcgtgcactggataagcttctagatgatgagcaacttgctgaattagtggcagcacatggggctgtcattcctcttgtcgggcttttattgggcaaaaactacatgcttcatgaggcagtcgcaagagctttggtgaagcttgggaaggatagacctgcatgcaaattggaaatggttaaagctggtgtaattgagagcattcttgatattcttcatgatgcccccgattttctttgcatggcattggcagaaatgcttcggattttgacaaacaatgctagcatagcaaaaggtccatctgcagccaaagtagtacaacccctattctctctgctatctaaggcagatactggtcctgaggggcagtacagcactttgcaggttctcgtgaatatcttggagcatcctgaatgtcgagctgattataacttgacagcccgccaaacaattgagccagtcattactttactgaattcatctccgcctgctgtacagcaattagctgcggagctcttatctcatctccttctagaagaacacctccacaaggatacagtagcagagcagtccatcactcctcttattcaagttctttcatctggtttgccaaatttacagcagagagctataaaagctcttgctaatcttgcattagcctggccaaatacaattgcaaaggagggtggtgtgtttgagttatccaaggtgctgttgcaatctgaccctcctttgcctcatgttgtatgggaatctgcagcatctgtcctgtctagcattttgcagtacagtactgagtttttccttgaggtacctgttgcagtactagtgcagttgctcaggtcaggaactgaaagtactgtcgtgggtgccctgaatgccctacttgtattggagagtgatgattcaacaagtgcagaagcaatggctgaaagtggggccgtagaagctctgttggatctcttgaggagtcatcagtgtgaggaagctgctgccagactcattgaggcattgctgaacaatgtaagaataagggaagccaaggctgcaaaaaatgctattgcacctttgtccatgtaccttttggatccacaaacacagtctcaacaaggaaggttgcttgctgctcttgctcttggagatcttttccaaaatgaaggtcttgctcgttctactgatgctgttgcagcatgccgtgctctggtcaatcttcttgaagatcagcctactgaagagatgaaagtggtagcaatctgtgccttgcagaacctagtcatgtatagccgagcaaataaaagagcagttgcagaatctggtggcgtccaggtcctgctggaccttatcagttcaagcaatcctgacacttctgttcaggcagcaatgtttgtcaagcttctgttcaataatcacactatccaagaatatgccacaagtgaaacagtcagagttattaccgcgtcaattgagaaggatatatgggcatcagggagtgctaatgaggagtatcttaaagcgcttaatgctctacttagcaacttccctcgcctgagagtcactgaacctgctacattatgcattccacatcttgtaacatcccttaagactggttctgaagcaactcaagaagcagcactggattcactctatctgctcaggcaagcgtggtcagcttgcccagctgaagtatttaaagctcaatcagttgctgcctcagaggctattcctctacttcagtacttgatacagtctggcccaccacggttccaagaaaaggcagagatgctacttcagtgcttgcctggaacacttacagtcacaataaagcgtggcaacaatctaaggcagtcagtgggaaatgctagtgcattctgcaagcttactcttggaaataatccacctaggctgacaaagattgtgtcaactggtgcggcacctgaatgggatgaagcctttgcatgggcatttgacagccctccgaaaggacagaagcttcatatctcttgcaagaacaacagcaaattcggaaagaaatcattcggtaaggtgacaatccaaatcgaccgtgttgttatgctggggtcagttgccggcgagtatacgttgctaccggagagcaaaagtggtccaaataggaacctggaaatcgaattccagtggtcaaacaaatgacagtattctacagaattaggggtgccctgtgtaagttaaatatataaaaagtcgggagtggtttctttgttttcagcctctgctaaaatgttaccctgtttgtgcatcagtgtaaatagcctgcagagaaagtcgccattttgttgtacctttctgtgagataaaaacagatgagatcagatttttttttactgattgcagcgaaccgattcattattgtttttgttttttccacgggagattttttcctttgtaatctttgtaaagggtataaacagaataaatatatgttgtgctttaggttttgcctc

SEQ ID NO: 1479 - DNA, 5603 bp, Zea mays
gtacgtatttgcaggaaccgagttaatgtggaggacgaggagacactttcaagcgttgctcaatgtattgagcaactacgacagagttcttcatcctcacaggagaaagagagctctttgaagcagttattagatcttgttcaaactcgtgatactgcattcggagctgttgggtcacattcacaggctgttccgatacttgtatctctccttaggtctggaccatctggagttaagatgctggctgccactgttcttgggtctctttgcaaggaagaggagttaagggtgaaagtcttacttggtggttgcatacctccattgcttgctcttctcagatcgaagtcagctgaaagccaaactgcagctgccaaaaccatatatgcagtttcacagggtgggataagggatcatgttggatcaaagattttctctacggaaaatgttgttcctgtactgtgggagcaacttaaaattagtctcaagaatgagagtttggtggatggccttctaactggagcactgaagaatttatcaaagaatacagaggggttttggtcagcaactgtgcaatgtggtggagttgatatacttataaagctggttagttctggacaaacaaatactcttgcaaacacttgctatcttcttgggtctttgatgatggaagactcttctgtttgttctaaagttttatctggagaaacaacaaagcagctcttaaagttacttggtcctggcaatgagacttctattagagctgaggctgctggggctctcaagttcctttctgcacagagtaaagaggccagacgtcagatagctaattctaacggtattccttctcttataaatgctactattgctccatcaaaagagttcatgcaaggtgaatctgctcaagcattgcaagagaatgcaatgtgtgcattagcaaatatatctggtggtctttcctacgtaatctcaagccttggtgagagtctcgagtcatgttcttcacctgcacagattgcagatactcttggtgcattggcctcagccttgatgatatatgacacaaatgcggaatctatcagtgcttctaatcctgttgacattgagaagacacttttgaagcagtttaagcctaaggttccttttcttgtgcaggagcgcataattgaagctttggctagcttgtatggtaacccggttctctgcaagacactagcagattctgatgcaaaacgcttacttgttggtttaataaccatggcagctactgaggtacaagatgacctcacgaaatcactttttgctctctgcaagaaggattgtgatctatggcaagctctgcaaggccgtgaaggtgtccagctattgatttctttacttggtctttcatcagaacagcagcaggagtgtgctgttgctctacttgcgcttctttcaaaggagaatgatgagagcaaatgggctatcactgctgctggtggcatacctccacttgtgcaaattttggaaactggatcttccaaagctaaagaagattcagcaaccatccttggcaatttatgcaatcacagtgaagacataagagcatgtgttcaaagtgctgatgctgttcctgctttactatggcttctgaaaaatggaagtgataatggcaaggagatagcttctaaaacactgaatcatctcatccacaaatcagatactggaactatcagtcagttatctgctcttttaactagtgatcagcctgagtcaaaagtttatgttctggatgctttgaaaagcttgctttctgttgcaccacttaatgatattctacatgagggaagtgcagcgaatgatgcggttgagacaatgattaaaattctaagctcacccaaggaagagactcaggctacatcagcaactgctcttgctggtctatttcattgccgcaaggacctgcgagaaactcatattgcagtgaagacactttggtcagtcatgaagctgcttgatatgcagtctaacaaaatactaacgggggcctcatgttgccttgctgccgtttttctttcgatcaaggaaaataaagaggttgctgcaattggccgggatgccttaaacccacttgtctcacttgcaaattcttcagttatagaagtggcagaacaagcgactagagctttggcaaatcttttccttgatcaggaattgtccctccaggtgccttttgaagaaattctcttccgtgtaacacgtgtactaagagagggaactattgatggaagaactcatgcagccgcagcaatagctcgtcttttacagtgccgaactattaatcagccactttcagatactgttaaccgctctgggtctgtccttgctctagctgggctcttggaagctgcaaatggtgaagctgctgcaacatcagaagttcttgatgcactggtgctgttgtcgcgatcaaaggcgtcaagtgggcacaccaaggctccctgggcaattcttgcagaaaacccccacacaatacttccccttgtttcatgtattgctgatgctgctgcctccttacaagataaagctatagaagttgtgtcaaggctctgttccgacctacatgatgttgtcggtggtctggtttctgaaactccaggttgcatgtcatccatcacacggcgcatcattggctccaacattcttaaagttaaagttggtggttgtgctcttctcgtctgtgctgcaaaagagtattgtcagaagcaaatagaggttctgaatgatgcaagtctgtatattcaactaattcattctttaattggtatgatccatatggcaaacacgcaagctgaaaatgtcagcagtgaaagcatatcagatattagaatttccagacactccaaagaaaacaacagtgatggtgaaactctgtgctgtactgctgtcatctcaggcaacatgattccactatggctacttgctatcttttctcgtcatgacagcaaaacaagagcagaactcctggaaatgggagcagttgaaatgctcatcgagaagatttcacaaaatgcattccaatatgtgggtgaagaagataacacctcatgggtctgttccttgcttctcactttgctattccaagaaagagagacaattcgatcaaactcagcattgcattccattcctgtgctctcaaacttgttaaggtcagatgagccagcatacaggtactttgcggcacaagctttgtcaagtctggtctgcaatggtagcagaggaactcttctggctgttgcgaattctggggcagccattggacttatatctttgcttggatgtgctgatgttgatatagctgatcttttggaattatcagaggaattcatgttggtgcctaaccctgatcaaattgcattagagaggctattcagagttgatgatatcagggttggtgcaacttctagaaaatctattcctcttcttgttgatctacttaaacccattcctgaaagacctggtgctcctttcttggccttgggtcttctgacccagttagccgttgattgccccccaaacatgctgctaatggctgaagctggaatcctagaagcacttaccaaatacttatctcttagtccacaagatgcaacagaagaagctacaactgaattgctgggcattcttttcagtagtccagaaataaggcaccatgaatcagcacttggtgttgttaaccaacttgtggcagtccttcgtctaggaggaaggaattcacgttatagtgccgcgaaggcattagagagtttattttgtgctgaccatgtgaggaacagtgagtcaactaggcaggctatccaaccgcttgtggagattctgagtactggcatggagagggagcagcatgcagctatatcagcccttgttaggcttctttctgacaatccttcaagagcacttgcggttgcggatgttgagatgaatgctgtggatgttatgtgccggattctttcttctgattgttcagtggagttgaaaggaaatgctgcggaactatgctgtgttctatttaccaacacaaggatccgttccacaatggcagcagctcgttgtgtggaacccctggttggtttactggttagtgaagctaaccctgcccagctttctgtggttcgtgcattggataggcttctagatgatgagcaactagcagaattagtggcagcaaatggagctgtcattcctcttgtggggcttttgtatggcaaaaactacatgcttcatgaggcagttgctagagctttggtgaaacttggaaaggacagaccagcttgcaaattggaaatggtcaaggctggtgtaattgagagcattcttgatattctccatgacgctccagattttctttgcattgcattggcagaaatgcttcggattttgacaaacaatgctaccatagcaaaaggtccatcctcagccaaagtagtacaacctcttttctctttgctttccaaggcggacatgggtcctgaagggcagtatagcacattgcaggttcttgtgaatattttggagcatcctgaatgccgtgctgattataacttgacacctcgccaaactattgagccagtgataaccttactgaattcatctccaccagctgtacagcaattagctgcagaactcctatcacatcttcttctagaagaccacctccaaaaggacacagtaacagagcaggcgattactcctcttattcaagttctttcttcaggtttgccaaatttacagcagagagctataaaagctctagctaaccttgcaatagcttggccaaatacgattgccaaggagggtggtgtttttgagttgtctaaagtgttgttgcaatctgacccgcctttgccgcatgttgtgtgggaatctgcagcatctgtattgtctagcattctacagtacagtactgagtttttccttgaggtacctgttgcagtactagtgcaattgctcaggtcaggaactgaaagcactgttgtcggtgctttgaatgcccttcttgtattggagagtgatgactcaacaagtgcagaagcaatggctgaaagtggtgctgtggaagcattgcttgatctcctgaggagtcatcagtgtgaggaaactgctgccagactaattgaggcattgctgaacaatgtaagaataagggaggcaaaggctgctaaaaatgctattgcaccattgtccatgtaccttctggatccacagacacaatctcaacagggaagattgcttgctgctcttgctcttggtgatcttttccaaaacgaaggtcttgctcgttctactgatgctgttgcagcatgccgcgctctagtcaatcttcttgaagatcaaccaactgaagagatgaaagtggtagcaatatgtgccttgcagaatctagtcatgtacagccgagcaaataagagagcagttgcagaatccggtggtgtccaggtcctgctggatcttatcagttcaagcaatcctgacacttctgttcaggcagcaatgtttgtcaaacttctattcaataatcacactatccaggaatatgcgaccagtgaaacagtcagagttataactgg

SEQ ID NO: 1480 - DNA, 6118 bp, Sorghum bicolor
aattagcgaaattcgcctcttgctccgggggtttcccatttcctatcgaaaataagcggaaggaagcgcgtccagcttctcatccgttccgggaagcagatccaaaccgggccaaatcgcctgggaaaaatccggagagtaacagtctgtgtatgggcgccgccctccccgctggatctgcgcccactccccggagcggcggcgattccatgagaggttgagaactctcggcactgacgaagtggatactctgatctgctctgctctgctcgacgagtttagcatctgagtatggcggcggcactggcgtggcggttcaatggaaccaatggcggcgcccatggcagcggagatctggaaaggcatgtggacaaagttcaagactcagagccaccgactcctatgtcagtcatgaaaatgggcaagaaccgagttaatgtggaggatgaggagacactttcaagcgttgctcagtgtattgagcagctacggcagagttcttcatcatcacaggagaaagagagctctttgaagcagttattagatcttgttcaaactcgtgatactgcattcggagctgttggatcgcattcacaggctgttccaatacttgtatctctccttaggtctggaccatctggagttaagatgctggctgccactgttcttgggtctctttgcaaggaagaggagttaagggtgaaagtcttacttggtggttgcatccctccattgcttgctcttctcagatcgaagtcagctgaaagccaaactgcagctgccaaaaccatctatgcagtttcacaaggtgggataagggatcatgttggatcaaagattttctctacggaaaatgttgttcctgtactgtgggagcagcttaaaattagtctcaagaatgagagtttggtggatggccttctaactggagcactgaagaatttatcaaagaatacagaggggttttggtcagcaactgtgcaatgtggtggagttgatatacttataaagctggttagttctggacaaacaaatacccttgcaaatgcttgctatcttcttgggtctttgatgatggaagactcttctgtttgttctaaagttttatctggagaaacaacaaagcagctcttaaagttacttggtcctggcaatgaaacttctattagagctgaggctgctggggctctcaagttcctttctgcacagagtaaagaggccagacgtcagatagctaattctaatggtattcctgctcttataaatgctactattgctccatcaaaagagttcatgcaaggtgaatctgctcaagcattgcaagagaatgcaatgtgtgcattagcaaatatatctggtggtttgtcctatgtaatctcaagccttggtgagagtctcgagtcatgttcttcacctgcacaaattgcagatactcttggtgccttggcctcagccttgatgatatatgacacaaatgcggaatctaccagtgcttctgatcctgttgacattgagaagacactgttgaagcagtttaagcctaaggttcccttccttgtgcaagagcgcataattgaagctttggctagcttgtatggtaaccctgttctctgcaagacactagcagattctgatgcaaaacgcttgcttgttggtttaataaccatggcagctactgaggtgcaagaggacctcacaaaatcactttttgctctctgcaagaaggattgtgacctatggcaagctctgcaaggccgtgaaggtgtccagctattgatttctttacttggtctttcgtcagaacagcagcaggaatgtgctgttgctctgcttgcgctcctttcaaaggagaacgatgagagcaaatgggctatcactgctgctggtggcatacctccacttgttcaaattttggaaactggatctcccaaagctaaagaagattcagcaaccatccttggcaatttatgcaatcacagtgaagacataagagcatgtgttgaaagtgctgatgctgttcctgctttactatggcttctgaaaaatggaagtgataatggcaaggagatagcttctaaaacactgaatcatctcatccacaaatcagatacagggactattagtcagttatctgctctcttaacaagtgaacaacctgagtcaaaagtttatgttctggatgctttgaaaagcttgctttctgttgcaccagttaatgatattctacatgagggaagtgcagcaaatgatgcggttgagacaatgattaaaattctaagctcacccaaggaagagactcaggctacatcagcaactgctcttgctggtctatttcattgccgcaaggacctgcgagaaactcatattgcagtgaagacactttggtcggtcatgaagctgcttgatatgcagtctaacaaaatactaatgggggcctcatgttgccttgctgctgtttttctttcaattaagcaaaataaggaggttgctgcaattggccgtgatgccttaaccccacttgtctcacttgcaaattcttcagttattgaagtggcagaacaagcaactagagctttggcaaatcttttccttgatcaggaattatccctccaggtgtcttttgaagaaattctcttccgtgtaacacgtgtgctaagagaaggaactattgatggaagaactcatgcagccgcagcaatagctcgtcttttacagtgccgaactattaatcagccactttcagatactattaaccgctctgggtctgtccttgctctagctgggctcttggaagctgccaatggtgaagctgctgcaacatcagaagttcttgatgctttggtgctgttatcgcgatcaaaggcgtcaagtgggcacaccaaggctccctgggcagttcttgcagaaaacccccacacgatacttccccttgtttcatgtattgctgatgctgcagcttccttacaagataaagccatagaagttgtgtcaaggctctgttctgaccaacatgatgttgttggtggtctggtttctgaaactccaggttgcatatcatccatcacacggcgcatcattggctccaacatgcttaaagttaaggttggtggatgtgctcttctcgtctgtgctgctaaagagaattgccagaagcaaatagaggttctgaatgatgcaagtctgtatattcaactaattcattctttaattggtatgatccatatggcaaacatgcctgctgaaaatgtcagcagtgaaagcatatcagatattagaatttccagacactccaaagaaaacaacagtgatggtgaaactgtgtgccgtactgctgtaatctcaggcaacatgattccactatggctacttgctgtcttttctcgtcatgacagcaaaacaagagcagaactcctagaagcgggagcagttgaaatgctcaccgagaagatttcacaaaatgcattccaatatgtgggtgaagaagatagcacctcatgggtctgttccttgcttcttgctttgctattccaagaaagagagataattcgatcaaactcagcattgcattccattcctgtgctctcaaacttgttaaggtcagatgagccagcatacaggtactttgctgcacaagctttgtcaagtctggtctgcaatggtagcagaggaactcttctggctgttgctaattctggtgcagccattggacttatatctttgcttggatgtgctgatgtggatatagctgatcttttggaattatcagaggaattcatgttggtgcctaaccctgatcaaattgcattagagaggctattcagagttgatgatatcagggttggtgcaacttctagaaaatctattcctcttcttgttgatctacttaaacccattcctgagagacctggtgctcctttcttggccttgggtcttctgacccagttagctgtagattgccccccaaacatgcagctaatggctgaagctggaatcctagaagcacttaccaaatacttatctcttagcccacaagatgcaacagaagaagctacaactgaattgctgggcattcttttcagtagtccagaaataaggcaccatgaatcagcacttggtgttgttaaccaacttgtggcagtcctacgtctaggaggaaggaattcacgttacagtgctgcaaaggcattagagagtttgttttttgctgaccatgtgaggaacagtgagtcagctaggcaagctattcaaccgcttgtggagattctgagtactggcatggagagggagcagcatgcagctatatcagcccttgttaggctgctttctgacaatccttcaagagcacttgcggttgcggatgttgagatgaatgctgtagatgttatgtgccggattctttcttctgactgttcagtggagttgaaaggagatgctgcagaactatgctgtgttctatttaccaatacaaggatccgttccacaatggcggcagctcgttgtgtggaacccctggttggtttactggttagtgaagctaaccctgcccagctttctgtggttcgtgcattggataggcttctagatgatgagcaactggcagaattagtggcagcacatggggctgttattcctcttgtcgggcttttgtatggcaaaaactacatgcttcatgaggcagttgctagagctttggtgaaacttggaaaggacagaccagcttgcaaattggaaatggtcaaggctggtgtaattgagagcattcttgatattctccatgacgctccagattttctttgcattgcattgtcagaaatgcttcgaatattgacaaacaatgctaccatagcaaaaggtccatctgcagccaaagtagtacaacctcttttctctttgctttctaaggcggacatgggtcctgaagggcagtatagcacattgcaggttcttgtgaatattttggagcatcctgaatgccgtgctgattataacttgacaccacgccaaactattgagccagtgataaccttactgaattcatctccaccagctgtgcagcaattagcagcagaactcctatcacatcttcttctagaagaccacctccaaaaggatacaacaacagagcaggcgattactcctcttattcaagttctttcttcaggtttgccaaatttacagcagagagctataaaagctcttgctaaccttgcaatagcttggccaaatacaattgcaaaggagggtggtgtttttgagttgtccaaagtgttgttgcaatctgacccgcctttgcctcatgttgtgtgggaatctgcagcatctgtattgtctagcattctacagtacagtacagagtttttccttgaggtacctgttgcagtactagtgcaattgctcaggtcaggaactgaaagcactgttgtcggtgctttgaatgcccttcttgtattggagagtgatgactcaacaagtgcagaagcaatggctgaaagtggtgctgtggaagcattgcttgatctcttgaggagtcatcagtgtgaggaaactgctgccagactaatcgaggcattgctgaacaatgtaagaataagggaggcaaaggctgctaaaaatgctattgcaccattgtccatgtaccttctggatccacagacacaatctcaacagggaagattgcttgctgctcttgctcttggagatcttttccaaaatgaaggtctggctcgttctactgatgctgttgcagcatgccgtgctctagtcaatcttcttgaagaccaaccaactgaagagatgaaagtggtagcaatttgtgccttacagaatctagtcatgtacagccgagcaaataagagagcagttgcagaatccggtggtgtccaggtcctgctggatcttatcagttcaagcaatcctgacacttctgttcaggcagcaatgtttgtcaaacttctgttcaataatcacactatccaggagtatgcgaccagtgaaacagtcagagttataactgcttctattgaaaaggatatatgggcttctggaagtgctaatgaagagtatctcaaagcacttaatgctttgcttagtaacttccctcgtctgagggtcactgaac

SEQ ID NO: 1481 - DNA, 2414 bp, Brachypodium distachyon
gctgggccccgcccgccgcgccgtttgctggagatcgtcatgatgtcgaggtcagctccgcggctcacaatctctcccgtgcttgtttgcgtgtagttttgatgcaattcgctcaatgctcaagtttcaatggctttattgttgctcccaggtttatgcacatcgggaagagcagcaggaagcttgctcatgctgcattggccaactcgaaacccagagtttccggtacgcagaacatcgggccgagctatgcttccggcttggcctatagaagcagggcgtttttgcacgggacggttcacaatggaccgagcacttcctttgttcttggacgagcaaaggagagcttgtactggagccctggtgccagaaacttatcggttctctcgtcctgtagccgtaatgccttccacagccaactggcctggaagcaactcacggctatgggttctcgtgcaccaagagcatctccgcttttaagtagagctgcttgtgccattaccttggctgccacgagatctaaggtagttccttaccttgtcgctttcatagctggggagataatgctagctgagaagactagtgcagaaggtgaatacctcccaattcgtgataatatttacatgcgggctcaggatagccgtatttacgtcacctcgttaatattctcggcagtagagatggttatcataatcttcagatccatatatctggcgatgctgttcactcccagtgtactgatggcgccatttgctgataatcttggcagtaagtataggaaaacatggctccgtcttgtgcatcgtactttggagaaggcaggtcctgcatttattaaatggggccagtgggctgctacacgtcctgatctatttgcaaatgatctttgtaccgaattgtcaaagctacacacgaaagctcctgctcacagctttgcctataccaagaaaactgtcgagaaggcctttggtcgaaaactatcagatatttttgagaattttgaagaagagcctgtagcgtctggaagtgttgctcaagttcaccgagcttctctgagattccggcatcctggcaagaagacaaagcgtgaaacagttgcagtaaaagtaagacatcctggtgtaggagattcaatacggagagatttcagtatcattaatacagtagccaaaatttcaagatatattccagcgttaaattggttgcgtttagatgagagtgtgcaacagtttgctgtcttcatgatgtctcaagttgaccttgcaagggaagctgctcatttgagccggtttatctacaacttccgtatgtggaaagatgtgtctttccctacccctctgtacccgcttgttcatcctgctgttttggtggagagttacgagcatggggagagtgtctcacactatgttgacgaccatgacgggcatgagcggattaaaagtgctcttgcacatattggcactcatgcacttttgaaaatgctactggttgataatttcgtccatgcagatatgcaccctggaaatattctggtccgtgttgtacaaccaaagaattcgaacaacacccttttgaagtcaaggccacatgtagtgttcctcgatgtaggaatgactgctgaactttcaagtaatgaccgtgtgaatttactggagttcttcaaggctgttgcacgtcgtgatggtcgtacagcagcagagagcacactgaagttgtcaaaacaacagaattgcccaaatccaaaagtatttatcgaggaagttgagcgagcattttccttctggggtacccctgaaggtgatgtgatccaccctgctgattgtatgcaccagttgcttgagcaagtccgacgtcataaagtaaatatcgatgggaacgtttgcactgttatggttactacattagttcttgagggctggcagcgaaagttggatccagattacaatgtcatgaaaacactacaaactttactttttaaggaggactgggccaagtctcttcagtatacaatcgaagggcttatggcaccttaggagtgtattgggatcttctcaattttgctgatctggtttaggtgcgtgtttatttagttttagagttacagttttctgcctacagttttgtactcatcttggcctgtgctgcgaaaacggccacgctaaagtaataattgcagcattcttttgagcagcaggagaaccagccctgggactatatgcttgtcaaggccaaaggacgggtccttttgagcgcctcccacattttttgtcaatagatattagaagatgtagcgaaaggccctcatccctgatgctctttttgtaacctgagattgtgtcagcgagtgagagttctttctttgtatacacagagataacagttaattgtttcaaagaaaacctacgccttctcct

SEQ ID NO: 1482 - DNA, 2819 bp, Zea mays
acctcaagtcctcaaggcaggcgcatagttctgtttcaacctcacagcgtcgtgacgtcgtcctctgcttcgcaagcgcccgagccgcgcgccgccgaacccgccgcctcctccagcctccgggcacatcggagcacgccagccaatcgcaccccgacacggcggcaccggaggaacccctccttcttggtcgtagcctccgtggcctccctcccctcaccccttccggtgttggattgagggtggagcggagatccgccacggcttgattgatccctggatcgatacaccatataatttgggattctaaggtcccggtgcagcttcttctcgcagaagtttaccctctatgcccctctctaagcccacccctgtgattccgccgtgacgcgtcatccacgggagaaacgccatgatgtcaaggtttgcccacttggggaagagcagaaaacttgctgaaacccttttggttgcctcaaagcccaatactgctggtggccaaaacattgcttcaagctttgcattcggcttgggttattccagcagggcctttttgcacgggaaggttcataatggtccaaacacctcctacatgctgggaagagcaaatgatagcttacattggagcactggtgtgaggaaattctcaattctttcatcttgtagccagaatgcatttcagagtcagcttgcttggaagcgacttgtagcactgggttctcgtgcaccaaaagcatctccaatttttagtaaggttgcttgtgccattggcttggctgtgagtaggtctaatatagccccttaccttgtcgcttttattgcgggagaggtaatgctagctcagaagacatctgcagatggagaatactacccaatacgtgagagagctcaggatggccgtatttacgttacctctctaatatattcggcagtagaattggttattataatcttcagatcaatatatttggcattgctgttcactccaagtatactgatggccccatttgcagagactcttggcagtaagtataggaaaacatggcttcgacttgtccatcgtactttggagcttgcaggtcctgcgtttatcaaatggggccaatgggctgcaacacgccctgatctgtttccaagtgacctttgtactgaattgtcaaagctgcacacaaaagcaccagctcacagctttacctatactaagaaaactgttgagaaagcttttggtcgaaagctatcagacatttttgaaaattttgaagaggaccctgttgcatctggaagtgttgctcaagtgcatcgggctgttctacgattccggtatcctaatcggcagacaaagcgtgtaactgttgcagtaaaagtaaggcatcctggtgtaggggactcgataagaagagatttcaatatcatcaatgccgtagcaaaaatatctagatatatccccacgctgaattggttgcgcctagatgagagtgtacaacagtttgctgtcttcatgatgtctcaagttgaccttgcaagggaagctgctcatctgagccggtttatctacaacttccgaaggtggaaggatgtatctttcccaagacctctctatccacttgttcatcctgctgttttagttgagacttacgagcatggggagagtgtttcacactatgttgatgaccttgaaggacatgatcgaattaaaagtgctctggcccatattggtactcacgcgctcctgaaaatgctactggttgataatttcgtccatgcagatatgcacccaggaaatattttagtccgtgttgcacaaccaaagaactcaaataacacccttaaaaagtcaaggccacatgtagtcttcctggatgtaggaatgactgctgaactttcaagtaatgaccgtgtgaatttacttgagttcttcaaggctgttgctcgccgagatggtcgtacagctgcagaaagtactctaaagttgtcaaaacaacagaattgtccaaatccaaaagcttttattgaggaagttgaacgatcattctctttttggggcactgctgaaggtgatgctatccacccagctgagtgtatgcaccaactgcttgagcaagttcgatgtcataaagtgaatatcgatggcaatgtttgtactgtcatggtgactacattagttcttgagggctggcaacgtaagttggatccagattataatgttatgaagactctgcaaactttactttttaaggaagattgggcgaagtctcttcaatacactatccaagggctcatggcgccttagggtcgtccgcaatcctttctaaagttttgatctggtttgtgttcgactggaggatcctcttctctcaccatcacgtctggcttcttttctacgttatttcacgtttcgtttctctgtacctgtcctggcgttgtgctgctaaagcagccttgatgataaagtaataactgcagtaaaaattttcagaagctaccagagtactatgctgctcagctctgggctgtcttcttatatgttcttgatgaagggccaaagaattaggtccttttcccccccctcctaccaacacttttgacaatagctcttagatgatgtagcaaaaggcgttctgttctgatgatcttttttgtaactggagagattgtatccgtggactggagagttgcttatgtacagacagagatactgttaatctcgaaggaatccacttgtcaactgacaattattcccaggaaaaggctcccagttttttcttgttttacatgtattagcaatgctgaatgtctgaaatttgaatgattttgctggt

SEQ ID NO: 1483 - DNA, 2847 bp, Sorghum bicolor
caagccaggcgcatagctctgtttcaacctcacagcgtcgtcctctgcttcgcaagcgcccgagccgcgcgccgccgcctcccccagcctccgggcacaccggagcacgccagccagtcacaccccgacacagcggcaccggaggaacccctccttcttggtggtagccgccgtggcctccctcccctcatccttccggtgttggattgagggtggagcggagatccgccacggcttggattgatctctggttgtcgacgccatagagaacttgggattctaaggtgctggtgcagcttcttctcgcaggagtttaacctccatgcccctcgctaagcccacccctgtgatcccgccgtgacgcatcatcctcaggagaaacgccatgatgtcaaggtttgcccacttagggaagagcagaaaaattgctcaagcccttttggtctcctcaaaacccaacactgcttctggccaaaacattacctcaagctttgcattcggtttgggttattccagcagggcctttttgcatgggagggtttataatggtccaagcacctcctacatgctgggaagagcaaatgagagcttacactggagcactggtgtgaggaagttctcaattctttcatcctgtagccagaatgcatttcagagtcaacttgcttggaagcgacttgtggccatgggttctcgtgcaccaaaagcatctccatttttgagtagggttgcttgtgccattggcttggctgtgagtaggtctaatgtagctccttacctcgtcgctttcattgcgggagaggtaatgctagctcagaagacatctgcagatggcgaatactacccaatacgtgagcgagctcaggatggccgtatttatgttacctctctaatatattcggcagtagagctggttattataatcttcagatcaatatatttggcattgctgttcactccgagtatactgatggccccatttgcagagactcttggcagtaagtataggaaaacatggcttcggcttgtccatcgtactttggagcttgcaggtcctgcgtttatcaaatggggccaatgggctgcaacacgccctgatctgtttccaagtgacctttgtactgaattgtcaaagctgcacacaaaagcaccagctcacagctttaagtataccaagaaaactgttgagaaagcttttggtcgtaagctatcagacatttttgagaattttgaagagaaccctgttgcatctggaagtgttgctcaagtgcatcgggctgttttacgattccggtatcctaatcagcagacaaagcgtgtaacagttgcagtaaaagtaagacatcctggtgtaggagactcgataagaagggatttcaatatcatcaatgccgtagcaaaaatttctagatacatccccacgctgaattggttgcgcttagatgagagtgtacaacagtttgctgtcttcatgatgtctcaagttgaccttgcacgggaagctgctcacctgagccggtttatctacaacttccgaaggtggaaggatgtatctttcccaagacctctttatccacttgttcatcctgctgttttggtcgagacttacgagcatggggagagtgtttcacactatgttgatgaccttgaggggcatgatcgaattaaaagtgctctggcccatattggcactcatgcgctcttgaaaatgctactggttgataatttcgtccatgcagatatgcacccaggaaatattttagtccgtgttgtacaaccaaagaactcaaataacacccttataaagtcaaggccacatgtagtcttcctggatgtaggaatgactgctgaactttcaagtaatgaccgtgtgaatttactcgagttcttcaaggctgttgctcgccgagatggtcgtacagctgcagaaagtactctaaagttgtcaaaacaacagaattgcccaaatccaagtgcttttattgaggaagtggaacgatcattctctttttggggcactgctgaaggtgatgttgtccacccagctgagtgtatgcaccagctgcttgagcaagttcgacgtcacaaagtgaatatcgatggcaatgtttgtactgtcatggtgactacattagttcttgagggctggcaacgcaagttggacccagattataatgttatgaagacactacaaaccttacttttcaaggaagactgggcaaagtctcttcaatacacgatccaagggctcatggcgccttagggtctgtgctgcaatcctctcaaaagttttgatctggtttgtgttcggctggaggatcctctgctctcaccatcacgtttcttttcttctctactttatttgctcttagattatacagttctttgtactcgtcctggccttgtgctgctaaagcagccttgatgataaagtaataataacagcaaattttcagaagctaccagagtactatgctgtagagtgcattgcttctcatatgttctcgatgggccaaaggattaggtcctttttccccctcccaacacttttgacaatagctcttagatgatgtagcaaaaggtgttttgttctgatgatctttttttgtaactggagagattgtataagtgaacaagagagttgcttatgtacacacagatacttgaagaaacctacttctcaactgacaattcccaggattaacgtccataaagaggctcccaatttttcttgttttacatgtattagcatcgcagaatgcctgaagtttgaatgagtttgctggtagggaactatattggatttcgtttacagtcattttctaatttgagttgacattttatcct

SEQ ID NO: 1484 - DNA, 3309 bp, Brachypodium distachyon
atgcatcctctcttgctggttctcgtccacctcgtcttcttggcggaggccaaaggcgccggccgcggcgcgggctcggtggcggcgctgaacgatgacgtgctggggctgattgtgttcaaggccgacgtggtggacccggaggggcgcctcgcgacgtggagcgaggacgatgagcgggcctgcgcatgggccggcgtcacctgcgacccgcgcaccagccgcgtctccgggctctccctcgacggcttcggcctctccggcaagctcggcaggggcctcctccgcctcgagtcgctccagtcgctctccctctcccgcaacaacttctccggcgacctccctgccgacctcgcccgcctcccggacctccagtcgctggacctcagctccaacgccttctcgggcgccgttcctgacggattcttcggcaagtgccactccctccgcgacgtctccctcgccaacaacgccttctccggtggcatccctgatgtcggcggatgcgccacgctcgcctctctgaacatgtcgtccaatcgccttgcggggacgctacctggcggcatttggtccctgaacgcccttcgaactctggacctctctggcaatgccatcactggtgacttgcctgtaggcatcagcaagatgttcaatctgcgggcactgaacttgcgtagcaaccgcctcacgggcagcctcccggatgacattggggactgcccgctgcttaggtcagtgaacctcaggtccaattcgctgtcgggcaacttaccggagtccctgcgaaggctctccagttgcacagaccttgacttgagctcaaatgagctcaccgggactgttccaacctggattggagaaatggcgagcttggagatgctagatttgtcggggaacaagttctccggggagattccggaatctattggcggactcatgtcattgagggagttgaggttgtctggaaatgggttcactggtggcttgcctgagtcaattgggcgatgcagaagcctagtgcatgtcgacgtgagctggaattccctgactggcagcctgcctgcctggatcttttcatccggcgtgcaatgggtgtcggtctcggataacactttgagtggtgaggtactggttcctgtgaatgcttcctctgtgattcaaggtgtggacctgtcaagcaacgcattctcaggaccaatcccatcggagatctcacaactgctgacgttacagtcgttgaacatttcttggaactcactgtctgggagtattccagccagtatcatggagatgaaatcactggagttgcttgatttgagtgctaataggctcaatgggaggattccagctaccattggaggaaagtcgttgaaagtgttgaggctggggaagaactcccttgctggagaaattccagtccagattggcgattgctctgcccttgcttcactggatctatcacataatggtctaacaggagctattccagcaaccatagccaatctcaccaatcttcagacagctgatctttctcggaataagctcaccggtggtctgccaaagcagctctccaaccttgcccacctcattcgcttcaatgtttcacataaccagctctctggggatctccctcctggtagcttttttgatactatccccttctcatcagtgtctgacaatcctggcctttgcggttcaaagctcaactcttcttgtcctggtgtgctaccaaaaccaattgtactgaatccagactcttcctccaatccgctagcacagacggaacctgtgctagaggggctccgtcacaagaaaaccatactgagcatctcagcccttgttgcaattggtgctgctgttctcattgctgttggcatcataaccattactgttcttaaccttcgagttcgttcaccggcttctcattctgcccctgtactagaactctcagatggatatctcagtcagtctcccacaactgatgtgaacgcaggcaagcttgtaatgtttggaggaggcaattcagaattcagtgcaagtacccatgctctcctgaacaaggactgtgagcttggccgtggtggttttggcactgtatacaagacaactctccgagatggccaacctgttgccataaagaaactgactgtgtcaagcttggttaaatctcaagatgaattcgagagggaagtgaagatgttgggcaagctacgccaccacaaccttgttgcactcaagggctattattggacaccatcgcttcagcttcttatctatgagtttgtctctgggggcaacttacataaactactgcatgagttgtccactgtaagttgcctttcatggaaggaaagatttgatatagttcttggtatagcaagaagcctggctcacctccaccggcatgacattatccactacaatctgaagtcaagcaacattatgctcaatggatctggtgaggccaaggtgggggactacggattagcaaagctactgcctatgttggatcggtatgttctaagcagtaaggtacagagtgcacttggttacatggcaccagaatttacatgcaggactgtaaagataactgataaatgtgatgtttatggatttggagttcttgtccttgaggtcatgactgggaagacaccagtggagtacatggaagatgatgttattgttctgtgtgatgtggtgagagctgctttagatgaaggaaaagtggaagaatgtgttgatgagaggctttgcgggaaatttccgctggaggaagctgttcctatcatgaaacttggcttagtctgtacttctcaggttccttccaataggccagacatgagtgaggtggtgaatatattggagttgatcagatgccctccggacagcccagaaactgaattaggttaagctctatctgctttggtcttctttttggtggatcttgtctcattttggagtccttggcttggtaaccgattaaatgatgaaagtggaaggacattctatctagtttactttaggtcgtaggagcaagccaaagtgtgaagtgccaaggtagtcatttgatagtcaaggaattatgccatgcatgcaatggtttcatggcctatatctgttgatgtgtttgactttgatcctcatcagtatgatgtctgttgtggatcctctcacatcaattatataagcatgagatttctgtagaaaatattgatgctcgctcttactgttctggtggcttcactgcaagttgtctgtagtttcggtttcaattatgcatcgtgatcatgtaatgctacttgtgta

SEQ ID NO: 1485 - DNA, 3661 bp, Oryza sativa
ctcgctcgccgttacaaccttccacttcccactcccactccgcccactccctccttctcccctcccctctcccactgcaatggcgttctccggtaagccggcggcgacgtagacggccggcggcgtgcacgcggggaagaaggtgccgtttgaatcttggaggccaatcttctgaagattcaggcgaagctcgtcgtctcctgggcgcgttcttgcggcgtttcttggagcattttggctcgccgccggcggccttgcgcgttccggcttccgaggcaagaaggccatcctttttttttcttgctgctcgtgcgcgtttcggctctccggagtcgcggcaatgcgggctctggtggtgctggttggcttggcctgcctcgccttcgtggcggaggccaagggcggcggcgcggcctcggcggcggcgctggacgacgacgtgctggggctgatcgtgttcaaggccgacgtggtggacccggaggggcggctcgcgacgtggagcgaggacgacgagcggccgtgcgcttgggccggtgtcacctgcgacccgctcaccggccgcgtcgcggggctctccctcgccggcttcggcctctccggcaagctcggccgcggcctcctccgcctcgagtcgctccagtccctctcgctctccggcaacaacttctccggcgacctccccgccgacctcgcccgcctcccggacctccagtcgctggacctcagcgccaacgctttctcgggcgccatcccggacggcttcttcggccactgccgcaacctccgcgacgtctccctggccaacaacgccttctccggcgacgtcccgcgcgacgtcggcgcgtgcgccacgctcgcgtcgctgaacctgtcctccaaccgcctcgccggcgcgctgccgagcgatatctggtcactgaacgccctgcgcacgctggacctctccggcaacgccatcaccggcgacttgccggtcggcgttagcaggatgttcaacctgcggtcgctgaacctgcggagcaaccgcctcgcaggcagcctccccgacgacattggggattgcccgctgctgaggtcagtggacctcggctccaacaacatctctggcaacctgccggagtcgctgcggaggctctccacttgcacataccttgacctgagctcaaacgcgctcaccggcaatgttccaacttgggttggagaaatggcaagcttggagacgcttgatttgtccgggaacaagttttccggggagatcccggggtcgattggcgggttgatgtcattgaaggagctgaggctgtcggggaatgggttcaccggtggcttgccggagtcaattggtggatgcaagagcctagtgcatgttgatgtgagctggaattctctgaccggcaccctgccttcctgggtctttgcttccggcgtgcaatgggtatcggtgtcggacaacaccttgagtggagaggtgtttgtacctgtgaatgcatcttcgatggttcgaggcgtggatttgtcgagcaatgcgttttcaggaatgatcccatctgaaatctcccaggtgatcaccttgcagtcactgaacatgtcctggaactcgctgtctgggagtattccgccgagcattgtgcagatgaagtcacttgaggtgcttgatttgactgcgaacaggctcaatggaagcattccagctactgttggaggagagtcattgagagagttgaggctggcgaagaactcccttactggagaaatcccagcacagattggcaatctctctgcccttgcatcactggatctctcacacaacaacctgacaggcgcaattccggcaacaatagccaacatcaccaacctgcagactgttgatctttctcggaacaagctcactggtggtctaccaaagcagctctctgacctgcctcaccttgtacgcttcaatatttcacataatcagctctctggggatctccctcctgggagcttttttgacactatccccctctcatcagtgtctgacaatcctggcctttgtggtgcaaagctaaattcttcttgtcctggtgtgttaccaaagccaattgtgctgaacccagactcttcttcggatccactatcacaacccgagcctacaccaaatggcctacgtcacaagaaaactatactaagcatctcagcccttgtcgcaattggtgctgctgttctcattactgttggtgtcataaccattacagttctcaaccttcgagtgcgcactccaggctctcattctgctgctgagctagaactctctgatggatatctcagccagtcccccacaactgatgtgaattcaggcaagcttgtcatgtttggaggcggtaatccagaattcagtgctagtacccacgctctcctgaacaaggactgtgagcttggtcgtggtgggtttggcactgtctataagactactctgcgagatggccaacctgttgccatcaagaaactgactgtgtctagcttggttaaatctcaagatgagtttgagagagaagtgaagatgctaggcaagctacgccaccgcaaccttgttgcgctcaagggatattattggacaccatcacttcagcttcttatatatgagtttgtttctgggggtaacttacataaacaactgcatgaatcatccactgcaaattgtctctcatggaaagagaggtttgatatagttcttggcattgcaagaagcctggcccatctccaccgccatgacattatccactacaatctgaagtcaagcaacattctgcttgatggatcaggcgatgccaaggtgggggactacggattggcaaagcttctgccgatgttggatcggtatgttctaagcagtaaggtccagagtgcacttggttacatggcaccagagtttgcgtgcaggactgtgaagatcactgaaaagtgtgacgtgtatggatttggagttcttgcccttgagatattgacagggaggacaccggtgcagtacatggaagatgatgttattgtgctttgcgatgtggtaagggctgctttggatgaagggaaggtggaagagtgtgttgatgagaggctctgcggaaaatttccgctagaggaggctgttccaatcatgaaacttggtctagtgtgcacttctcaggttccttccaataggccagacatgagtgaggtggtgaacatactggagttgatcagatgcccccaggatagccctgaaactgaattaggttaagctctatctgatgtggttcccttttttgttagttttcttattccattttaagatccttctttgcttggcaactgataaaatgatgagacatgaaggggattctatctgttatgcttagtactaggagcaagtgtgaagtttctgggtagtattttggtagctaaggagttattatgtaatgcatgaaatagtttcatggcctgtggctgttgatgtgtttgactctgatcctcatcaggatgttaactgttgtggatcctctcacatcaattatatatgctgtttccaattcttgcttggtctatttgtatgtaaaaattgatatgccgttgcgctctcactcagttccttgttcctttttgtagtgtttttacctggatgaaacatagaacatctcagttaatc

SEQ ID NO: 1486 - DNA, 3614 bp, Sorghum bicolor
ctctcaccctccccctgccctgcattcttcaatggagttttcaggcgagtcggcggcggcggcggcggcaacgacgtagacgggcgcatcctggctcggcagttctccgcaggaaggaagaaggtacgccatttgaagctttgaggtccccacgcgcagatttgagcgaactccacccccggactctcggttcctcccgccgattcgtcttcctgcatcgaccccgagcatttatttgcgccgccgcctccctgtgcttcaccaataagtacgtcttcctgagcaatgcggccgctcgcgctgctggttctcgcccacctcgccgccctcgtggcggcggcggaggccaagggcggcgcggcgggggcggggctgggcgacgacgtgctggggctgatcgtgttcaaggccgacgtgtcggaccccgacggccgcctcgcgacgtggagcgaggacgacgagcggccctgcgcctggggcggcgtcacctgcgacgcgcgcacgggccgcgtctctgcgctctccctcgccggcttcggcctctcgggcaagctcggacggggcctcctccgcctcgaggcgctccagtcgctctcgctcgcccgcaacaacctctccggcgacgtccccgcggagctcgcccgcctcccggcgctccagacgctggacctcagcgccaacgccttcgccggtgccattccggaggggctcttcggccgctgccgctccctccgcgacgtctcgctcgccggcaacgccttctctggcggcatcccgcgggacgtcgccgcgtgcgccacgctggcgtcgctcaacctgtcctccaacctcctggccggcgcgctgcccagcgacatttggtccctcaacgcgctgcgcacgctggacatctccggcaatgccgtcaccggcgacctcccgatcggtatcagcaggatgttcaaccttcgggcgctcaacctgcgaggcaaccgtctcactggtagcctcccggacgacattggggactgcccgttgcttaggtcattggatcttgggtccaactcgctgtccggcgacttaccagagtccctgcggaggctctccacctgcacataccttgacctgagctcgaatgagttcactgggagtgtgccaacatggtttggagaaatgggaagcctggaaattctggatttgtcggggaacaagttctctggcgagattccagggtctattggcgggttgatgtcattgagggagctgaggttgtctgggaatgggttcaccggagccttgcctgaatcaatcgggggatgcaagagcctgatgcatgttgatgtcagctggaactctcttacgggtgccctgcctagctgggttctcggttctggtgtgcaatgggtgtcggtgtcgcagaacacgttgagcggggaggtaaaagtgcccgcaaatgcttcttcagtgcttcaaggagtggacttgtcgaacaatgccttctctggagttattccatcggaaatctccaagctgcagaatttgcactcgttgaacatgtcatggaactcaatgtctggaagtattccggccagcattttggagatgaagtcactggaggttcttgatttgactgccaaccgactaaatgggtgcattccagcttcaactggaggggagtcattgcaggagttgaggctggggaagaacttcctaactggaaacatcccagctcagattggcaattgctcttccctagcatcactggatctttcacataacaatttaacaggaggaattccggagacaatatctaaccttaccaatctcgagattgttgatctttctcagaacaagcttactggtgttctaccaaagcagctttctaacctcccccacctcctgcagttcaatgtttcacataaccagctctctggggatctccctcccggtagcttctttgatacaatccccttatcttctgtgtcggataatcctggcctttgtggcgcaaagctcaattcgtcttgtcctggtgtgctgccaaaaccaatcgtgctgaacccaaacacttcttctgatccaatatcaccaaccgagcctgtgcccgatggtggtcgccatcataagaaaaccatactgagcatctcagcccttgttgcaattggtgctgctgctctaattgctgttggtgtcattaccatcacggttcttaaccttcgagtgcgtgcccctggatctcattctggtgctgctctggaactctcagatggatatctcagccagtcaccaacaactgacatgaatgcaggcaagcttgtcatgtttggaggaggaaatccagagttcagtgccagtacccatgctcttctgaacaaggattgcgagcttgggcgtggtggttttggcactgtctacaagaccactcttcgagatggacaacctgttgccatcaagaagctcactgtgtcaagcttggttaaatctcaagttgaatttgagagagaagttaagatgctgggcaagctacgccatcgcaacctagttgcactaaagggttattactggacaccgtcgcttcagcttctcatttatgagtttgtctctgggggtaacttgcacaaacaattgcatgaatcatccaccacaaattgcctgtcctggaaggaaagatttgacatagtcctcggtatagcaagaagccttgctcatctccacaggcatgatattatccattacaatctgaaatcaagcaacattctgctcgatggatcaggtgaggcgaaggtaggagattatgggttagcaaagctgctcccgatgctggatcgttacgtcctaagtagcaaggtgcagagtgcgcttggatacatggccccggagtttgcatgcagaactgtgaagatcactgagaaatgcgatgtgtacgggtttggtgttcttattcttgagattctgactggtaggacacctgtggagtacatggaagatgatgtgattgtgctctgtgatgtagtgagggcggctttggatgaaggcaaggtggaagaatgtgttgatgagaggctctgcggcaaatttccactggaggaggctgttccgatcatgaaacttggtttggtatgtacttctcaggttccgtcaaacaggccggacatgaatgaggtggtgaacatactggagctgatcagatgcccccaggatagcccggagactgaattgggttaacctctacctacattgagtacctgttggttttacttttgagatccttctttgcttggtaactgaccaaacaaagaaagatggagggagttctattctatccagtgtgcaattgcgaagctgtcgaaatgtctagctagtcttttgatggttagggaattattatgtaatgcctacaatagtttcatcgcctcccggggtgttgatgtgtttgacttagatcctcaccagtaaggtcaaggcgtatggtgtggatcctctcacatcaatcctggtggcctgtaatttcagttttcgttatgcaatctggtgcaagttgtcttttctggatcatgttatggaagcttgccacattttggatctttgctatctaaccatcgatttgattaattcgagaatctgtaccactaaac

SEQ ID NO: 1487 - DNA, 1253 bp, Sorghum bicolor
ggggggcagccgttcctttcctccccgccggtcgccatccccctcttcgctcatttactgctcgctacgactcctcgtgcgaccatctcctgaccgtgagcttgagggacgcggcggcgatcatggcgtggcgtggcccgctcggagccggagacgccggggacagcggcctcgagctcagcctcggcctcccggcctacttcgccaagccatcatcaggtttggacgtcgccgccggcgaggagtccggtgaggcctctgctttcgctcaccaggctgccaatgggagcaatggctccaaagcaagggtcaggccagcacccgcggcgccggtggttgggtggccgccggtgcggtcgttccggaggaacctggcctcgtcctcctcctcaaggccgtcgccgccgtcgtcgtcgggtcaccacaaggttcaggacggcggcgcgcacaagggcggactgttcgtgaagatcaacatggacggcgtgccgatcgggcggaaagtggacctcaccgcgtacggcggctacgccgacctctccgccgccgtcggcaagctcttccgcggcctgctcgccgctcagagggacccggccgcgacggcgggtggcgaggcggcggcggaggaggaggtgcaggagccggtgatcggcggcgactacacgctggtgtacgaggacgacgagggagacagggtccttgtcggcgacgtcccctgggagatgttcgtggccaccgccaagaggctgcgcgtgctcaagagctccgacgtgccggcatcgtcgctgagagcagggggcaggaagagggctgcagccgattgctgaaactgttcggcatcatgtgcttgtaaaaagtctcgagtggaggagacgacgaaaggagtggccagggctcaggctgtgtcccaggcctttttttgctgtctttctgctagtagtactagctagcagtgttgggtgccagtagtaaagtagggaaggagtatatgggaacaaagtcatgacggtattaatgtcatgtagtgcaagattagaagtggtagtacctcattagtactcttgggtgttaatgaatctatggtcttttgttttgggatatattttgacgttttaaattaagctgtatactatgtatgcacgcgtcaaatttcggtgtgtttgtgctgatctcacacgaacgtgtttccgtgtgaccttataagcaaaattgctaacttggcagtgtcattaaatgaaggagttttattagat

SEQ ID NO: 1488 - DNA, 3878 bp, Triticum aestivum
  misc_feature (434)..(434): n is a, c, g, or t
  misc_feature (640)..(640): n is a, c, g, or t
  misc_feature (658)..(658): n is a, c, g, or t
  misc_feature (676)..(676): n is a, c, g, or t
  misc_feature (679)..(679): n is a, c, g, or t
  misc_feature (684)..(684): n is a, c, g, or t
  misc_feature (706)..(706): n is a, c, g, or t
  misc_feature (837)..(837): n is a, c, g, or t
  misc_feature (844)..(844): n is a, c, g, or t
  misc_feature (979)..(979): n is a, c, g, or t
  misc_feature (3839)..(3839): n is a, c, g, or t
ccacgcgtccgccccgcggcaagaacggcggctggacaagaaaaaaccaaaaaaaaaaaggaagaacacagagcaccacaccaatttccgcccgcccacctatcgatcgaagccccggatttcaatccgcaagaatacctcgagaaatcggaggagccgcgatccttctccctccggatcccacagcgctgctgctcggctgccgctccggcgcgacgtcgaaaccctagtggggatggcggaggtgtccgcggcggcggcgctggtgccggagggcgtcctgcacaggaggatagagttccacctcgcccggaggccgcactccgcggcggccgtcgggggaggcgggttccagatggagaccctcaacccggacgccgcgggcggtgcgtcctcggcggcggtgggagcggccaggggcgaggcggaggcgnggaggccggagaaggccgaggctctgggcttggatccggagctcaccgttgccaggatctacctcgggagaattggtgctggtctgcaaaatcttgggaacacttgctacctcaactcggttctgcaatgcttgacgtacacggagccgttcgcagcctacttgcagagtggaaggcacaagtcttcatgtcgtactgctggattntgtgcattgtgtgctctncagaaccatgttaagacngcnctacngtcaactggaaaaatagtgacnccatcacaaattgtcaagaacttgcgctgcatttctcgtagcttccgtaattcaaggcaggaagatgctcatgagttaatggttaacttgcttgaatccatgcataaatgctgtttaccttctggagtacngagcgantctgcaagtgcttatgagaagagcttagttcacagaatatttggtggccgcctaagaagtcaggtgaaatgtacaaggtgctcgcattgttccaacacatttgatcctttcttggatctcagtcttgatattggnaaggccacaactttggtgagagcgcttcaaaactttactgaggatgaactactcgatggcggtcaaaagcagtatcagtgtgagcgctgcaggcagaaagttgtagcaaagaaaaggtttacaattgatcaagctccaaatgttttgacagttcatctgaagcgctttagccctttccgtccccgtgaaaagattgacaaaaaagtggattttcaacctgttctagacttgaaaccatttatgagtgattctaaaggcgcggattacaaatacagtctttatggtgtcttggttcatgctggttggagtactcaatctggtcattattattgctttgttcggacttccagtgggatgtggcacaatcttgacgataatcaggtacgccaagttcgtgaggcagacgtactgaaacagaaagcctatatgttattttatgtacgtgacagaattgggaacacattggggcgcaaagacaacagcactcctaatctgcctgtaaacaacatgatccctgggaagatttcatctatcaatggtgaaatggaagcaaaatcgagtggtctgacatcaccttatgcaaataagaagttgcagagtacaagcaatgcccattccagcgttagcagtatgacattagtagaccattgttcaacaaatgctggcaaagctgaaactgctgcagcccttcaaaacagtgtcctgcccgccgcacagaaagcccttggacctcaaaatgatggtgctacattgtcaactaaatcaaagcaagttgcttcaagtagtcataaagagacatcttcatcagatcaactggcgagcagcaatcagacaatggctaagatgtcattgcaggaaccaaagactggtggtgcattggccaagctgggaaataatacttctattgcctcatctatggtcagtggtcctgctggactgtcagagacagataaacaaacttcttgctctcaaacatgttccaagccaagctcgaacttggttggcacgattaccgggtttaccgcgcaaactttccaaactaaggatgctgttctttcaaatggtgtcatccctagcactagcggtggagatccagtttcaagtgagaaaatgaaggacttaacaggatctctcaagcaagatgaccacatagtgaaggctttgacgacgagcaagaaggagaaaaccatactaccaggacttgagcaagttgatgttggaaaacagatctcctcgcaagtttccacgaaggtggttccaggcgattcatgtaatggcagaatgactaaaagggtggactcgaagtcaaagaaacttgtgagatatccattaatgaagttatggctccggccaagacaattatcactaaagcaacaaaagaagaagcataagaaaaccaaaaagcgcgttaaggacacggccagtgttgattgttctggtgacaacagcagtgagcagcagacatcaacgtcagcaactgtgccgccaaaaactgcaggatctacatctcgtaagcggaaacatgcccatgccagtgcaagttctgaaaatggcacccaagtattcaaagacagccagcaggttgttggagcaagcagtgctggtgctggtgatcataacatggacgccaggaatggaaagagtcaaacttctgcaaatcaagcaaattcaagaaacaacgtagatgcaaagaggggagccgcctcccaacaagtcgttattcgcacagaggacttgagggcagaagttaccgttccgtgctgggatgatgttgccgtgccaaacagtgagactagtgaatacaaaagttcggggaagaagagcattggatatgtgctggatgagtgggatgaggagtacgaccgtggaaaggcaaagaaggtcaggaaagcaaaggaagacgacaacgacgatggcatgaaccccttccaggcggaggccaactatgtgtcagcgcggaagacgaaacagaattcctacaaatccaagccttgggacaagcccgccagaccgagtcgctagactttgccgaaagagatgacgcccccaggctccgtagaaagagaagagaagtgttgttgtatcgcccattttctgaaacatgccatctgctgttccttttttttcccgccttgttgctccttttttcaccttgttgtctgactagacggctcgaaatagacagcactcttgatcggggcctgtatttaattgtgagattctttgtagcgcagtgggagttcgtagaacatgttgccgtttttcgcagcatttttcgttcttgtttctccagcgacatagttatgatttgttatgaataaacttgtgttctcgtttctctagcaaaaaaaaaaaaaaaaaaaaaaaaaaaaaaaaaaaaaaaaaaaaaaataaaaaaaaaaagggggggcggcgcggtctaaactatagtatgggggcgggcgggccttaattcccacacccctccttgatagaaccaagagtccctccccgtcccccttagttttatttttcaaacgcaggcgcccgggcactggtctcttcatttttaacaaacgtgacaagaacgtggccatcctatggttaacgccttgcggtatttgaaaagcaaaacccttcccttcgggtggggggtgagcgtgaacatgaacccgacccacccctgagagttaattggcaattttcgtggaaaaaaaaaaaaatatatacttcttggaaaggaaggaaaaagaaataaaaattccttctggggtggctggggggggtatgaaaaaggcctaccataaccttcatattcaaataatattgagagctccccagcggggcgcgacgtattcgtaactctgggtgtttgggtgtnctataacaccccccgacctggttgagttgtatatcttca

SEQ ID NO: 1489 - DNA, 1099 bp, Brachypodium distachyon
caccgccgccgcctcccgccgtcgtccccgtcatggctccgctcctcttccttctcctcgccgccctcgcgttgtctccgaccttcgatgccgccgccggaggcttctacgaccaggcgcgcgtcacccagctctcctggcgccccagggcgttcctgtacagcggcttcctctcgcacgccgagtgcgaccacctcgtcaagctggccaaggggaggctgcagaagtcgatggttgcggacaatgactccgggaagagtgtcatgagccaggtgcgcacaagctccggcacgttcttgaacaagcatgaggatgaaattatctctggaattgaaaagcgcgtagctgcttggacatttctacctgaagaaaatgccgagtcaattcaggttctgcactatgaagttggtcagaagtatgatgcccacttcgattattttcatgacaaaaataaccagaagcttggtggtcatcgagttgccactgtccttatgtacctgacagatgtgaagaagggtggggaaactgtctttccgaatgcagagggaagacatttacaacacaaggatgaaacgtggtccgagtgcgcaagatctggcctggcagtgaagccaagaaaaggtgatgcactactgttcttcagtctccacattaacgcgacaacagatccaagcagtcttcatggaagctgcccagtaattgagggtgagaagtggtctgccacaaaatggatccacgtccggtcatttgacaatcctccaattgttaggatggacgtgcggtgttctgatgacaatgagctttgctctaaatgggctgctgttggagagtgttacaggaacccaaaatacatgataggcacgaaagatacgctcggattttgccgcaaaagttgcgggatttgcgatgcttgaaactctcacctatctgaactgtatatgtgaagtgcagtgttagcctgttgtctgtttccactcccctttctgttttacctgggatgtacgttacaaaaccaagtagacttactcctcttaacatgtagtttgaccgcagagcatcttgacataaagctatttttttaatccaacctgctgatatc

SEQ ID NO: 1490 - DNA, 1168 bp, Oryza sativa
atgaacccgctcccatggcgcccctccgaacactcgttatcttcctcctcctcctcctcgcgctcgtcccggcactctcgcgcccggatggcggcggcggcggcttctatgacccggcgcgcgtcacccagctatcctggcgccccagggcgttcctgtacagcggcttcctctcgcacgacgagtgcgaccacctcgtcaatctggcgaaggggaggatggagaagtcgatggttgcagacaatgattccggcaagagtatcatgagccaggtgcgcaccagctccggcaccttcttatcgaagcacgaggacgacattgtttctggaattgaaaagcgtgtagctgcttggacatttcttcctgaagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcgggaaggcatttacaactcaaggatgaaacttggtctgattgtgcaagatctggcctggcagtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgcggggtttgcgatgcttaaaccctgcacccgccaaactgaagatctgaaaatcaaagtgtcatgttaggctgttagctattttcgcccactttacttacacagttacactacttgagaagttgagatgtacataacagacaaagcaggtttattagtatgtgtttctgtgtagtttaaccttgaacgatattgattgaaagtaattggaactttttttcaggtctaaagtgctactgaaatttttcgcaaaaaagttgggagtatttctttta

SEQ ID NO: 1491 - DNA, 1103 bp, Triticum aestivum
  misc_feature (118)..(118): n is a, c, g, or t
  misc_feature (459)..(459): n is a, c, g, or t
  misc_feature (948)..(948): n is a, c, g, or t
cccatcatgccgccgctcctcctcgccgcgctcgcgctcgccctggccctctcccacgccgccgccggaggaggcgccgggttctacgacccggcgcgggtcacccagatctcctggngccccagggcgttcctgtacagcggcttcctctcgcacgccgagtgcgaccacctcatcaagctggccaaggggaggctggagaagtcgatggtggcggacaacgagtccgggaagagtgtcatgagccaggtgcgcacaagctccggcaccttcttgtccaagcgcgaggatgaaattatctctggaattgaaaagcgtgtagctgcttggacgtttctccctgaagaaaatgccgagtcaatgcaggttctgcattatgaagttggtcagaagtatgatgcccacttcgattattttagtgacaaaaagaacgtgaagcgtggtggtcatcgggttgcnactgttcttatgtacctgacagatgtgaagaagggtggagagaccgtgttcccaattgctgagggaagagatttacaacataaggatgaaacgtggtcggagcgcgcgagacatggcctggcagtgaagccaagaaaaggcgatgcgctactcttcttcagtctccacgttaacgcgacaacagatccgagcagtcttcacgcgagctgcccagtagtcgagggcgagaagtggtctgccacaaaatggatccacgtccggtcattcgacaaccctccagatgttatgacggacgcacggtgttctgatgacaatgagcaatgccctagatgggctgctcttggggagtgttacaagaatgcaaaatacatggtgggcacgaaggacaccctcgggtcttgccgcaaaagttgcggggtctgcgatgcttgaacccccgcaccaatcttaactgaatttgcatggttactgagatgtagattacaaaancaaataggttcttagtagcatggcattagatgtttactcttcttgtcatgcagtttgacctcagagcatcttgatatacagcaaaaagggaattgactttgtttcagaagaatttggacataacccgatggtatcaagtatttccaaaaaaaaaa

SEQ ID NO: 1492 - DNA, 1965 bp, Brachypodium distachyon
ttcacgaatcaccaccgatggcaaccccgaccgtcgtgttgctgcccgtctggggcgctggccacctcatgtccatgctggacgcaggcaagcggttgctcgcccgcagccgcggcgctctctcgctcacggtgctcgtcatgcaggcaccggcggagaactacaggtccgaggtcgccggccacattcgtcgggaggaagcttccgggctggacattcgcttccatcacctccccaccgttgagctcccaacggactacgtgggcatcgaggaatttatctcccgtttcgtgcagctccacgcgccgcacgtgaaggcggccatctccggcctggcgtgccccgtggcagcacttgtcgtcgacttcttcgccacgacgctgttcgacgtctcccgcgagctcgccgtgccggcatacgtgtacttcaccgccagcgccgccgcgtacgcgctcttcctgcgcctgccggcgctccaggaggaggtaacgtgcgagttcgaggagttggacggcatggtggacgttcccgggttgccgccggtgccgccgtcgtccctcccgtcgccgttgatggacaagaagaaccccaactacacatggttcgtgtaccacggcaggcgtttcatggaagccaacggcgtcatgattaacacggcggccgcgctcgagcagagcgttcttgctgccatcgccgacggccggtgcacgcccggaatccctgccccgacggtctatccagtcggccctgtgatctccttcaatccgccagcggagcagggcggccatgagtgcctccggtggctcgacacgcagcctccggcctccgtggtgctcctctgtttcggcagcggaggcttctccaccgcgccgcaggcgcacgagatcgcgcacgggctggagcgcagcgggcaccggttcctctgggttctgcgtggcccgccggcagccggcgcgcagcaacccgcggacgcgaatctagaggagctgctcccggaggggttcctggagaggaccaaggggaagggcctcgtgtggccgacaaaggcgccccagaaggagatcctcgcgcacgccgccgtggggggtttcgtgacgcacggcgggtggaactcggtcctggagagcctgtggttcggcgtgcccatggtgccgtggccgctctacgccgagcagcacttcaacgcgttcacgctggtcgcctacatgggcgtggccgtggccatggaggtggacaggaagaggaaaaacttcgtgcgcgcgtcagacctggaacgagccgtggtggcgctcatgggcgactccgacgagggaaggaaggcgagagagaaagccacggagatgaaagctgcctgtaggagtgccgtcgaggaaggaggttcgtcgtattctgcactggggagcctcgcggaagagatgattaaaggcgtgaaccagagatcgccgcactgaaatggtgttctgcataagggtgcgtagaaaatcaacttggagggagctggaccgagtgtttattttcctgattgctaataattgctgctgctggcacatcgtgagcaaccgtccggcgtctgctgcaccgatcgtgcggacacgtgcctggtgagccccgcgctaatcaggctttttcggtcaagacatgtaatcctcgtgggctcatttgagttggttgagaaataataattcctttttttgcgaaagggaaaaataattatttcagggtcaatgatgtgaactgttgattcggatgcggagattcgggagctttcaggtttctttgtgcttgtattatttgggaatttcagctttgttggaggtagcatatcatttttgtgcaactcagcttataaaaatgcgcagctttatcagttttattcctaaaattgtaatagtggtaatggctattgtatcagtgagtatgatttatggttcaaacgttgctaagttatatgattttgaaatgaaa

SEQ ID NO: 1493 - DNA, 1828 bp, Brachypodium distachyon
ccataaatttcgacaggtgcaagcgcgcgcgactacttctctaagttatcatgaaccaaaatcattgctaccaagaaccacattcacatccctgcctatattagagcagcccctgctggatcagccagttcaacacagttcgacaagcagtcaagcaccgacacaccagtaagctatcaacgctgcgatggcgacgccacccacgctggttctcctcccggagtggggcgcggggcacctcatgtccatgctcgagtcctgcaagcgcgtcctcctcagcggcggccgcgccttctccatcacgctcctcgtgatgcgcccgcccaccgccgcggccacctccgaggtcgaggcgcacgtccgccgcgaggcggcctcgggcctcgacatccgcatccaccgcctccccgccgtcgagccccccgccgacgctgccggagtcgaggagttcatcgcgcggtacatcgagctccacgcgccgggcgtcagggacgccgtggccggcatgtcctgccccgtcgccgcgctcgtgctcgacctgttcgcggcgcccatggtggacgtggcccaggacctcggcgtgccctcctacgtgttcatgtcttccacgggcgccatgctcgcgctcatgctccacctgcccgtgctccacgaggcggtgaccgtggagttcgaggaagtggagggaggagtcgtgcacgtgcccgggctgccgcctataccgcacgagtggatgccgtgccccgtggtggacaagaagagccccaactacacgtggttcgtgcgcctcggggagcgcttcatggacgccacggggatcatcgcgaacaccgcggacgagctcgagccgggcccgctcgcggccatcgccgaaggtcgcgccgtgcccggacgccccgcgccgcccgtgtaccccatcggccccgtgctctcgctcggtagcagtagtagcaagaaggaatcctcctccgggccgccgcacgcgtgcgtcgcctggctcgacgcgcagccaagggcgtcggtggtgctcctctgcttcgggagcatgggctggtttgaggcggcacaggtagttgagatctgcgcggcgctcgagcggtgcggcgcccaccgcttcctgtgggtcctccgaggcccgcccggcgcggacacgggcgccggcgcgccggacgggtcggagcacccgacggacgcggacctggacgagctcctcccggaggggttcctggagaggacggcgggtagggtcctcgtctggccgacgtgggcgccgcagaaggagatcctggcgcatgccgccgtgggcgggttcgtgacccactgcgggtggaactcggtgctggagagcctgtggcacggcgtgcccatggcgccgtggccgctgtacgcggagcagcacctcaacgcgttcgagctcgtggccgacatgggcgtcgcggtgccgctcaaggtggaccggaagcgggacaactttgtcgaggcagcggagctggagcgggcggtggagtccctgatgggcggcggcgaggaggggaggaaggcgagggagaaggccgccgtgatgagagatgtgtgccgcaaggccgtcggcaagggcggctcttctgaggctgcgttgcagaggctctccgaggtgcttcacgaaggcgctctgccgaaggtgtgaaccgtcgagcagcgtggaacgcactgcgcgggcgcctcgctgggtagtcttgatcgagctctggagaaattttacttttcaaaaaaaaatgaagaaaaaatactagtgttcactgctacaggaatatgctctcaaggaaatattacaatattgattccagcc

SEQ ID NO: 1494 - DNA, 1670 bp, Zea mays
tgcttgctttggttacccaaggaaaaagcactgaagtaacggttacggccaaacaccgactgttccaatggcgacgcccgcgctggtgctcctaccggagtgggggtccggccacctcatgtccatgctcgagtcctgtaagcgcgtcctcctcagcagcagcggcggcaaggccttctccatcaccctgctcgtgatgcgcccgccgacggccgaggccacctccgaggtggaggcgcacgtgcggcgcgaggccgcgtgcgggctggacatccgcttccaccgcctccccgccgtggaggcccccaccgacgccgtcggggtcgaggagttcatcgcgcgctacatcggcctccacgcgccgcacgtccgtgacgccgtggccgccatggcgtgccccgtggccgcgctcgtgctcgacctcttcgccgcgccgctggtggacgtggcgcggggcctcggggtgccgtcctacgtcttcatgtcgtccacgggggccatgctcgcgctcatgctgcacctgcccgtgctccacgagtccgtccccgccgtggacttcgacgagatggagggggacgtgccgctgccggggctgccgccggtgccgccggactccatgccgtgccccgtggcggacaagaggagccccaactacgcgtgcttcgtgcgcctcggcgaccgcttcatggacgccacgggggtcatcgccaacacagcggacgagctcgagccggggcccctggcggccgtcgcccggggccggtgcgtgcccggccggcccgcgccgccggtgtacccgatcggccccgtgctgtcgctcggcggccgctcgccgtctcacgagtgcgtcgcgtggctggacgcgcagccgccggggtccgttgcgttcctctgtttcgggagcatggggtggttcgacccgccgcaggttgcggagatcactgccgcgctcgagcggtgcggccaccgcttcctgtgggtcctgcggggaccaccctcggacgcgtccgggtcggagcacccgacggacgcgaacctcgacgagctgctcccggaggggttcttggagaggacggggggcaagggcctggtgtggccgacgtgggcgccgcagaaggagatcctggcgcaccccgccgtgggcggcttcgtgacgcacggcggctggaactcggtgctggagagcctgtggcacggcgtgcccatggcgccgtggccgctgtacgcggagcagcacctgaacgcgtttcagctggtggccgacatgggcgtggccgtgccgctcaaggtggacaggaaacggggcaacttcgtggtggccgcggagctcgagcgcgctgtgcggtccctgatggacgccgacggcgagcaggggaggagggcgagggagaaggccgcgcgtatgaaggccgtgtgccggaaggccgtggaggagggcgggtcgtcgcacgcggcgctgcagagactcgcagaggcgctccacgacggcgccgtgatcccgaagaagtgaaacgcggccgctccatgttcctttgtttggtgatgtttcatggaatactatgcgcgcgtaattgtttttttataccaatagcgcaataacagtaataatacaaatttagattacaataagtagcaagttgcatcaaactaacatacttagtgtccaataa

SEQ ID NO: 1495 - DNA, 1951 bp, Oryza sativa
tgcccaaactccgaattgttctcgatcaaaccgtcttttctgctcatttttccacattttgaccacctagtcgaaattcgccacctctactgcgatacttctagtacaagtgtcactggtcgtgtagtgaattttaaccttatctcgcaggcagctagtgtgatcaatcacgagttgttgtattcaattatccattattagctactagctagctagtccaactaatagagtgttgcgccgaacgaacactactgctgcagacggtgatcagctagagagcgagagtatggcgacgctggcgccggcgctggtgctcctgccggagtggggctccggccacctcatgtccatgctcgagtcctgcaagcgcgtgctcctcgccggcgccggcggcggcagggagttctccatcacgctgctcgtcatgcgcccgcccaccgacgaggcgggctccgaggtcgaggcgcacgtccgccgcgaggccgcgtcgggcctcgacatccgcttccaccgcctccccgccgtcgacccgcccgccgacgccgccggcgtggaggagttcatcgcgcggtacatccacctgcacgcgccgcacgtcagggacgccgtcgccgggatggggcgccccgtcgccgcgctcgtgctcgacatgttcgccgcgcccatggtcgacgtggcgcgcgacctcggcgtgccgtcctacgtcttcatgtcgtccaccggcgccatgctcgcgctcatgctgcacctcccagtgctccacgaccgggtcgccgtggagttccacgaggtggacggggaggtggacgtgcccggcctgccgcctctgccgccggcgtccatgccgtgcccggtggtggacaagaagagccccaactacacgtggttcgtgcgcctcggcgaccgcttcatggacgccacgggcatcatcgcgaacaccgccgacgagctcgagccggggcccctcgccgccatcgcggacggccggtgcgtgccggggcgcgccgcgccgccagtgtaccccatcggccccgtgctctcgctcggcggcaacgacaagagggacagctccgagccgccgcacgagtgcatcgcgtggctcgacgggcagccgccggcgtcggtggtgttcctctgcttcgggagcatgggctggttcgaggcggcgcaggtggtggagatcaccgccgcgctggagcgttccggccaccgcttcctctgggtcctgcgtggcccgccgcccgccgccgagtcaggcaccggcgcgcccgacgggtcggagcacccgacggacgcgaacctcgacgagctcctccccgaggggttcctggagaggaccaaggggaggggcatggtgtggccgacgtgggcgccgcagaaggagatcctcgcccacccggccatcggcggcttcgtgacgcacggcgggtggaactcggtgctggagagcctgtggcacggcgtgccgatggcgccgtggccgctgtacgcggagcagcacctgaacgcgttcgagctggtgcgcgacatgggcgtggccgtgccgctcggggtggacagggagcgggacaacttcgtggaggcggcggagctggagcgcgcggtgaggtcgctgatggacgatgcgtcggaggaggggaagaaggcgagggagaaggcggcggagatgaaggccgtgtgccggagcgccgtggcggcgggcggcggctcgtcgcacgccgcgctgcagaggctctccgaggcgctgcaccagggcgcggcgctcccgaagaactgagcatacgtgaaaattgttgcacgtcacgttttcgaagtcgaagtaacaagagatgatgccgcttgtactgtttgtgccatatgcgtgtcttgtttgcactacagtaacactgaaatgcagtcttgtactcgggtcattattaatgatgattttctatggacttgactcctctca

SEQ ID NO: 1496 - DNA, 1691 bp, Sorghum bicolor
ttattagtactgcaattcgcgagcagtgaaaaggaaaagcagtgaagttagagttacggctacagccttacaccgacggttgttcccatggcggcgcccgcgctggtgctcctgccggagtggggcaccggccacctcatgtccatgctcgagtcctgcaagcgcgtcctcctcagcggcggcggcggcaaggccttcaccatcaccctgctcgtcatgcgcccgcccaccgccgaggccacctccgaggtggaggctcacgtgcgccgcgaggccgcgtccgggctggacatccgcttccaccgcctccccgccgtggaggcgccctcggacgccgcgggggtcgaggagttcatcgcgcggtacatcgccctccacgcgccgcacgtcagggacgccgtggccgccatgtcgtgccccgtcgccgcgctcgtgctcgacatcttcgccgcgcccctggtcgacgtggcgcggggcctcggggtgccgtcctacgtcttcatgtcgtccacggccgccctgctcgcgctcatgctgcacctgcccgtgctccacgagtccgtccccgtggagttcgacgaggtggaaggggaggtgcaggtgcccggcctgccgccggtgccgccggagtccatgccgtgccccgtggtggacaagaagagccccaactacgcctggttcgtgcgcctcggcgatcgcttcatggacgccacggggatcatcgccaacaccgcggacgagctcgagccggggccgctagcggccgtcgccggggggcggtgcgtgcccggtcgccccgcgccgccggtgtacccgatcggccccgtgctgtcgctcggcgaccgctcgccgtctcacgaatgcgtcgcgtggctggatgcgcagccgccggggtcagtggtgttcctctgcttcgggagcctgggctggttcgatccgtcgcaggtggtggagatcacggccgcgctcgagcggtgcggacaccggttcctgtgggtcttgcggggcccaccttcggacgcgtccggctccggcgccggcgccccagacggggcggagcacccgacggacgcgaacctcgacgagctcctgccggaggggttcttggagaggaccaagggcaagggcctggtgtggccgacgtgggcgccgcagaaggacatcctggcgcaccccgccgtgggcggcttcgtgacgcacggcggatggaactcggtgctggagagcctgtggcacggcgtgccggtggtgccgtggccgctgtacgcggagcagcacctgaacgcgctggagctggtggccgatatgggcgtggccgtgccgctcaaggtggacaggaagcgggacaacttcgtggaggccgcggagctcgagcgcgcggtgcggtccctgatggacgccgacggcgagcaggggaggagggcgagggagaagaccgcggatatgaaggccgtgtgccggaaggccgtggaggagggcgggtcgtcgcacgcagcgctgcagaggctcgccgaggcgctccaccacggcgcggtgatcgccaagaagtgaaccacggccgccgtgttcttttgttcggtgatagtttactctactcatgtcgtatgtatggatcataaaactttcgtgtcagtgttgacaataagttggtccgcgaaaatttgtttgctgttgtgctattagttctttac

SEQ ID NO: 1497 - DNA, 645 bp, Triticum aestivum
attcggcacgagttcttgcagatgacggagggcaagggcctggtgtggccgacgtgggtgccgcagaaggacatcctggcgcacccggccgtgggggggttcgtgacgcacgccgggtggaactcggtgctggagagcctgtggcacggcctgccaatggcgccgtggcctctctacgcggagcagcacctgaacgccttcgagctcgtcgccgacatgggggtcgccgtgccgctcaaggtggaccggaagcgggacaacttcgtggaggcggcgaacctggaacgagcggtcaagtgtctgatgggcgaggaggggcggaaggccagggagagggccgccgagatgagagacgtctgccgcaacgccgtcaacaagggcggctcctccgacgctgcgttgcagaggctctcggaggcgctccaccacggctcggtgctgcccccgaccatgtgaattctttacgcttgccaggaaaagcgtttctaccaaaatataattaaaatatttttctcatgtattttctaatgaatcttaaagtattcaacacttatttatttattttgattgattgaagtggacctggttatggctgtgtgcatcttaattatgtagaagccgtctataatgcttaaaccttttaag

SEQ ID NO: 1498 - DNA, 941 bp, Triticum aestivum
attcggcacgaggcttcctgtgggttctgcgtggccccccttcctccaagtccggcgccggcgcgccggacgggtcggagcacccgacggacgcgagcctggaggagctgctcccggaggggttcctgcggcggacggagggcaagggcctggtgtggccgacgtgggcgccgcagaaggagatcctggcgcacccggccgtgggggggttcgtgacgcacggcgggtggaactcggtgctggagagcctgtggcacggcatacccatggcgccgtggccgctgtacgcggagcagcacctgaacgcgttcgagctcgtcgccgacatgggcgtcgccgtgccgctgaaggtggaccggaagcgggacaacttcgtggaggcggccgagctggagcgggcggtgaggtgcctgatgggcgaggaggggcggaaggccagggagaaggccgccgagatgagagacgtctgccgcaaggccgtggagaagggcggctcctccgacgctgcgctgcagaggctctcggaggcgctccacgacggcgcggtgcggccgaccatatgaatcgatccttataatggagtatatatttctctcctacagaaaatgataaaataaaatcgaagtgtgtgtgtggtagaaacaccagagcagaacatctttgatgcagttcaaggctggcgttttgatgtgctccagatagaggaagatctggaaagtcagtctatgcgcgccgagaaccagtgatggagaagctccttttggtcatttgctattttgtctgcttttgctcataagtttctattggctagcttgtggttgcgtatcttgctttcacctatttatgtggtttggtaattggttgctaatgttaataggacttttataactaccaaagttcggatttaccaataggcaagaacgatccttatttcactctaa

SEQ ID NO: 1499 - DNA, 1867 bp, Brachypodium distachyon
cctaacgccgccgtccatccatggcctcctgcgacgacgacttcggcctcctcggtgacgacgcccaccccgctccccagccttccgcccagccgcccccgccgcagcaggcccagaccttctgcttcgtcgacgccccggccacgggctccggctccggccccttcgtgccggcccaggaggagggcaaccacagctccgagcgcgggaaggcgtcgcaccactccaagaggcggagggagcgcgcggaggagttcagcgatgggggcgagtactgttcctacatcagcagcagcgccggggggaggaagggccgtggcggcggcggcggcggttcctccgactaccggaaggaccgggaggagtggacggacggcgccatcagcagcctcctcgacgcatacacggagcggttcgagcagctcaaccgcgggaacctgcgggggcgggattgggaggacgtcgccgctgccgtgaccgacgggcagggcaaaggcggcgctggcaagagcgttgagcagtgtaagaataagatcgacaacctcaagaagcgctacaaagtagagtgcacacgcaacggcggcgccggtgccgcctctgtcagccactggccctggtacaggcagatggagcaaatcatcggcaactcctcgtcgcccggcacctccaagccactggcgcccaccaacgacgagaagccgcggcaactgctgcagaacgccaacaaaaggtacccttcttccggtactggccctcctaccatggttccctgttccagattgacccctctctcaaatccgaaatggaagagggtgctcctaaagattgggggcactgcattggctggagaagctcctcacaatgttgacccaaaggtaatcatgctgattgccagagaagttcaagtggcgtgccgccatggtgttgaggtggctattgtcatgggagctcggaatatattctgtggcgacaattgggttgctgccacaggcactgatagagcttccacacaccctgttggaatgatggcagcagtgatgaatgcagtattgcttcaagcatcactagaaaaaataggtgtggagacacgagtccagactgcactgatgatgcaagaggtagcagaaccatacataagaaggcgagccatgcgccatcttcaaaaaggaagggtagttatctttggtggaattggtgcttgcataggaaatccacttttcacaacagataccgctgctgcactgagagcttctgaaatcaatgcagatgttgtcctgaaaggtattgctggagatgatgaatatggttgtcctcctagaagcaacagtaatgcactatttgagcacatctcatttagggagttagcggcaagaggaacaagcagcatggatatgacagcaattacatgttgtgaggagaacaatattcctgttgtcatctttaacatgttagagcctggtaacatctcaagagcgatttgtggagatcaagtaggtactttagttgaccaatcaggaaggattacttaaattacaaggcatggtggattagctgtggtgtagcactgggacattcttatagtcccggtggcatcatgcatgttctttgcctgcatggaaagaagggccacgccttgatttgcatgagatacttgttgtgtagtatctgttgtagtggcaactctctgcaatgagaaattgtttatctgttgtgtctgtctgtaatgtgattgttagattagttgaagtgtatgtacccagttcagaatgtagcgttgtaactctgtcgtttgagatgtagtgttgtatttggagaaaaaaatagtttagcgacctttactgctctattaagtgagtgtccagcaagt

SEQ ID NO: 1500 - DNA, 2031 bp, Zea mays
cgtgtctgggagcggagcccgcggtgtaaccctaacgccgccacgcgcggccatccatggcctcctgcgacgacgacttcgttctcctcggtgacgacgcacaccagccggcaactcccccacccccggcccccaccgcccagcaacccgcgccgccgccgccgccgccgccacaggcctcccatcccttcagcttcactgacgcggttgcgggggctgccgccggcgccggctccttcgcgcaggcccaggaggagagcaaccaccacgccgagcgcggcaagccggcgcaccacgccaagcggggcagggagcgcgccgaggagttcagcagcgatgggggcgagtactgttcctacatcaacagcagcggcagcggcggtggtgggaagaagggccgtggcggtggagggagctcgagcgtgtcagactaccgtaaggatcgggaggagtggacggacggcgcgatcagcagcctcctcgacgcctacacggaccgatttgagcagctcaaccggggaaacctgcggggtcgggactgggaggacgtggccggcgccgtgaccgacgggcagggcaagactaccggggccaagagcgtggagcaatgtaagaataagatcgacaatcttaagaaacgttacaaggtggagtgccagcggctctccagttcgggcgggggtgccatcagccactggccctggttcaaaaagatggagcagatcgtgggaaactccgcatctcctgcctcctccaagcttctaactgctgccgaggatgagaaaccgaggcagcagcagcagcacagcagcaaaaggtatcctctttcctgtactggccctcctactggggttggtagctccagaacgaaccctctttcaaatccaagatggaagagggtgcttctgaagattgggggcactgccctatgtggagcagctcatcaaaatgttgatcccaaggtgattatgctgatcgctagagaagttcaagtggcatgccatcatggtgtggaggtggcaatcgtggtaggagggcggaatatattctgcggtgacaattgggtagctgcaacaggcactgatcgagcctcaacgtacccaattggaatgatggcatcagtgatgaattcagtacttcttcaagcatcgctagaaaagataggtgtggagacacgagtccaaaccgcattgatgatgcaagaagttgcagaaccttacattaggcgtcgagccatacgccatcttgaaaaagggagagtggtcatctttggtgggattggtgtgggcattgggaatccattgttcacaacagatacagctgctgccttaagagcttcagagatcaacgcagatgttgtccttaaaggtattgttggtgatgatgagtatggctgtcctcctaggagcaacagtaatgcttcatttgagcacatctcctttagggagttagcagcaagaggaatcaccaaaatggacatgacagcagtaacatgttgtgaggagaacaacattcctgtcgtcatctttaacatgttggagcctggtaacatctcaagagcaatttgtggagatcaaataggcaccttagttgaccagtcaggaaggatcacataaaactaggaggatgaatggtagcagagctccaggacatgccgatactctgggtgggacatcactctggggggacatcctgaattctttgctcgtggatcttttccgtatagaaggaaaacatgttcatcagatggaagcgttcaccttgatttgcctgggatgcctattgtgtattatgcgttgtggtcgcaattgcccacattgagaaaagtattaccttgtaatgtctatttgtaatttgtctgtagattagtggaagggctcatgtaaagtgtttcacggtgcccagatcagaatgtagtgttgtaagttgtaatgctattatttgagtcgtagtgtttgaggtgtcacgttttgcacgattaatttgcctgtggctttccagcaatcaatctttttttttgttcaatgatca

SEQ ID NO: 1501 - DNA, 885 bp, Pennisetum glaucum
aagcagtggtaggaggacggaatatattctgcggtgacaattgggtagctgcagctggcaccgatcgagcttcgacgtacccaattggaatgatggcatcagtaatgaattcggtacttcttcaagcatcacttgaaaaaataggtgtggagacacgagtccagaccgcgttgatgattcaagaagttgcagaaccatatgttaggcgacgagccatacgccaccttgaaaaagggagggtcgttatctttggtgggattggtgctggcatagggaatccacttttcacaacagatacagctgctgccttaagagcttctgaaatcaatgcagatgttgtcctaaaaggtattgttagtgatgatgaatatgggtgccctcctaggagcaatagcaatacgccatttgagcacatatccttcagggagttcgcagcaagaggattcagcagaatggacatgacagcagtaacgtgttgcgaggagaacaacattcctgttgtcatctttaacatgttagagcctggtaacatctccagagcgatttgtggagatcaaataggcaccttagttgaccagtctggaaggatcacttaaaattatgatgtagcagagcttcaggacatgtcaatactctgggggacatgcattattggttgcatggaatgttctggataggagaggtgaaacatgttcatcagacggaagcctgcacactcgcatgccctgggatgcttgttgtgtattatgtgttgtggtagtgattatccacattgaaaagagtatttatcttgtaatatctgcttgtaatgtggtatgtagattagtgagaagggcctatgtaaagtggttcacgggtacccagatcaagatgtagtgttgtaag

SEQ ID NO: 1502 - DNA, 2101 bp, Oryza sativa
gcggcgcgtagccctaacgccgccaccaccacccacgatacgatggcctcctgcgacgacgacttcggtctcctcggtgacggccccgtccccgaggaggaggcggcggcggcggcggcgtcgtcgcaggccgcgccgccgccgccgcagcagcaggcccaggccttctgcttcggcgatgcggcctcggtcgccggggccggggcgggcgtgggccccttcgctccgatggggcaggaggagggaaaccacagcgcggagcgagggaaggcggcggcggcggcggcgcaccactccaagcgggggagggaccgggcggaggagttcagcgatgggggagagtactgctcctacctcaacagcggcggaggtggcggcggcgcggggaagaagggccgcggcgggggcggcggtggcgggggcggggtcgcggccggctcgtcggagtaccgcaaggaccgggaggagtggacggacggcgccatcagcagcctcctcgactcgtacacggaccggttcgagcagctcaaccgggggaacctgcggggtcgggactgggaggacgtcgccgccgccgtgaccgacgggcagggcaagagcagcgggggcaagagcgtggagcagtgcaagaacaagatcgacaacctcaagaagcggtacaaggtggagtgccagcggctcgccggctcgggggcctctgccgtcagccactggccctggttcaagaagatggagcagatcgtcggcaactcgtcttctcccgcttcctccaaggcgttggtggcctccgacgacgacaacaagccacggcaaccgcagcagcatagcagcaaaaggcacgctccttctggcagtagcacccccaccttcggcggcagctccagattggcccctccatcaaatccaaaatggaaaagggtgcttctcaagattgggggcacagcattggctggagcgcctcctcaaaatgttgatcctaaggtaattatgctgattgcccgagaagttcaagtggcatgccgccatggtgttgaggtgtcaattgttgtgggaggtcggaatatattctgcggcgacacttgggtttctgcaacgggcactgatagagcttcaacatactcaatcgggatgatggcatcagtgatgaatgcagtactgctccaagcgtcactagaaaagataggtgtggagacacgagtccaaactgcactgatgatgcaagaagttgcagagccatacataaggcgacgagccatacgccatcttgaaaaaggaagggtcgttatctttgctggtattggtgctggcataggaaatccacttttcaccacagatacagctgctgccttgagagcttctgaaatcaatgcagatgttgtgcttaaaggtaccgccggagatgacgattatggttgtcctcctaggggcaacaacaatccaccttttgagcacatctcatttagggagttagcggctagaggattcagcagaatggatatgacagcgattacatgttgtcaggaaaataatattcctgttgtcatcttcaacatgttagagcctggcaatatctccaaagcaatttgtggggatcaagtaggtacattagttgaccaatcaggaaggattacataaactttaagaaggttagctgcggtagagcattgggtcatgcccgtactatgggggtagcctgcatattggttgatttttgtggatgcgagagcgggcatgttccttggacagaaggctcccaccttgatttgtctgggatgcttgttgtgtactatctgttcagtgccaattctctacaacggaggagaaaaaaaattgtagtatccatttgtaatgtgatatgtagattagattagtttgatgggcatgtatccttgtataaattggttcacgggtaaccgcatcaaagtagggctgtaaccttgtaaggctgttgttgaagtttagtgttgtattggggaacagcattttatctcttttctttgccattcttgcaatcatctttatcttgaaaatggcgagaggtgggacagttctattacgaacacaagacccctctgtggctagaattatctcttgattttcc

SEQ ID NO: 1503 - DNA, 2023 bp, Sorghum bicolor
cctaacgccgccgccgtggctgggagcggagcccgcggcgtaaccctaacgccgccacgcgcggccatccatggcctcctgcgacgacgacttcggcctcctcggtgacgacgcccaccagccggcaactcccccgcccgcaccccccatcgcccagcaacccgcgccgccgccgtcgcagcaggccgcccatcccttcagcttcactgtcgcgcctgcgggggttgccgccggcgccggctccttcgcgcaggtccaggaggacagcaaccaccacgccgagagcggcaagccggcgcaacacgccaagcggggcagggagcgcgccgaggagttcagcagcgatgggggcgagtactgttcctacatcaacagcagcggcagcggcggtggggggaagaagggctgtggcggtggagggatttcgagcgtgcgcgacctctaccgtaaggatcgggaggagtggacggacggcgcaatcagcagcctcctcgacgcctacacggaccgatttgagcaactcaaccggggacacctgcggggtcgggactgggaggacgtggccagcgtcgtgaccgacgggaagggcaagactaccgggggcaagagcgtggagcaatgtaagaacaagatcgacaaccttaagaaacgctacaaggtggagtgccagcgtctcaccagttccggcggaggcgccgtcagccactggccctggttcaaaaagatggagcagatcgtcggagactccatgtctcctgcctcctccaagcctcttgctgcagccgaggatgtgaaaccgaggcagcagcagcagcagcacggcagcaaaaggtatcctctttccagcactggtcctcctactggggttggtagctctagaacgaaccctctttcaaatccaagatggaagagggtgcttctgaagattgggggcactgccttatgtggagaggctcctcaaaatgttgatcccaaggtgattatgctgatcgctagagaagttcaagtggcgtgccatcatggtgtggaggtggcgatcgtgctaggagggcggaatatattctgcggtgacaattgggtagctgcaacaggcactgatcgagcctcaacgtacccaattggaatgatggcatcagtgatgaattcagtacttcttcaagcatcactagaaaagataggtgtggagacacgagtccaaactgcattgatgatgcaagaagttgcagaaccttacattaggcgtcgagccatacgccatcttgaaaaagggagggtggtcatctttggtgggattggtgcgggcactgggaatccattgttcacaacagatacagctgctgccttaagagcttcagagatcaatgcagatgttgtccttaaaggcattgttggtgatgatgaatctggttgtcctcctaggagcaacagtaatgcttcatttgagcacatctcctttagggagttagcagcaagaggaatcaccaaaatggacatgacagcagtaacatgttgtgaggagaacaacattcctgttgtcatctttaacatgttagagccgggtaacatctctagagcaatttgtggagatcaaataggcaccttagttgatcagtcaggaaggatcacataaaattaggaggattaatggtagcagagctccaggacatgctgatactctgggggacatcatggattatttgctcttggatcttttccggatagaagagaagcatgttcatcagatgggaagccttcaccttgatttgcctgggatgcctgttatgtactatgcgttgtggtcgcaattgcccacattgaaaagaagtatttagcttgtaatatctatttgtaattttctgtagattagtggaagagcttatgtaaagtggttcaagggtaccaagatcagaatgtagtgttgtaagttgtaaggctattatttgagtcggtagtgtttgatgtatcacctttttgcgccattaatttgcctgtggctttccagcaatcaatctttttgtttgtt

SEQ ID NO: 1504 - DNA, 2044 bp, Saccharum officinarum
  misc_feature (503)..(503): n is a, c, g, or t
  misc_feature (572)..(572): n is a, c, g, or t
tgcacgtacacgttctcgaattcccggtcccgacccaacccacccgtgcgcacgaggcgtaaccctaacgccgccacgcgcggccatccatggcctcctgcgacgacgacttcggcctcctcggtgacgacgcccaccagccggcaactcccccgcccgcaccccccaccgcccagcaacccgcgccgccgccgtcgcagcaggccgcccatcccttcagcttcactgtcgcacctgcgggggctgccgccggcgccggctccttcgcgcaggtccaggaggacagcaaccaccacgccgagcgcggcaagccggcgcaacacgccaagcggggcagggagcgcgccgaggagttcagcagcgatgggggcgagtactgttcctacatcaacagcagcggcagcggcggtggggggaagaagggccgtggcggtggagggatctcgagcgtgcacgacctctaccgtaaggatcgggaggagtggacggacggcgcgatcagnagcctcctcgacgcctacactgaccgatttgagcaactcaaccggggacacctgcggggtcgggactgngaggacgtggccgccgtcgtgaccgacgggcagggcaagactaccgggggcaagagcgtggagcaatgtaagaacaagatcgacaaccttaagaaacgctacaaggtggagtgccagcggctcaccagttccggcggaggcgccaccagccactggccctggttcaaaaagctggagcagattgtcggagactccgtgtctcctgcctcctccaagcctcttgctgctgccgaggatgtgaaaccgaggcagcagcagcagcagcacggcagcaaaaggtatcctctttccagcactggccctccttctggggttggtagctctagaacgaaccctctttcaaatccaagatggaagagggtgcttctgaagattgggggcactgccttacgtggagcggctcctcaaaatgttgatcccaaggtgattatgctgatcgctagagaagttcaagtggcgtgccatcaaggtgtggaggtggcgatcgtggtaggagggcggaatatattctgcggtgacaattgggtagctgcaacaggcacggatcgagcctcaacatacccaattggaatgatggcatcagtgatgaattcagtacttcttcaagcatcactagaaaagataggtgtggagacacgagtccaaaccgcattgatgatgcaagaagttgcagaaccttacattaggcgtcgagccatacgccatcttgaaaaagggagggtggtcatctttggtgggattggtgcgggcactgggaatccattgttcacaacagatacagctgctgccttaagagcttcagagatcaatgcagatgttgtccttaaaggtattgttggtgatgatgaatctggttgtcctcctaggagcaacagtaatgcttcatttgagcacatctcctttagggagttagcagcaagaggaatcaccaaaatggacatgacagcagtaacatgttgtgaggagaacaacattcctgttgtcatctttaacatgttagagccgggtaacatctctagagcaatttgtggagatcaaataggcaccttagttgatcagtcaggaaggatcacataaaattaggaggattaatggtagcagagctccaggacatgccgatactctgggggacatcatggattctttgctcttggatcttttccggatagaagagaagcatgttcatcagatgggaagccttcaccttgatttgcctgcgatgcctgttgtgtattatgcgttgtggtcgcaattgccccacattgaaaaaagtatttagtttgtaatatctatttgtaattttgtctgtagattagtggaagagcttatgtaaagtggttcatgggtacccagatcagaatgtagtgttgtaagttgtaaggctattatttgagtcggtagtgtttgaggtatcaccttttgcaccattaatttgcctgtggctttccagcaatcaatctttttgtttgttc

SEQ ID NO: 1505 - DNA, 789 bp, Panicum virgatum
gacacgagtccagaccgcattgatgattcaagaagttgcagaaccatacgttaggcggcgagccatacgtcaccttgaaaaagggagggttgttatctttggtgggattggtgctggcatagggaatccacttttcacaacagatacagctgctgccttaagagcttctgaaatcaatgcagatgttgtccttaaaggtattgttggtgatgatgaatatggttgccctcctagaggcaatactaacacaccatttgagcacatttccttcagggagttagcagcaagaggattcagcagaatggacatgacagcagtaacgtgttgcgaggagaacaacattcctgttgtcatctttaatatgttagagcctggtaacatatccaaggcgatttgtggagatcaaataggcaccttagttgaccaatctggaaggatcacttaagattatgaggatttactctagcacaggttgaggacatgccaatactctggggaccatcatgcattctttgcttgcatgggtttatcgagtggtgcaaggtgttcatcagacggaagcctgcaccttgatttcgttcagatgcatgctgtgtattatgtgttgtgttagcaactatccacatttaaaaaaagtatttatcttgtaatacctatttgtaatgtggtctgtagattagtgggagggcttacgtaaagtggttcacgggcacccaaatcagaatgtagtgttgtaagttgtaacgctattggtcaatttgtagtgtttgagagatcctctcgcacgat

SEQ ID NO: 1506 - DNA, 2004 bp, Panicum virgatum
cccggaagcggagcccgccgcgcgtaaccctaacgccgccacgcgcggccatccatggcctcctgcgacgacgacttcggcctcctcggtgacgactcccaccagccggcagcttccccgctccagcccgccaccgccgcgctgcagcccgcggcggcggcgccgcccgcccaggccttctgcttcgccggcgcgaccgtggccgcgggcgccgccaccgccgccggcgccggctccttcgcgcaggcccaggaggagagcaaccaccacgccgagcgcggcaaggcggcgcaccacgccaagcgggccagggagcgccccgacgagttcagcagcgatgggggcgagtactgctcctacatcaacagcggcggcagcggcggcggtggcgaggggaagaagggccgcggtggcggggggagctcgggcgcatcggactaccgtaaggatcgggaggagtggacggacggcgccatcagcagcctcctcgacgcgtacacggaccgattcgagcagctcaaccgggggaacctgcgaggtcgggactgggaggacgtggccgccgccgtgaccgacgggcagggcaagactaccgggggcaagagcatcgagcaatgtaagaacaagatcgacaaccttaagaagcgctacaaggtggagtgccagcggctcgccagctccggcaccggcgccgtcagccactgggcctgggttcaagaagatggagcagatcgtcgggaactctgcgtctcctgcctcctccaaggcgcctgtcgtagtagaggatgaaaaaccgaggcagcagcagcagcacgccagcaaaaggtgtcctctttccagcgctggccctcttactgtggttggcagctccagagcaaattctctttcaaatccaagatggaagagggtgcttctgaagattgggggcactgcgttggcaggagcagctcctcaaaatgttgaccccaagattataatgctgattgctagagaagttcaagtggcatgccatcatggtgtggaggtggcaattgtggtaggagggcggaatatattctgtggtgacaattgggtagctgcaactggtactgatcgagcctcaacatacccaatcagaatgatggcatcagtaatgaattcggtacttcttcaagcatcactagaaaaaataggtgtggagacacgagtccagaccgcattgatgattcaagaagttgcagaaccatacgttaggcggcgagcaatacgtcaccttgaaaaagggagggttgttatctttggtgggattggtgctggcatagggaatccacttttcacaacagatacagctgctgccttaagagcttctgaaatcaatgcagatgttgtccttaaaggtattgttggtgatgatgaatatggttgcccccctagaggcaatagtaacacaccatttgagcacatttccttcagggagttagcagcaagaggattcagcagaatggacatgacagcagtaacgtgttgtgaggagaacaacattcctgtcgtcatctttaatatgttagagcctggtaacatatccagagcgatttgtggagatcaaataggcaccttagttgaccagtctggaaggatcacttaagattatgaggatttactctagcacagcttgaggacatgccaatactctggggaccatcatgcatttattgcttgcatggatttatcaagtggtgcaacgtgttcatcagacggaagcctgcaccttgatttctctcagatgcatgttgtgtattatgtgttgtgttagcaacttccacatttaaaaaagtatttatcttgtaatacctgttcgtaatgtggtctgtagattagtgggagggcttatgtaaaatagttcacgggtacgcaaatcagaatgtagtgctgtaagctgtaacgctattgttcaatttgtagtgtttgagagatcctctcgcacgattatttatttttcaatgataagatattatatgccaataa

SEQ ID NO: 1507 - DNA, 1627 bp, Triticum aestivum
  misc_feature (116)..(116): n is a, c, g, or t
  misc_feature (741)..(741): n is a, c, g, or t
  misc_feature (1562)..(1562): n is a, c, g, or t
ccacgcgtccggacggcgccatcagcagcctcctcgacgcatacatggaccggttcgagcagctcaaccgagggaatctccgggggcgggactgggaggacgtcgccgctgccgtnaccgacgggcaaggcaagagcagcgggggcaagagcgtggagcagtgtaagaataagatcgacaacctcaagaagcggtacaaggtagagtgccaacgcatcgccggctccgcctcggtcagcctctggccctggtacaagcagatggagcagattatgggcaactccccatcgcccggcacccccaagccgccgccggccaccaacgacgagaagccgcggcaacagcagcagcacagcaacaagaggtacccttcttccggcactggccacgctaccaccatggttccttattccagatccactcctctctcgaatccgaaatggaaacgggtacttctgaagattgggggcactgcattggctggagaagctcctcataatgttgaccctaaggtgatcatgctgattgccagagaagttcaagtggcatgccgccatggtgttgaggtggctattctcatgggaggtcggaatgtattctgcgctgactcttgggttgctgccacaggcaccgatagagcttcaacacatccgattggaatgatggcagcagtgatgaatgcagtattgctccaagcgtcactagaaaaaataggtgtggagacacgagtccagactgcantgatgatgcaagaggttgcagaaccatacataaggcggcgagctatacgccatctggaaaaaggaagggttgttatctttggtggaactggtgctggtacaggaaatccactttttacaacagatacagctgctgcactgagagcttctgaaatcaatgcagacgttgtccttaaaggtgtcattggagatgatgaatatggttgtcctcctaggagcaacggcagtgcaccatttgagcacatctcatttagggagttggcagcaagaggaaccagcaaaatggacatgacagcaattacatgttgtgaggagaacaatattcctgttgtcatctttaacatgttagagcctggtaacatgtccagagctatttgtggcgaccaagtaggtacgttagttgaccagtcaggaaggataacttaattcacaaggggggttaactttgttgtagcattgggacattcgtattctctcacggcagcgtgcatcttcgttgattgcatggatctttgtggatgggagagagggtaatgttcctcggagagaaggctcacaccttgatttgcatcgggtgcttgttgcgtgacatctgttgtagcggctctgccatgagaagttgtttgtttgtagtatctgtctgtaatgtgatggttagactagttgaagagcctttgtataaagtcgtatttatgcctgcgtatggcgttaggtcaggtcatcagaatgttgtattgtgctctagtagtaacttgtaacgctgttgttgagctgtagtgttgtactgtattggagaaaggcatttttcttccttccgtgctntaatgagtgatggctacccagcaagtgtgctgtgtgatgctgccatttctttttcacatcaaaca

SEQ ID NO: 1508 - DNA, 1588 bp, Brachypodium distachyon
tatacaccgtaccacctgacgagctcaagtggctcaaggctcgagaagcagagtgcgttcaacgtggtatatagtgagagagagacggtgatctttgctgagccagcagccatggcggggacgtcgttgccggcgtcggagaggccgccgcacgccgtgatgatcccgtacccggcgcagggccacgtgacgccgatgctgaagctcgccaagctgctccacgcccggggcttccacgtcaccttcgtcaacaacgagttcaaccaacgccgcctgcagcgcgcgcagggcggcggtcccggcgcgctcgacggcgcgcccggattccgcttcgccaccatcgacgacggcctccctcgctcggaccgcgacgcccagcaggacgtcccttcgctgtgccgctccaccatgaccacctgcctccccaggttcaaggcgctcatcgccaggctcaacgaagacgccgatggcgccgcgccgcccgtgacatgcgtcgtcggcgacagcaccatgaccttcgccctccgcgctgctaaggagctcggcctccgctgcgccacgctctggaccgccagcgcctgcggcttcatggggtacgcccactacaaggaccttgtccaacgtggtctcttccctctcaaagacgaggcgcagttgagcaatgggtacctggacacgacagtggactggataccggggttgccgaaggacctgcggctgcgggacttgccaagcttcgtgcgcagcaccgacccggacgacatcatgttcaacttcttcgtccacgagacggccggcatggcgcaggcgtccggggtggtcatcaacaccttcgacgagctggacgcgccgctgctgggcgccatgtcgaagctcctgccgccggtctacaccgtggggccgctccatctcacggtgcggaacaacgtgccagcggagagcccggtggccggcatcgactccagcctctggattcagcagcaggacgcgccgctccggtggctcgacggccgggcgccgggctccgtggtgtacgtcaacttcgggagcatcacggtgatgtcgaacgagcacctgctggagttcgcgtggggactggccaacaccggctacgccttcctctggaacgtgcggccggacctcgtccggggcgacgaggccgccctgccgccggagttctccgcggccacggcggggcggagcatgctgacgacgtggtgcccgcaggagaaggtgctggagcacgaggccgtgggggtgttcctcacgcactccggctggaactccacgctcgagagcatctgcggcggggtccccatggtttgctggccgttcttcgccgagcagcagaccaactgccggttcaagcgcacggagtggggaattggggtggaggtgcccgacgaggtgaggagagacgaggtggaggccatgatacgggaggccatggagggggagaaaggccgcgacatgcggcggcgcgtgctggagctccgggacagcgcgctggcctcggccaagcctggcggccgctccatgtgcaatgttgataggctcattcaggaagtgttgcttgcttgaagcagcc

SEQ ID NO: 1509 - DNA, 1445 bp, Brachypodium distachyon
ctgctccacgcccggggcttccacgtcaccttcgtcaacaacgagtacaaccaccgccgccttctgcggtcgcagggcgccgagatgctcaacagcgtgcccgggttccgcttcgaggccatcgccgacggcctcccgccgtccgacaacgaggacgccacgcaggacatcacctcgctctgctactccaccatgaccacctgcttccccaggttcaaggagctcatcctgaggctcaacaaggacgccgaggactccggcggcgcgctcccgccggtgacgtgcgtcatcggcgacagcgtcatgtctttcgccctcggcgtcgcgagggagctcggcatccgctgcgccacgctctggaccgccagcgcctgcggcttcatggcctactaccactacaaggaccttgctcaacgcggccttgttcctctcaaagacgagcagcaattgagcaatggatacttggacacaaccatcgactggataccaggtgtgcccaaggacctacgtttacgcgacttcccaagcttcgtgcgtacgaccgaccccaacgacatcatgttcaacttcttcatccacgagacggccggcatgtcgcaggcatccgcagtggtcatcaacacattcgacgagctggacgcaccgctactagatgctatgtccaagctgttgccaaaggtttacaccgttgggccgctccagctcacggtgcgcaacaacataccggaggagagccctattgtcagcattgggtctaatctctggaaggaacaggatgcgccgctccggtggctcgacagccgtccggcgggctccgttgtgtacgtcaacttcgggagcatcaccgtgatgtcgaaggagcacctgctggagtttgcttggggattggcaaacaccggctattcctttttatggaacgtgcggcctgacctcgtgaagggcgatgaagccgcgctaccgccagaatttttcaagctaacggaggggcggagcatgctgtcgacgtggtgtccacaagagaaggtactggaacatgaggccgtcggagtgttcctgacgcactctggatggaactcgacactggagagcatctcggcaggcgtgccgatggtttgttggcccttctttgccgagcagcagaccaactgccggtacaaatgcacggagtggggaattggaatggagattgatgacaatgtgcggagagtcgaggtagaggcgctgatacgagaggccatggaaggacagaaaggccaagagatgaagcgtcgcgtgctagacctcaaaaagagcgcggtggcctcggcgcagcccggtggaaggtccatgagcaatgtcgacaagttcatcgaagaggtgctgttgtagtttatttccccttcgtttgatatatgtgaggaaccatgggcgaaaataagttcaatgtaatatgtctcacatttact

SEQ ID NO: 1510 - DNA, 1589 bp, Brachypodium distachyon
gtgatgatcccgtacccggcgcagggccacgtgacgccgatgctgaagctcgccaagctgctccacgcccggggcttccacgtcaccttcgtcaacaacgagttcaaccaacgccgcctgcagcgcgcgcagggcggcggtcccggcgcgctcgacggcgcgcccggattccgcttcgccaccatcgacgacggcctccctcgctcggaccgcgacgcccagcaggacgtcccttcgctgtgccgctccaccatgaccacctgcctccccaggttcaaggcgctcatcgccaggctcaacgaagacgccgatggcgccgcgccgcccgtgacatgcgtcgtcggcgacagcaccatgaccttcgccctccgcgctgctaaggagctcggcctccgctgcgccacgctctggaccgccagcgcctgcggcttcatggggtacgcccactacaaggaccttgtccaacgtggtctcttccctctcaaaggtatatacgggcatatggcagaaaaaaatgagtaaacaaagaaattacccacttgagatcgatgatgaaagttccgttttgggtgcagacgaggcgcagttgagcaatgggtacctggacacgacagtggactggataccggggttgccgaaggacctgcggctgcgggacttgccaagcttcgtgcgcagcaccgacccggacgacatcatgttcaacttcttcgtccacgagacggccggcatggcgcaggcgtccggggtggtcatcaacaccttcgacgagctggacgcgccgctgctgggcgccatgtcgaagctcctgccgccggtctacaccgtggggccgctccatctcacggtgcggaacaacgtgccagcggagagcccggtggccggcatcgactccagcctctggattcagcagcaggacgcgccgctccggtggctcgacggccgggcgccgggctccgtggtgtacgtcaacttcgggagcatcacggtgatgtcgaacgagcacctgctggagttcgcgtggggactggccaacaccggctacgccttcctctggaacgtgcggccggacctcgtccggggcgacgaggccgccctgccgccggagttctccgcggccacggcggggcggagcatgctgacgacgtggtgcccgcaggagaaggtgctggagcacgaggccgtgggggtgttcctcacgcactccggctggaactccacgctcgagagcatctgcggcggggtccccatggtttgctggccgttcttcgccgagcagcagaccaactgccggttcaagcgcacggagtggggaattggggtggaggtgcccgacgaggtgaggagagacgaggtggaggccatgatacgggaggccatggagggggagaaaggccgcgacatgcggcggcgcgtgctggagctccgggacagcgcgctggcctcggccaagcctggcggccgctccatgtgcaatgttgataggctcattcaggaagtgttgcttgcttgaagcagccattgttgatgtcttctgatataaaacctcatcttgggttcgtggcgtaggcatgtgcaattaattggtg

SEQ ID NO: 1511 - DNA, 792 bp, Leymus cinereus x Leymus triticoides
  misc_feature (759)..(760): n is a, c, g, or t
  misc_feature (762)..(762): n is a, c, g, or t
caacctgtggaaggagcaggacgcacccctccggtggctcgacggctggccgccgcgctccgtggtgtatgtaaattttgggagcatcacggtgatgtccaaggagcatatgttggagttcgcgtgggggctggccaacaccggctacgccttcctgtggaacgtgcggcctgacctcgtcaagggcgacgacgaggtcgcactaccgccagagtttttcgcggcgaccgaggggcggagcatgctctcgacgtggtgcccgcaggagaaggttctggagcacgaggccgtaggggtcttcctcacgcactctgggtggaactcgtcgctggagggcatctgcggcggcgttccgatggtgtgttggcccttcttcgcggagcagcagaccaactgtcgttacaagtgcacggagtggggcattgggatggagattggggacgacgttaggaggaccgaggtggaggccctgatacgggaggccatggagggggagaagggtcgagagatgcgacgacgcgtgctggagctccgggagagcgccgtggcctctgcacgtcctggcgggaggtccatgcgcaatgttgataggctcatccacgaggtgttgctggcttgaaacaagcaaattaagatggtaaaaataaatggtctggagagtctgaagtgtttattaagacgtcaccaatccatctccattttcaattttcaagtcatagtttgagtggttagttacatggatcaccaattatttgttanngntggaaatacttggacatttgtggcattata

SEQ ID NO: 1512 - DNA, 1857 bp, Zea mays
gagcaaatcaccaattctagcaaggcagctcagcagcttttgtagcgagcttcttggagccttgaaatgagtagtagtggtagcctagccaccaccagtagcaagtaggcactataagcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcaccgccatcgacgacggtctcccgctctttgaagcggacgccacccaggacatccccgcgctctgccactccaccttgaccacctgcctgccccggtttaaggatctcatcgccaggattaacgccgaggctgaggccgagggacaacccaccgtgacatgcgtcgtcggcgacagcaccatgaccttcgcgctccgcgccgcgcgagagctcggcctccgctgcgctacactctggaccgccagcgcctgcggcttcatcggctacttccactaccgccacctcgtcgagcgtggtatggtccccctcaagaacgaggagcagctcacggacgggtacctagacaccatcgtcgactggatcccgggcgcgcccaaggacctgcggctccgggacttcccgagcttcgtgcgcaccacggatccgaacgacgtcatgctcaacttcttcatccacgagacggagggcatgtcgcaggcgtcggcggtggtcatcaacaccttcgacgagctcgacgcgacgctgctcgctgccatggcgaagctcctgccgcccatctacaccgtgggcccgctccagctgacggtgcggaacaacgtgcaggcgaacagtcctgtcgctgctattgggtccaacctgtggaaggagcaggaggcgccgctccggtggctcaacggccgtgcgccgcgctccgttgtgtatgtcaacttcgggagcatcacggtgatgtccaacgagcagctggtcgagttcgcgtgggggctggccaacaccggctactacttcctatggaacgtacgcccggacctcgtcaagagtggcgactccgccgggctgccgccagagttctcagctgcgacagagggacgaagcatgctgtctacgtggtgcccgcaggcagctgtgctggagcatgatgccgtgggggtgttcctgacgcactccgggtggaactccacgctggagagtatttgcggcggcgttcccatgctgtgctggcccttcttcgccgagcagcagaccaactgccgatacaagtgcaccgagtggggcatcggaaaagagatcggtgacgatgtacagcggggcgaggtagagtcgctcatacgggaggccatggagggggagaaagggcaagagatgctccggcgcgtgactgaactcagggacagcgccgtggccgctgcagggcctgacggacggtctatgcgcaacgtagacaggctcatcgaagaggtgctcctagcctagattgagcactggtgaacatcatagcagtcatgtgtcttcgcgtctggcactccaatcgattcaaatcctttgtgttttgatgtcaagcgtttactttcggtacccataaaagtattttctcgtacaaggtggtgattacacgcaaagcacattgttataagttcagtttgtaagatctatgggtaaaaccaagcgttttgtataattaaggaccgtttgagagggctacgactccttta

SEQ ID NO: 1513 - DNA, 1940 bp, Sorghum bicolor
aacaggcaacatcatagcataggcaaaaccaccaattctagcaaagccttggagcttggggtggtagccacaccagtagccagagcagtcatggggtcgctgccgacggaggagcgggagaggcgccagcagcagccgccgcacgtggtgatggtcccgtacccggcgcagggccatgtcacgccgatgctgcagctggccaagctactccacacgcgcggcttccacgtcaccttcgtcaacaacgagttcaaccaccgccgccacctgcgcgcgcgcgggcctggagcgctcgacggcgcgccggggttccgcttcgtcgccatcgacgacggccttccacgctccgacgccgacgccacgcaggacgtccccgcgctctgctactccaccatgaccacctgcctgccccggtttaaggacctcgtcgcccggaccaatgccgaggccgaggcccagggacggcccgccgtgacgtgcgtcgtcgccgacagcgtcatgaccttcgctctccgcggcgcgcgggagctcggcctccgctgcgccacgctctggaccgccagcgcctgcggcttcatcggctactactactaccgccacctcgtggagcggggcatcgtcccgctccagaacgaggcgcagctcaccgacgggtacctggacgacaccgtcgtcgactggatccccgacggcgcggcgcccaaggacctgcggctccgggacttcccgagcttcgtacgcaccacggacccggacgacatcatgctcaactacttcatccacgaggtggccgggatgtcgcaggcgtcggcggtggtcatcaacaccttcgacgagctcgacgcgacaccgctccacgccatggcgaagctcctgtcgcggccggtctacaccgtcggcccgctcccgctgacggtgcgaaacaacgtccccgcggacagccccgtcgcggccatcgcgtccaacctgtggaaggaggaggacgcgccgctccggtggctccacggccgcgcgccgcgctcggtcgtgtacgttaacttcgggagcatcacggtgatgtccaacgagcagctggccgagttcgcgtgggggctggccaacaccggctacgccttcctgtggaacgtgcgtccggacctcgtcaagggcggcggcggcggcggcgggctgccgtcggagttcgcggccgcgacggagggccggagcatgctgtcgacgtggtgcccgcaggcggcggtgctggagcacgatgccgtgggggtgttcttgacgcactccgggtggaactccacgctggagagcatctgcggcggcgtgcccatggtgtgctggcccttcttcgccgagcagcagaccaactgccggtacaagcgcaccgagtggggcatcgggatggagatcggcagcgacgtccggcggggcgaggtggaggcgctcatacgggaggccatggagggggagaaagggcgggagatgcgccggcgagtgacggagctcaaggaaagcgccgtggccgcggcgaggcccgacggacgatccatgcgcaacgtggacaggctcatcgacgaggtgctcctagcctgagcctgagcctgagcattcagcatcctccctgtggctctctttgttctccgtggacaggaactgtgctcctagctagcttgagcattcaacatcctccgatcatacggtatcatatccttgtttttattgtgaaagtggcaacgatgtcgttgcacatgggagtatatctctctcgatgttggaggtgattaacaaatcactaaagctaaatttggcaagagatctatagtagctaaatttggtaagagatctgtagtatgtaaggtcttattataaaattaagaacatggtgctcttgttcaatttattagggcttgtttatatacaatgatgactaactgatacagctagctaaa

SEQ ID NO: 1514 - DNA, 942 bp, Panicum virgatum
gcccgctcccgctgacggtgcggaacaacgttccggcggggagcccggtcgccgccatcgggtccaacctgtggaaggagcaggacgcgccgctccggtggctggacggccgcccgccgcgctccgtcgtgtacgtcaacttcgggagcatcacggtgatgtccaaggaggagctggccgagttcgcgtggggcctcgccggcaccggctacgccttcctctggaacgtgcgcccggacctcgtcaagggcggcggcgactcagccgggctgccgccggagttcgcggcggccacggagggccggagcatgctgtcgacgtggtgcccgcaggcggcggtgctggagcacgacgccgtgggggtgttcctcacgcactccggctggaactccacgctggagagcatctgcggcggcgtgcccatggtgtgctggcccttcttcgccgagcagcagaccaactgccgcttcaagtgcacagagtggggcatcgggatggagatcggcggcgacgtcaagcgcgtcgaggtggaggcgctcatccgggaggccatggaggggaagaaggggagggagatgcgccgccgcgtggccgagctcagggacagcgccgtggcggcggcgagccccggcggccggtccatgcgcaacgtcgacaggctcatcgacgaggtgctcctagcttgaacgctcatcaacacgctactgaacgttgccccgtgttcgttattggcctcttgttgattggcggctgccgcgctagcttgatatccattatctctgtgagctgaatgcgattgcgatatatcagtttgaggtgatagtgatataagtttgggttctttttggctcgaatttatacggagtttatgtgcttgtgctccacctcatgcaaatatatctagtttcttgtataattattaaagaaagtgttttgcatcct

SEQ ID NO: 1515 - DNA, 1660 bp, Triticum aestivum
cttgtgggtgagagagctaactgaagctgaagcaacagcaaggcgaagcaagctcgctagcaaggatggggtccttgccgccggcgggcgagaggccgcacgccgtgatgatgccgtacccggcgcagggccatgtgacgccgatgctgaagctggccaagctgctccacaccaggggcttccacatcaccttcgtcaacaacgagttcaaccacctccgcctgctgggcgcgcagcagtcgcaggccgccgtggacaggctctgcagcctgccggggttccgcttcgccaccatcgccgacggccttcctccgtccgacctcgaggcctcgcgggacacccccgccctgatctactccaccatgaccacctgccgtcccaggttcaaggagctcgtcgtcaagctcaacgaggaggctgaggcctccggtggcgccgtgccgcctgttacctgcgtggtggccgatagcatcacgagcttcgccattagcgtggcgcgtgagctcggcctccgctgcgccgtgctctggaccgccagcgcctgtggtttcatgggctactaccactacaaggatctactcgaccgtggactcgtccctctcaaagaataggctcagttgcgcaatggatacttggacacgatcatcgactggataccggcgatgcccaaggacctgcgggcttggcgttgacctcccgagctatttgcgcaccgtggaccctgacgacatcatgttcaacttcttcatccacgaggtacccgccatgtcgcaggcgtcggctgtggtcatcaacacctgggacgaactcgacgcgcccttgcttgatgccatgtccaagctcctgccgcccatctacacagcggggccactccatttgacggctcgcaacaatgtgccggaggagagccccgtctccggcattgggtccaacctgtggaaggagcaggacgctcccctccggtggctcgacggccggccgccgcgctccgtggtgcacgtcaatttcgggagcaccacggtgatgtccaaggagcatatgctggagttcgcgtgggggctcgccaacactggttacgccttcctatggaacgtgcggcctgaccttgtcaagggcgacgtcaaggccgcacttccgccggagttctatgcggcaactgaggggcggagcatgttgtcgacatggtgcccgcagcaggaggtgctggagcacgaggccgtaggggtgttcctcacgcactctggctggaactcgtcgctggagggcatctgcggcggcgtgccgatggtgtgctggcccttcttcgcggagcagcagaccaactgccgtttcaagtgtacggagtggggcatcgggatggagattggggacgacgtgaggaggaccgaggtggaggccatgatacgggaggccatggagggggagcaggggcgggagatgcggcgacgcgtgttggagcttcgccagagcgctgtggcctcctcacggcgtgacggaaggtccatgcgcaatgttgataggctcatcaaagaggtgcttctggcttgaaacaagcaaattaggctggtaaataaatgtttggcgagtctaaagcgtttattaagaagtaaccaatccctctccattttaaagcttcagtcatgttttgggtgataactta

SEQ ID NO: 1516 - DNA, 1109 bp, Pseudoroegneria spicata
gtcgcggaagaatctatatgttgtgagattcgaatgttggaggagaaactgaatataattgcatttggtgaaggaagagaagatctgatggcttcccgcagccaagccttgaagttcctacatgaaataggatggcttcttcaaaggagccacacacgagctacatcatctaaggctccacaacaacatcgacatcgtgttgtgggtattcctgctgcaagatttagatggctcctgtcctttgcggttgatcaggaatggtgcggcgtcttaaagctgctgctggacaccttgttccagggcaatatcgatgtcgcctcaccagttgagtttgtcctgggagagagcttagtattcgcagctgtcaacaagcggtcgaagcctttggttgccttcctattgagatacacaacgaaatctgcaccggtaggcagtggagccgtggccacaccagctcggttcttgttcacgcctgacatgactggtccatcggatattacacccctccatgttgcagctaccatcactaatgctgctgccgttttggatgctctaactgatgatccccaacagctggggatcaaaacctggaagaatgcccgcgatgctaccgggtacactccagaggattacgctcggcggagagggcacacgtcctacatccagatggtccagaacaaaatcaacagcaggttacttgcggcccatgtgtctgtttccatgaccagcactggtatcgccgaagagcatgcagacgcaggtcggccgaaatcaactgatcagaccgtatttgatgtcgagaaaagcccaccgggatgcagacaatgtgtccagctccagcacattgcctaccgtccctgcccaaacaggttcttgtcgaacaggcctgcggtgctatccttggtcgccattgctgctgtctgtgtctgcgtagggttgataatgcagagcccgccggtcgtccgcggtttgccgggcccttttctctggaatcgcatccgttggggacccacttgaaacggccactggtctgcaggttctgctatagtctgtgtactcgagagtgaggatgcttgggaattgtgatattaaagtgcaaattctgtaca

SEQ ID NO: 1517 - DNA, 1097 bp, Triticum aestivum
  misc_feature (734)..(734): n is a, c, g, or t
  misc_feature (788)..(788): n is a, c, g, or t
tgccggatctgatggcttctcgcagccgggccttaaagtttctacatgaaatagggtggcttctccaaaggagccacacacgagctacatcatccaaggctccgcaacaacatcatgcggtgggcttttctgctgcaagatttaggtggctcctgtcctttgcggttgatcaggaatggtgcggcgtggtaaagatgctgctggacaccttgttccagggcaatatcgatgtcgcctcaccagttgattttgtcctgggagagagcttagtattcgcagctgtcaacaagcggtcgaagcctttggttgcctgcctattgagatacacaacgaaatctgcaccggtgggcagtggagccgtggccacaccagctcggttcttgttcacgcctgacatgactggttcatcggatattacacctctccatgttgcagctaccatcactaatgctgctgccgttttggatgctctaactgatgatccccaacagctggggatcaaaacctggaagaatgcccgcgacgctaccgggtacactccagaggattacgctcggaggagaggacacacgtcctacatcaagatggtcgagaacaaaatcaacagcaggttacctgcagcccatgtgtccgttgccatgaccaccactggcatcgccgaaaagcacacagatgacggtcggccgagatcaactgaacagaccgtatttgatgtcgagaaaagcccaccgggntgcagacaatgtgtccagctccagcacattgcctaccggccctgcccaaacagnttcttgtcgaacaggctcgcggtgctatccttggtcgccattgccgctgtctgtgtctgcgtagggttgataatgcagagcccgccggtcatccgcggtttgccgggcccttttctctggaatcacatccgttggggacccacttgaaatggccagtcggctgcaggttctgctatagtctgtgtactcgagagtgaggatgcttgtaaattgtgatagaccaaagtgcaaattctgtacattatatgagttgtggagtgcctaactctgcttaggtagcgctagttttattgcatattcaccgttttc

SEQ ID NO: 1518 - DNA, 2008 bp, Brachypodium distachyon
actccgcggcggccggcgcgatgcccgccgcggcgctcgccttcgcttccaccttcgctccgccccagccgtgggtcccacggaggccgcatcctcgccacgcccgcctccgtctgccccctccaaggagcggcggtggcgacaacaacaagcccaccacctcgtgggtcagtcccgactggctcacgtcgctgtcccgctcgctggtcggcaggggaggcggcggtggagacggctcggggatccccgtcgcgtccgccaagctcgacgacgtgcgggacctcctcgggggcgcgctcttcctcccgctcttcaagtggttccgcgaggaagggcccgtctaccgcctcgctgcgggtccgcgcgacttcgtaatcgtcagcgaccccgcagtcgccaagcacgtcctccgcgggtacggcacgcggtacgagaaggggctcgtcgccgaggtctccgagttcctgtttggctccgggttcgccatcgccgagggagcgctctggacggtgagacgaagagcagttgtaccatctttacacaaaagatttatctcagtgatggttgaaaaagtattttgtaaatgtgctgagagattagtggagaaactcgaaacatatgctttgagtagtgaacctgttaatatggaagcaaggttttctcaaatgactttagatgtgattggtttgtccttgttcaactacaattttgattccctcacatcagatagtcctgttattgatgctgtttatactgcactcaaagaagcagaggctcgctcaacagatcttttaccatactggcagattgatttactgcgcaagatagttcctagacagataaaagcagaaaaggcagttaacataataaggaataccgttgaagaactgattacgaagtgcaagacaattgtagatgctgaaaatgaacagattgagggtgatgaatatgtaaacgaggcagatcctagcatcttgcgctttttacttgcgagccgtgaagaggtcaacagttcgcagttacgtgatgatctgttgtcaatgttagttgctggtcatgaaacaacaggttctgtcctgacatggactgtttatcttctgagtaaggatccagcagcgctaaggagagctcaggatgaggtagatcgtgttctacaaggtagactccccagatatgaagatgtaaaagagctgaagtacttgatgcgctgtataaatgagtctatgaggctatacccacacccccctgtgctgatacggcgtgcaatagttgatgatgttcttcctggaaactacaaggttaaggcaggtcaagatataatgatttcagtgtacaatatacacagatcacctgaggtatgggacagagcggatgaatttgttccagagagatttgatctggagggaccagttccaaatgagtcaaacactgatttcaggtttgtccctttcagcggaggtcctcgaaaatgtgttggagatcagtttgctcttttagaagcaattgtggcacttgcagttgtcttgcagaagattgacattcagcttgtggctgatcaagaaatcaacatgaccactggggccacgattcatacaaccaatggcttgtatatgaatgttagtctgcgtagagttgagcaggaacctgagttagcactgagtgactcgcgatagatgaaataacttttaaccagataagcaaaacagggtgagatcagtacatgcagcggttacagaattcccaatatgttgtaggtatatcgtctggcttacagattctgaaaactgtaaagaaatggatcacttgcttgttgatctttccagttgcagaggagattctgaaaactgtaaagaaatggatcacttgcttttggtgcaaccaatgtgcgttagcaccaccactataatttttttgtcgcattgacccaatatgtacctatcacaccctaaaatttcaaacttggaaatatacacattgagttaaaaaaaaacagacaaattttgctgtg

SEQ ID NO: 1519 - DNA, 2052 bp, Zea mays
cctctcaggctctcacaccaatccccactctccctccttccgtaattgcgtctctcaccacctcggcaactccaatcccaaacggccacaccctagctggtctggtggcatcggccggcacacggcgatgcctgccacggtcttcgcctccccctccatcgccgcgtcgccgtcgccgtcgctgtctccgtggtccccacgtccgcctcctcgtcgcgtccacgtccgtgtccgcgtccgcccgcccccgccgagaagcggaagcagcgggggcgacgagccctctactgccaccccgtgggcgagccccgactggctcacgtctctctcgcgcgcggtcggccggagcggcggcgacgactcggggatccccgtcgcgtccgccaagctcgatgatgtgcgggacctcctcggcggcgcgctcttcctgccgctcttcaagtggttccgcgaggaagggcccgtgtaccgccttgccgcggggccacaggactttgtcatcgtcagcgaccccgccgtcgccaggcacgtgctgcgtgggtacggctcgcgctacgctaagggactagtcgctgaagtctccgagttcctcttcggctccggcttcgccatcgcagaaggcgacttatggacggtgcgttctctgtctctcttcctgctctatgcttagttcagtgactttcttagttacttactagtgagacgcagagctgttgtgccttccctgcacaaaagatttctgtccattatcgtggacaaggtattttgtaaatgtgctgagagactaatagacaaacttgagccatatgctttgagtggggaacctgtcaatatggaagcgaggttttctcagttgacattggatgtgattggtttatcattgttcaactacaattttgattccctcacaacagatagtcctgtcattgatgctgtttatactgcactcaaagaagcagagcttcgttctacagatcttttgccatactggaaggttggtttcttgtgcaagataatcccaagacagataaaagcagagaatgcggttatgattataaggaacactgttgaagagctgattatgaagtgtaaagaaatagtggaagctgaaaatgaacagattgagggtgaggaatatgtaaacgaaggggatcctagcattctacgcttcctacttgctagccgagatgaggtaagcagtgtacaattacgtgatgatctcttgtcaatgttagttgctggtcatgaaacaacaggctctgtactgacgtggacaatctatcttctcagtaaggatccgactgcactgaggagagctcaagatgaagtagatcgtgttctacaaggtagactacccaaatatgaggatgtaaaggagctgaagtacttgatgcgctgtataaatgagtctatgcggctgtatccacaccctcctgtgctgttacggcgtgcaatagttgatgatgttcttcctggaaactataaggttaaggctggtcaagatattatgatatctgtgtacaatatacacaggtccccagaggtttgggatagagcagatgagttcattccagagaggtttgatttagagggacctgttccaaatgagtcaaacacagatttcaggtttattccattcagtgggggtcctcggaaatgtgttggagatcaatttgctctcctagaagcaatagtggcacttgcagttgtgttgcagaagatggatatgcagcttgtgccagatcaaaagattaacatgactactggagctacaattcatacaaccagtggactatatatgaatgtaagcctgcgtaaagttcagcaagaagctgagttagcgctgagcgaatcgaaatagatggaaacaacttcagacaagaatagagcacctgaactggatacaatcatacaaatatgaaatatgcttctccagtttctcgttgaaagctctactgtactatactagatgtcaatgcgtcggcatacagattacagattcgcttctcttgaaacatgaaaggatccttcgctggctgattcgtttggcta

SEQ ID NO: 1520 - DNA, 2069 bp, Oryza sativa
actgccaactgctcatctcgtctcgtctctctctccccccaatccggcgaccccaattccccaaaatccatctcgaatccctagctcgcgggcggccagtgcgatggccgccgccgccgccgccgccgtcccgtgcgtaccattcctgtgcccgcctcctccgccattggtctcgccgcgtctccgccgtggccacgtccgcctccgcctgcggccgccaaggagcagcggcggtggaggcggaggcggagcggggggagacgagccgcccatcaccacctcgtgggtgagccccgactggctcacggcgctctcccgctcggtggcaacccgcctcggcgggggcgacgactcggggatccccgtcgcctccgccaagctcgacgacgtgcgggacctcctcggcggcgcgctcttcctccctctcttcaagtggttccgcgaggaaggccccgtctaccgcctcgcggcggggccgcgggatctcgtcgtcgtcagcgatcccgccgttgccaggcacgtgctgcgtgggtacggttcgaggtacgagaaggggctcgtcgccgaggtttccgagttcctcttcggctccgggttcgccatcgccgagggcgctctctggacggtgagacgtcgatcagttgtaccatctctacacaaacgatttctctcggtgatggttgacagagttttttgtaaatgtgctgagagattagtggagaagcttgagacatctgctttaagtggcaaacctgtaaatatggaagcaaggttctctcaaatgactttagatgtgattggtttgtccttgttcaattacaattttgattccctcacatcagatagccctgttattgatgctgtttacactgcactcaaggaagcagaacttcgttctacagatcttttaccatactggaagattgatttgctgtgcaagattgttcctagacaaataaaagcagaaaaggcagttaacatcatcaggaataccgttgaggacctaattaccaaatgcaagaagattgtagatgctgagaatgaacaaattgagggtgaggaatatgtaaatgaggcagaccctagcatcctgcgattcctacttgctagccgtgaagaggtaaccagtgtgcagttacgtgatgatctattgtcaatgttagttgctggtcatgaaacaacaggctctgtactgacgtggactatttatcttctcagtaaggatccagcagcgctgaggagagctcaagcagaggttgaccgtgttctacaaggtagactccccagatatgaagatctaaaagagctgaagtacttgatgcgctgtataaatgagtctatgcggctttatccacacccacctgtgttgatacggcgagccatagttgatgatgtgcttcccggaaactataagatcaaagctggtcaagatattatgatttcagtgtacaatatacacaggtcacctgaggtttgggacagagctgatgattttattcctgagagatttgatttagagggacctgttccaaatgagacaaacactgaatacagatttatcccattcagtggaggtcctcggaaatgtgttggagatcagtttgctctcttggaagcaattgtggcacttgctgttgtgttgcagaagatggacattgagcttgtgccagatcaaaaaattaacatgactactggggccacaattcatacaaccaatggcctgtatatgaatgtaagtctgcgtaaagttgacagggaacctgattttgcactcagtgggtccagatgaacggaaggaaacagcttcaaagcagaaaagcaaaagatgtacatcgacacacatgagatgtggtaaatatcggcgtacaggttgacgaagctcgaaagcatggatataattcgtttattgtttatggatatacgttgtatgcttatatatccccgagaatctggtccgcaatgcccgttctatagcgtagaaagccgatatttaagaggcccaattgcgtgaacaatttcatcaagagaaagttaggcgcatagaactttcggccacaaaaggcctatat

SEQ ID NO: 1521 - DNA, 2038 bp, Sorghum bicolor
ctctccctcctccgtgttccgtctctccccacctcctcggcaactccaatcccaaacggccaaaccctacctggtctgctctggccgcatcggccggcgcgcggcgatgcctgccaccgccttcgcctccgcctccgtcgccgcgtcgccgtctccgtggtcgccgcgtccgcctcctcgccgcggccacgtccgggtccgcgcgccgccgccgagaagcggaagcagcgcgggcgggggcgggggcgacgagccctccaccgccacaccgtgggcgagccccgactggctcacgtcactctcgcgcgcggtcggccggagcggcggcggcgacgactccgggatccccgtcgcgtccgccaagctcgacgacgtgcgggacctcctcggcggcgcgctcttcctgccgctcttcaagtggttccgcgaggaagggcccgtctaccgcctcgccgcggggccacaggacttcgtcatcgtcagcgaccccgccgtcgccaggcacgtgctgcgcggctacggctcgcgctacgccaagggactagtcgccgaagtctccgagttcctcttcggctccggattcgccatcgcggagggcgacctatggacggtgagacgcagagctgttgtgccttccctgcacaaaagatttctgtccattatcgtggaaaaagtgttttgtaaatgtgctgagagattaatagagaaacttgagccatatgcttcgagtggggaacctgtcaatatggaagcgaggttttctcagttgacattggatgtgattggtctgtcattgttcaactacaattttgattccctcacaacagatagtcctgtcattgatgctgtgtatactgcactcaaagaagcagagcttcgttctacagatcttttgccatactggaagattgatttcttgtgcaagataattccaagacagataaaagcagagaatgcagttaggattataagaaacactgtcgaagagctgattatgaagtgtaaagaaatagtggaagctgaaaatgaacagattgagggtgaggaatatgtaaatgagggggatcctagcattctgcgcttcctacttgctagccgagatgaggtaagcagtgtacagttacgtgatgatctcttgtcaatgttagttgctggtcatgaaacaacaggctctgtactgacatggacaatctatcttctcagtaaggatccgactgcactgaggagagctcaagatgaagtagatcgtgttctacaaggtagactccccaaatatgaggatgtaaaggagctgaagtacttgatgcgctgtataaatgagtctatgcggctgtatccacaccctcctgtgctgttacggcgtgcaatagtcgatgatgttcttcctggaaactataaggttaaggctggtcaagatattatgatatctgtgtacaatatacacaggtccccagaggtctgggatagagcagatgagttcattccagagaggtttgatttagagggacctgttccaaatgagtcaaacacagattacaggtttattccattcagtggaggtcctcggaaatgtgttggagatcaatttgctctcctagaagcaatagtggcacttgcagttgtgttgcagaagattgatattcagcttgtgccagatcaaaagattaacatgactactggagctacaattcatacaacaaatggactatatatgaatgtaagcctgcgtaaagttcagcaagaagctgagttagcactgagtgaatcgaaatagatggaaacgacttcaaaccagactagagagcacctgcactggctacagaattgtcaagatgtgaaatactgtatgcttctccagtttctagttagaaagctctactacagtactatactaaatgtcactgcgtcggcgtacagattagctattacagattcggctgcttaaaacttaggtcctggtggtaatctaaggccgaacagattcatatattggtgagcagcatgccaaatctaccagtcattcaacaatgttttttct

SEQ ID NO: 1522 - DNA, 2175 bp, Triticum aestivum
  misc_feature (641)..(641): n is a, c, g, or t
  misc_feature (704)..(704): n is a, c, g, or t
  misc_feature (746)..(746): n is a, c, g, or t
  misc_feature (1139)..(1139): n is a, c, g, or t
  misc_feature (1145)..(1145): n is a, c, g, or t
  misc_feature (1163)..(1163): n is a, c, g, or t
  misc_feature (1205)..(1205): n is a, c, g, or t
  misc_feature (1505)..(1505): n is a, c, g, or t
ctcttctctcttctctctgtcacacaccttcactactgctctcacccaaatccaacccaaattaacagtagcccgcggcggcctgcgcgtgagcgatgcccgccgcggcattcgcctccgcgttcgcgtctcctcctcctccgtgggccccacgaccgcctcctcgccacgccagcctccgcctgcccccgccaaggagcagcagcaacaacagcggcggcggcggaggggacaagcccaccacctcgtgggtcagccccgactggctgacgtcgctgtctcgctcggtgctcggccgggggaacgacgactcggggatacccgtcgcctccgccaagctcgacgacgtgcaggacctcctcgggggcgcgctcttcctgccgctcttcaagtggttccgcgaggaagggcccgtctaccgcctcgccgcggggccgcgcgacttcgtcatcgtcagcgaccccgccgtagccaagcacgtcctccgcgggtacggcacgcggtacgagaaggggctcgtcgccgaggtctccgagttcctctttggctctgggttcgccatcgccgagggagcgctctggacggtgagacgtagagcagttgtaccatctctacacaaaagatttctctcagtaatggtngataaagtgttctgtaaatgtgctgagagattggtggaaaagctcgagacttatgctttgagnggtgaacctgttaatatggaagcgaggttttcgcaaatgacnttagatgtgattggtttatccttgttcaactacaactttgattccctcacatcagatagtcctgttattgatgctgtttacactgcactcaaagaagctgaggctcgttctacagatcttttaccatactggcagatcgatttgctgtgcaagattgttcctagacagataaaagcggaaaaagcagttaacacaataaggaataccgttgaagagctaattacaaaatgcaaggcaatcgtagatgctgaaaatgaacagattgagggtgaagaatatgtaaatgaggcagatcctagcatcctgcggtttttacttgctagccgtgaagaggtcagcagtttgcagttacgtgatgatctattgtcaatgttagttgctggtcatgaaacnacaggntctgtactgacatggacnatttatcttctcagtaagggtccagtagcactaaggaaagcncaagaagaggtagatcgtgttctacaaggtagactccccagatatgaagatgtaaaagagctgaagtacttgatgcgctgtatcaatgagtccatgcggctatacccacatcctcctgtgctgatacggcgtgcactagttgatgatgtgcttcctggaaactacaaggttaagactggtcaagatattatgatttctgtgtacaatatacacagatcacccgaggtatgggacagagcagatgaattcattccagagagatttgatttggagggtcccattccaaatgagtcaaacacngatttcaggtttatccctttcagtggaggtcctcgaaaatgtgttggagatcagtttgctcttttagaagcaattgtggcacttgcaattgtcatacaaaagatggacattcagcttgtggcagatcaaaaaatcagcatgaccactggggccactatccatacaaccaatggactgtatatgaatgtaagtctgcgtaaagttgagcaagaagctgacttagcactgagtccatcgggctagacaaaagcaaagcaaaacagggtgggattagtacaggcagaggcaacagaattgtcaatacgtgagatgcctctgcaattaaatttggacatgtttggaatgtttccttgtccagaaatttgagatacctctcttcagttcttgtatcttttcagcaggttccagctatcattggctaataggttgcgtaaactgtaaagaaatggatcattgacttgctgattttgacagttaatgtaaatcggtagtaccttgtctgtttgtatggtttccttttccagcagagtatgcgtgggctgggaaaaacttgttgagttgttcttcgtcgaaggtccattagtgctcggataggagctagtgcaggtaatatagccctgccgaggcttagagcatctcaagagcaggtaccaaatttgagcctccattg

SEQ ID NO: 1523 - DNA, 2396 bp, Brachypodium distachyon
gtagctatctaccgtgcaccaatggtggtcgtcttctccccgactccccgcctcagccaaatcccaaacccaaccgccgcgcagatccccgaaaatccccaatcctaatcaccgccgccgttcggattaatcccccccaattcgattcagctcgatgcggttagcagcgctgtagcagatcccccctcccccgcgagctagggttagggtttccaggggtttgagctagggtttgggcccgccgcgatgggccggtctcgcggagtgcccaatcctggcgacgacgacaccaaccacaggtcgaagcggaggagggttgcatcgagcggcgatgcgacggattccctttctgcggcgtgcggtggagcaggcgacgggaagaaggcgctgtaccactgcaactactgtaacaaggacctctctgggaagatccggttcaagtgctccaagtgcccggatttcgacctctgtgttgagtgcttctctgttggcgccgaggtccaaccgcatcgaagcaaccacccctacagggtcatggacaacttgtcttttccactcatttgtccagattggaatgcagatgaggaaatccttcttctagagggaattgaaatgtatggtctaggaaattgggctgaggttgcagagcatgttggtaccaagggcaaggctcaatgcattgaacattatacaactgcatatatgaactcaccttgttatccccttccggacatgtctcatgttaatggcaagaataggaaggaacttcttgccatggctaaagtacagggtgagagtaaaaaagggatatcagtgttaccaggggattcgactcccaaggacgagtctccattttctccctccagggtcaaggtggaagatgcacctggagaaggtccagccggtcgatcaccttcacacatagctggcggtgctaataagaaggcttcaactgctggccattttaaagatagtgctaatttggctaaaatggaagatggccatatggatagaagtattggtgtaaaaaagcccagatattctgcagatgaagggccttctttgactgaactgagtggatacaacgcaaagagacatgagtttgacccggaatatgataatgatgctgaacaagcactcgcggaaatggaatttaaagaaactgattcagaaactgatcgtgaactgaagctacgggttctgcgtatttacttgtcaaggcttgatgaaagaaaaaggagaaaagagttcatactagaaagaaatttactgtaccctaatcctttggagaaggatctgacaaatgaagacaaggaagtttaccaccgctacaaggtcttcatgcgtttcctttcgaaggaggaacatgaagcccttgtcaggagtgtcattgaagaaagaaaaattcggaggaggattcaagagcttcaggaatgtcgttctgctggatgccgtacattggctgaagccaagatacacatagagcaaaagaggagaaaggagtacgaggcgaatgcccacaaagctaaggaaagtggccaacttattccaactactaaagtagtacacaaaacaaatcgccctatgaaacttgaatctgatgggaatctcgatccaaagaaaagcaatgctactgtagattctggcggtcgggattctcccaaagcaacgggacatacagtcgctaaacaatgggatgattgggacattgttggtcttcctggggcagagctattaagcgccagtgaaaaacttctatgctgccaaaacagattgctacctagtcattatctgagaatgcaggaggtattgatgcaggagatgttcaagggcagtgtcgtcaaaagggaagatgcccatgtattattcaaggtagaccctgccaaagtagatactgtttatgatatggtgatgaaaaagctcggtagcaatgaggaggctccaactgtttagttttgccaatgggtttgcctggtgtaaacttcccccaaaaccaaatcttggtttctcattcgcagcatgaccgagactctgtgtaaaaatggaggctatacttacagttaacttggctgtagtgttaaattgaaatttgtgtcagatttctgaagaagcacaataaggcattcgagccaaattgtaaaattatcgcccgcaatgggaatgtgtagcatgagttaccattgctgttcaatttttaagaggatagttgccatcgctgagtgtactgtggtgatctgttagtgcctttgttgtaggtttaggttctgaaatgatgtatcatgtatgtaaacattcgtcctattttatgccattgttccaagaccagacattaattattaaagctccctgccaattttttgcgagtgttcatattcaagaatgtatatttatgctga

SEQ ID NO: 1524 - DNA, 2388 bp, Zea mays
ctgacctccgcctgctcgccctctctctctcgatggtcgtcttctccacgagaccacgaccgatcaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctagggtttgggcgcacgatggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttacaaagtcatggacaacctgtctttcccacttatttgcccagattggaatgcagacgaagaaattctcctccttgagggaattgaaatgtatggtctgggaaactggcttgaagttgcagagcatgttggtaccaagtctaagttacagtgtattgatcattacacaacagcatacatgaactcaccttgttatcccctaccggatatgtctcatgttaatggcaagaacaggaaggagcttctagctatggctaaagtgcagggtgaaagtaaaaaagggacttcactgttgcctggagagctgactcctaaggctgaatctccattttctccctccagggtcaaggtggaagatgcacttggagaaggtctagcaggtcgatcaccttcgcacatagctgttggtgcaaataaaaaagcttcaaatgtgggacatattaaagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatgaaagaaaaaggagaaaagagttcatattggaaaggaatttattgtttcctaatcccttggagaaggatcttacaaatgaagacagggaagtttaccatcggtataaggtcttcatgcgttttctttccaaggaggaacatgaagcccttgttaggagtgtcattgaagagcgaaaaattcggaggagaattcaagaactccaggaatgtcgttctgctggatgccgcacacttgctgaagcaaagatacacatagagcaaaagaggaaaaaagaatacgagctgaatgcccaaaaagctaaggaaagtaaccaccttattgcaaatactaaattggtgcagaagatgaatcgacctatgaagattgagtctgatgggaatttggatccaaagaaaggtggtgttggcttagattctcctaaaactacaggacttacaagtgttaagcagtgggatgactgggatatagttggtcttcctggggcggagctattaagtgctagcgaaaagcttctatgttgccagaacagactgctacccagtcattacctgagaatgcaggaggtgctgatgcaggagatattcaagggtagtgtcctaaagaaggaagacgcacacgtcttgtttaaggttgatcctaccaaagtagatagtgtttatgatatggtaacaaaaaagctgggcaaccatgtggagttgcctacggtctagcttatgcctttgggcttgcctgctgtgacatgccgaagaaaacaagtcttggtttcgccccttgcagcgtgtctgaaccatagctgaaggtggaactgtactagatcaaatcggccatagttaactgaaattcgtatcagttgtcagaagcacaataaggcattccagccaagttgtaaaattattgcccttagcagaatgtgtagcgtgagttgtcatttcctttctgccattgttgtgcactgtttcagctgtggtagtgccttgtagtaggtataggtgcctgagtttatatgtatcatcgtgtatgtaccattgggagctcaattatatgccattgtaccaaccccagacattgattattacaattcatctagcagccagattcttgtctctaatggaatgcatggcgtcaatatattttttt

SEQ ID NO: 1525 - DNA, 2427 bp, Zea mays
ccattgatgtgtgcatctaatgagaaaaaggttcctgtcctgcaccgccttgtcctagacccgagtggacccgagtggctgagtccacctctgatgctctgacctccgcctcctcctttctctcgtcgtcgtctccacgacacctcaaccccaatcagaacccggacccagatctctaaaaaatccccaatcccaatctgccgtacgccgttgcgatcatacctccaaatccgcccccaagtctgttcgatgcgaatagcacctgcgatttagcgaaccgtgcgctcgctaggtttagggtttcgagggtttgcgttagggtttgggcgcacgatggggcggtcgcgaggggtgctgagttccggcgacgacgacaccgggcacaggtcgaagcggaggagagtctcgtcgggcggggatgcgacggactccatttcagcctccatcgggggagctggagagggagggggcaagaaggcgctctatcactgcaactactgcaacaaggacatctccgggaagatacggatcaagtgctccaagtgccctgacttcgacctttgcgtggagtgtttctctgtcggcgctgaagtcaccccgcaccgcagcaaccatccttacaaagtcatggacaacttgtctttcccacttatttgcccggattggaatgcagatgaagaaattctcctccttgagggaattgaaatgtatggtctgggaaactggcttgaagttgcagagcatgttggtaccaagtctaagttacagtgtattgatcattacacatcagcatacatgaactcaccttgttatcccctcccggatatgtctcatgttaatggcaagaataggaaggaacttctagctatggctaaagtacagggtgagagtaaaaaagggactttgctgttacctggagaactcactcctaaggttgaatctcaattttctccctccagggtcaaggtggaagatgcacttggagaaggtccagcaggtcgatcaccttcacacatggctgttggtgcaaataaaaaagcttcaaatgtgggacatattaaggatggcgctactgtatcaaaagtcgaagatgttcatgtagatagaagtgttggtgtgaagaagcccagatattctgcagatgaaggcccttcgttgactgaactgagtggatacaatgcaaagagacatgagtttgacccagaatacgataatgatgccgaacaagctcttgctgagatggaatttaaagaaactgattcggaaactgatcgtgaactgaaactccgtgtgctgcgtatttacctctccaggcttgatgaaagaaaaagaagaaaggagttcatattggaaagaaatttgttgttccctaatcccttggagaaggatcttacgagtgaagacagggaactttaccatcgctataaagtcttcatgcgttttctttctaaggaggaacatgaagccctcgttaggagtgttattgaggagcgaaaaattcggaggagaattcaagaactccaggaatgccgttctgctggatgccgcacactggctgaagcaaagatacacatagagcaaaagaggaaaaaagaatacgagctgaatgcgcaaaaagctaaggatagcagtcaacttaatgcaaataataaatcagtacaaaagatgaatcgacctatgaaaattgagtccgatgggaatttggatccaaagaaaggtggtgctggcttggattctcctaagacaacaggacctacaagtgttaagcagtgggatgactgggatatagttggtcttcctggggcagagctattaagtgctagcgaaaagcttctatgctgtcagaacagattgctacccagccattacctgagaatgcaggaggtgctgatgcaggagatattcaagggtagcgtcctaaagaaggaagacgcccacgtcttatttaaggtcgatcctaccaaagtagatagtgtttatgatatggtatctaaaaaactgggcaaccatgaggaggccccaaccgtctagcttacgcttttgagcttgcctgctgtgacatgccgaaggaaacaaatcttggtctggcccttcgcagcgtgtctgaatcagggctgaaggtggtggaaccatactaaatcgaatcggccatagttagctgaaattcatatcagctgtcagtagcacagtaaggcattcccgccaagctgtaaaattattgccccgacgagaatgtgtagcatgaatttgaatttcttttctgctattgctgtgtactgttgcagggtagtgccttattgtagtatatgtataggtgcctgagttttatgtatcatcgtgtatgtaccatttgggcgctctatttatgccattgtaccaaccccaaacatcgattattataattcatctcgcagccaaattcttgtc

SEQ ID NO: 1526 - DNA, 1596 bp, Pennisetum glaucum
tatggctaaagtgcagggtgacagtaaaaaagggactacgctgttatctggcgaattgactcctaaggctgaatctccattttctccctccagggtcaagatggaagaagcacttggcgatggtactgcaggtcgatctccttcgcacatggctggtgcaggtgcaaataaaaaggcttcaaatgctggacagaataaagatggtgctaacatatcaaaagttgaagtgccagatggtcatgtcgatagaagtattggtgtgaagaagcccagatattctgcagatgaaggcccttctttgactgagctgagtggatacaatgcaaagcgacatgagtttgacccagagtatgataatgatgccgaacaagcgcttgctgagatggaatttaaagaaactgactcggaaactgatcgtgaactgaaactccgtgtgctgcgtatttacttgtccaggcttgatgaaaggaaaaggagaaaagagttcatattggaaagaaatctgttattccctaatcccttggagaaagatcttacaaatgaagacaaggaagtttaccatcgctacaaggtcttcatgcggtttctttccaaggaggaacacgaagcccttattaggagtgttatcgaagagcgaaaaattcggaggagaatccaagagcttcaggaatgtcgttccgctggatgccgtacactagctgaagcaaaaatacacatagagcaaaagaggaaaagggaatacgagctaaatgcccaaaaaactaaggaaagtggccaacttattccaaataacaaatcagtacaaaagatgaatcgacctgtgaaaattgagtcggatgggaatttggatccaaagaaaggtggtgctggcttagattctcctaaaaccacaggacttacaagtgtgaagcagtgggatgattgggatatagttggtcttcctggggcagaactattaagcgctagcgaaaagcttctatgttgtcagaatcgattactgcccagtcattatctgagaatgcaggaggtgctgatgcaagagatatttaagggtagtgtacacaagaaagaagatgcccatgtcttatttaaggttgatcccaccaaagtagatactgtttatgatatggtaacaaaaaagctgggcaaccatgaggaggctccgactgtctagatatgcttgacttgcccaaaaaaccaaatcttggtttctcctccgaaccatagctgaaggtggaggctgtagtaaaattgagtcaaccatagttaaacctgaaattcgtgtcattgtctgaagcgcaataaggcattcctgccaaaatgtaaaattatcgtgccaacgagaatgtgtagcatgagttgccattgcagtttccttgaggataggtgccattgttgagagtttactgttgcagatgtgctagcgccttgttgtaggtatagggcctgagtttatgtatcatcatgtatgtaacattatcgccctattttttattccattgtaccgatatctgaggttaatttttacaattccatctttgcagccaaattgtttcttgtctgtactgggatgctttgcgcctttatcctgctcgt

SEQ ID NO: 1527 - DNA, 960 bp, Pseudoroegneria spicata
  misc_feature (4)..(6): n is a, c, g, or t
gcgnnncctttccaggaggaacatgaagcccttgttaggagtgttattgaagagcgaaaaatccggaggaggattcaagagcttcaggaatgtcgttcagctgggtgccgtacgctggctgaagccaagatacacatagagcaaaagaggaggaaggagtatgaggcgaatgccctgaaagccaaggaaagtggccagcttatctcaaatactaaatcaggacacaaaacaaatcgtcctatgaaacttgagactgatgggagtttggatcttaagaaaggcagtgccattttggatgcgggtggcagggattctccaaaaaccacaggacctacaagcgctaagcaatgggatgattgggacattgttggtcttcctggggcagagctattaagctccagtgaaaaacttctgtgctgtcagaacagattgctacctagttattatctgagaatgcaggaggtgttgatgcaggagatgttcaagggcaatgtcgtcaagaaggaagatgcccgtgtattgtttaaagtcgatcctgccaaagtcgatacggtttacgatatggtgacgaaaaagctgggtaacaacgaggaggccccaatggtttagctatgcaatttgggttctgcctgctctaggcttcgcccaaaaccaaatcttggtttctcagcacgagaggcccaggtgagaatggaggctatacttgacttggctgtagcagtgttacgttgaaatttgtgtcagatttctgaagaagtgcaataaggcattcgagccaaattgtaaaattacccggcagtgggaatgtgtagcgtgagttgttgccattgctgttcaattttaaagaggagatagacgccattactgaaagtgtactgtgatgatgtgatagtgcctttgttgtaggtttaggggactcagatgatgtaccatgtatgtaaacatttgtccattttatta

SEQ ID NO: 1528 - DNA, 2453 bp, Oryza sativa
ctcccccgctttcctctccgtgtcgcgatctgcgatggtcgtctcgtccgcgacaccccggccccaattccaacacgcgtgcccagcagccgcagatctctctccaaattccccaatccaaatccgccctcgcctcgccccgatcgatcccctcgattcgattcgatcccgcccgatgcgagtggaggcggcggcggcggcggcggaggccgtggcggcgtgcgcgcgagcttagggtttctagggtttgcgctagggtttgggggcgcgcccgcgatgggccggtctcgcggggtgcccaattccggcgacgatgaaacgaaccacaggtcgaagcggaggagggtcgcgtcgagcggcgatgcgccggactcgctctcggcggcctgcgggggagccggagagggtggtgggaagaaggcgctgtaccactgcaactactgcaataaggatatttccgggaagatccggatcaagtgctccaagtgccccgacttcgacctctgcgtcgagtgcttctcggtcggcgccgaggtcaccccgcaccgcagcaaccatccttacagggtcatggacaacctgtctttccctcttatttgtccagattggaatgcagacgaggaaatccttcttctagagggaattgaaatgtatggtctgggaaattgggctgaagttgcggagcatgttggcaccaagaccaaggcacaatgcattgatcattatacaactgcatacatgaactcaccttgttatccccttccggatatgtctcatgttaacggtaagaacaggaaggaattgcttgctatggctaaagtacaaggcgagagtaaaaaaggaacttcagtgttaccaggggatttgacccctaaggacgagtctccattttctcccccaagggtcaaggtggaagatgcacttggagaaggtttagctggtcgatcaccttcacacatagctgggggtgcaaataagaaagcatcaaatgttggacaattcaaagatggtgctaatgtagcaaaagttgaagatggtcatgtggatagaagtataggtgtgaaaaaaccccgatattctgcagatgaagggccttctttgactgaactgagtggatacaattcaaagagacatgaatttgacccagagtatgataacgatgctgaacaggcactcgctgagatggagtttaaagaaactgattcggaaactgatcgtgaactgaagctaagggtattgcgtatttacttgtcaaggcttgatgaaagaaaaaggagaaaagagttcatactggaaagaaacttactatttcctaatcctttggagaaggatctcacaaatgaagacaaggaagtttaccatcgctataaggtgttcatgcgtttcctttctaaggaggaacatgaagcacttgttaggagtgttcttgaggaacggaaaattcgaaggaggattcaagagcttcaggaatgtcgttctgctggatgccgtacattggctgaagcaaagattcacatagagcaaaagaggaaaaaggaacatgaggtgaatgcccaaaaagctaaggaaagtggtcagctcttatccaacactaaagtggtgcataagacgaatcgacctatgaaaatcgagtcagatggtaatttggatcagaagaaaggtggtgccagcttggattctactggcagggattctccaaaaaccacagggcatgcaggcactaaacattgggatgactgggatattgttggttttcctggggcagagctattaagcaccagtgaaaaaaatctatgctgtcagaacagattgctacccaaccattacctgaaaatgcaggaggttttgatgcaggaaatattcaagggtagtgtcgccaagaaggaagatgcccatgtattatttaaggttgaccctgccaaagtagataacgtttatgatatggtgacgaaaaagttgggtaccaatgaggaggccccgactgtttagccatgtttttgagttcctcaatcagcgcgtggtttctgatttgcagcatgactactgagacagctaaaatggaggctatacttgaattaaattggctgtagttgaaatttgtgtgaggtgtctgaagaagcacaataaggcatttcagccaaattgtaaaattatcgccccgattggaatgtgtagcatgagtttaccataccattactctccattttaagaggatggtttgccctcgttcgaagtgtaacgtgtaacgtgttgcagagccactaaaagggccttgacagtatagtgcctgaaatgatgtatgtaaacattgccacctttttcatatgtgacatcgttccgataccagacgctatttaattgttgtatttcactgcctaagaggtttcctttgtgtttattcgatgttacacactgtatgttaacatagtttgttgcgatccattgcctgcgtc

SEQ ID NO: 1529 - DNA, 2342 bp, Sorghum bicolor
gagtccacctctgaggctttgacctcctcctcctctctctctcgatggtcgtcttctccacgacacctcaaccccaatcggaacccggacccagatctccgaaaaatccccaataacaatctgcggtccgccgttgtgattacaccttccaatccgatcccaagtctgttcgatgcgaatagcagcggcgatttagcgaaccgcgcgttcgctagggttagggtttcgagggtttgcgctagggtttgggcgcaggatggggcggtcgagaggggtgccgaattccggtgacgatgacaccggacacaggtcgaagcggaggagggtctcggggtcgggcggggacgcgacggactccatttcagccgccatcgggggagctggagagggagggggcaagaaggcgctctaccactgcaactactgcaacaaggacatctccgggaagatacggatcaaatgctccaagtgccctgacttcgacctctgcgtggagtgcttctctgttggcgctgaagttaccccacaccgcagcaaccatccatacagagtcatggacaacctgtctttcccacttatttgcccagactggaatgcagatgaagaaattctcctccttgagggaattgaaatgtatggtctgggaaactggcttgaagtggcagaacatgttggtaccaagtctaagttacagtgtattgatcattacacaacagcatacatgaactcaccttgttatcccctcccggatatgtctcatgttaatggcaagaacaggaaggagcttctagctatggctaaagtgcagggtgagagtaaaaaagggacttcactgttatctggagaactgactcctaaggctgaatctccattttctccctccagggtcaaggtggaagatgcacttggagaaggtccagcaggtcgatcaccttcacacatagctgttggtgcaaataaaaaggcttcaaatgtgggacagattaaagatggtgctaatgtgtcaaaaatcgaagatggtcatgtcgatagaagcgttggtgtgaagaagcccagatattctgcagatgaaggcccttcgttgactgaactgagtggatacaatgcaaagagacatgagtttgacccagagtatgataatgatgccgaacaagcgcttgctgagatggaatttaaagaaactgattcggaaaccgatcgtgaactgaaactccgtgttcttcgtatttatctgtccaggcttgaagaaagaaaaaggagaaaggagttcatattggaaagaaatttattgttccctaatcccttggagaaagatcttacaaatgaagacagggaagtttaccatcgctataaggtcttcatgcgttttctttccaaggaggaacatgaagccctcattaggagtgtcattgaggagcgaaaaattcggaggagaattcaagaactccaggaatgtcgctctgctgggtgccgcacactggctgaagcaaagatacacatagaacaaaagaggaaaaaagaatacgagctgaatgcccaaaaagctaaggagagcagccttattgcaaataataaatcggtacagaagatgaatcgatctatgaaaattgagtctgatgggaatttggatccaaagaaaggtggtgctggcttggattctcctaaaactacaggacttacaagtgttaagcagtgggatgactgggatatagttggtcttcctggggcagagctattaagtgctagcgaaaagcttctatgttgtcagaacagattgctacctagtcattaccttagaatgcaggaggtgttgatgcaggagatattcaagggtagtgtcttaaagaaggaagatgcccatgtcttatttaaggttgatcctaccaaagtagatagtgtttatgatatggtaacgaaaaagctgggcaaccatgaggaggctccaactgtctagcttatgcttttgagcttgcctgctgtgacatgccgaagaaaacaaatcttggtttcgccccctttgcagcgcatctgaaccatagctgaaggtggaactgtactaaatcgaattggccatagtttacagaaattcatatcagttgtcagaagcacaataaggcattccagccaagttgtaaaattattcccgcccgaccagaatgtgtagcatgagttattcatttctgttctgccattgtcgtgtactgttgcagttgtggtagtgccttgttgtagtaggtataggtgcctgagtttatatgtatcatcgtgtatgtaccattggtcgctctattttatgccattgtaccaaccccagacattgattattacaattcatcttgcag

SEQ ID NO: 1530 - DNA, 2361 bp, Saccharum officinarum
cataagccacaggctccgacctccgccgccgccaccacctcctcctcctcctctctctctctctcgatggtcgtcttctccacgacacctcaaccccaatcggaacccggacccagatctccgaaaaatccccaatcccaatcttccctccgccgttgcgatcataccccacaatccgagcccaagtctgcttgatgggaatagcagcggcgatttagcgaaccgcgcgttcgctagggttagggtttcgagggtttgcgctagggtttgggcgcacgatggggcggtcgcgaggggtgccgaattccggcgacgacgacaccggacacaggtcgaaacggaggagggtctcgtcgggcggggatgcgacggactccatttcagccgccatcgggggagctggagagggagggggcaagaaggcgctctaccactgcaactactgcaacaaggacatctccgggaagatacggatcaaatgctccaagtgccctgacttcgacctctgcgtggagtgcttctctgtcggcgctgaagttaccccacaccgcagcaaccatccttacagagtcatggacaacctgtctttcccacttatttgcccggattggaatgcagatgaagaaattctcctccttgagggaattgaaatgtatggtctgggaaactggcttgaagttgcagagcatgttggtaccaagtctaagttacagtgcattgatcattacacaacagcatacatgaactcaccttgttatcccctcccggatatgtctcatgttaatggcaagaacaggaaggagcttctagctatggctaaagtgcagggtgagactaaaaaagggacttcgttgttacctggagaactgactcctaaggctgaatctccattttctccctccagggtcaagatggaagatgcacttggagaaggtctagcaagtcgatcaccttcgcacatagctgttggtgcaaataaaaaagcttcaaatgtgggacagattaaagatggtgctaatgtatcaaaagtcgaagatggtcatgtcgatagaagtgttggtgtgaagaagcccagatattctgcagatgaaggcccttcgttgactgaactgagtggatacaatgcaaagagacacgagtttgacccagagtatgataatgatgctgaacaagcgcttgctgagatggaatttaaagaaactgattcggaaaccgatcgtgaactgaaactccgtgtgctgcatatttatctgtccaggcttgaggaaagaaaaaggagaaaggagttcatattggaaaggaatttattgttccctaatcccttggagaaagatcttacaaatgaagatagggaagtttaccatcgctataaggtcttcatgcgttttctttccaaggaggaacatgaagccctcattaggagtgtcattgaggagcgaaaaattcggaggagaattcaagaactccaggaatgtcgttctgctggatgccgcacgctggctgaagcaaagatacacatagagcaaaagaggaaaaaagaatacgagctgaatgctcaaaaagctaaagaaagcagccatcttattgcaaataataaattggtacaaaagatgaatcgacctatgaaaattgagtctgatgggaatttggatccaaagaaaggtggcgctggcttagattctcctaaaactacaggacttacaagtgttaagcagtgggatgactgggatatagttggtcttcctggggcagagctattaagtgctagcgaaaagcttctatgttgtcagaacagattgctacccagtcattacctgagaatgcaggaggtgctgatgcaggagatattcaagggtagtgtcctaaagaaggaagacgcccatgtcttatttaaggttgatcctaccaaagtagatagtgtttatgatatggtaacgaaaaagctgggcaaccatgaggaggctccaactgtctagcttatgcttttgagcttgcctgctgtgacatgccgaagaaaacaaatcttggttttgcctttgcagcgcgtctgaactgtagccgaaggtggaactatactaaatcgaatcggccataggtaacagaaattcgtatcagttgtcagaagcacaataaggcattccagccaagttgtaaaattattgccccgacgagaatgtgtagcctgagtttttcattcttgttctgccattgttgtgtactgttgcagttgtggtagtgccttgtagtaggtataggtgcctgagtttatatgtatcatcgtgtatgtaccattggccgctctattttatgccactgtaccaaccccagacattggttattattacaatttatcttgcagcc

SEQ ID NO: 1531 - DNA, 1578 bp, Panicum virgatum
aagaacaggaaggaacttcttgctatggctaaagtgcagggtgagagtaaaaaagggacttcgctgttacgtggtgaactgacccctaaggctgaatctccattttctccctccagggtcaagctggaagatgcacttggagatggtccagcaggtcgatccccttctcacatggctggtggtgcaaataaaaaagcttcaaacgctggacagattaaagatagttctaacgtatcaaaagttgaagatggtcatgttgatagaagtattggtgtgaagaagcccagatattctgcagatgaaggcccttcattgactgaattgagtggatacaattcaaagagacatgagtttgacccagagtatgataatgatgctgaacaagcgcttgctgagatggaatttaaagaaactgattctgaaactgatcgtgaactgaaactgcgtgtgctgcgtatttacttgtccaggcttgatgaaagaaaaaggagaaaagagttcatattggaaagaaatttattattccctaatcccttggagaaagatcttacaaatgaagacaaggaagtttatcatcgctataaggtatttatgcgttttctttccaaggaggaacatgaagcccttgttaggagtgtcattgaggagcgaaaaattcggaggagaattcaagagcttcaggaatgtcgttctgctggatgccgtacattggctgaagcaaagatacacatagagcaaaagaggaaaagggaatacgagttaaattcccaaaaatctaaggaaagtggccagcttattccaaataataaatcagtacaaaagatgaatcgacctatgaaaattgaatctgatgggaatttggatccaaagaaaggtggcactggcttagattctcctaaaaccactggacttgcaagtgttaagcaatgggatgactgggatatagttggtcttcctggggcagagcttttaagcgctagtgaaaagctgctatgttgtcagaaccgattgctaccaagtcattacctgagaatgcaggaggtgctaatgcaggagatatttaaagataatggcctcaagaaagaagatgcccgtgtcttatttaaggttgatcctagcaaagtagatacggtttatgatatggtaacgaaaaagcttggtaaccatgaggaggctccaactgtctagcttatgctgttgagcagcctgcctgatgtgacttgccaacaaatcaagtcttagttttgccctttgcaaccatagcttaaggtggaggctgtaattgaatctaccatagttaaaactgaaattcgtgtccattgtctgaagcacaataaggcattccagccaaattgtaaaattatggtgcggccgataatgtgtagtatgagttgccattgcagagggtagttgccattgttgagtgtactgttgaggatgtgctagtgccttgttgtaggtatagggcctgagtttatgtatcatcatgtatgtaacatttcctgccctattttatgccattgtaccaatcagacatggattattacaattcatcttgcagcgtatttgttgtgtctg

SEQ ID NO: 1532 - DNA, 1011 bp, Triticum aestivum
  misc_feature (66)..(66): n is a, c, g, or t
  misc_feature (180)..(180): n is a, c, g, or t
  misc_feature (267)..(267): n is a, c, g, or t
  misc_feature (290)..(290): n is a, c, g, or t
caaggcttttcatgcgtttcctttccaaggaggaacatgaagccctgcttaggagtgttattgaanagcgaaaaatccggaggaggattcaagagcttcaggaatgtcgttcagctggatgccgtacgctggctgaagccaagatacacatagagcaaaagaggagtaaaggagtatgancgcgaatgctctgaaagccagatggaaagtggccagcttatttcaaatagtaaatcaggacacaaaacaaatcgtcctatgaaactngagactgatgggagtttgatctnaagaaaggcagtgccattttggatgctggtggcagggattctccaaaaaccacaggacctacaagcgctaagcaatgggatgattgggacattgttggtcttcctggggcagagctattaagctccagtgaaaaacttctgtgctgtcagaacagattgctacctagtcattatctgagaatgcaggaggtgctgatgcaggagatgttcaagggcaatgtcgtcaagaaggaagatgcccatgtattgtttaaagtcgatcctgccaaagtcgatacggtttatgatatggtgatgaaaaagctgggcaacaacgaggaggctccgatggtttagctatgcaatttgggttctgcctgctctaggcttggcccagaaccaaatcatggtttctcagcacgacggaggcccaggtgagaatggaggctatacttacatgacttggctgtagcagtggtacattgagatttgtgtcagatttctggagaagtgcaataaggcattcgagccaaattgtaaaattacccggcagtgggaatgtgtagcgtgagttgttgccattgctgttcgattttaaagaggagatagacgccattgttgctgaaaatgtactgtgatgatgatgtgatagtgcctttgttgtaggtttaggggactgagatgatgtaccatgtatgtaaacatttgtccattttatttatgatattgcggattcatgtgc

SEQ ID NO: 1533 - DNA, 754 bp, Leymus cinereus x Leymus triticoides
  misc_feature (740)..(743): n is a, c, g, or t
acccgccgggcccactgctgtcgtgggcgcggcttgccacatcagacgtccacgtaggtgggttacttgtccccgccgggaccactgccatggtcaacatgtgggccataacccacgacccaaccgtgtgggccaagccgacggagttcaagccagaacggttcctcgccgggccatcgtcggaccacgccgccgccgagttctctgtaacgggttccgatctcaggctcgcgccgttcgggtcaggcaggcggagctgccccggcaagtcactcgcgatcgccaccgtcggattctgggttgccacgctgctgcacgagttcgagtggacgccgccgtcgtctgacggaccaggtggcgtggacctgtctgaggtgctgaggctgtcgtgtgagatggcagctccgctggaggcaaggctgaggccgaggcgtgctgtgtgatgacgtgtctgggccatgcgggcagggtagaagttggcctcttcttcgttactactatcagtgcgtgtagtgtagtggtaatgtagtgtcccgctttggaaatgtacctgctactacaataggtccggtcctggtacatgtactgctgtcctttactgttctttagctgggtagtagatgtttaattaggtttttatgaactactatcaggaggtgagtgacagttttcttgtgcttccgtttgctgcctagagatgtacttctactatgtaaaaatatttatcgtaatgcaagtannnngttgtattgta

SEQ ID NO: 1534 - DNA, 961 bp, Triticum aestivum
  misc_feature (4)..(4): n is a, c, g, or t
  misc_feature (24)..(24): n is a, c, g, or t
  misc_feature (33)..(34): n is a, c, g, or t
  misc_feature (54)..(54): n is a, c, g, or t
  misc_feature (60)..(60): n is a, c, g, or t
  misc_feature (73)..(73): n is a, c, g, or t
  misc_feature (76)..(76): n is a, c, g, or t
  misc_feature (80)..(80): n is a, c, g, or t
  misc_feature (146)..(146): n is a, c, g, or t
  misc_feature (167)..(168): n is a, c, g, or t
  misc_feature (174)..(174): n is a, c, g, or t
  misc_feature (204)..(204): n is a, c, g, or t
  misc_feature (240)..(240): n is a, c, g, or t
  misc_feature (263)..(263): n is a, c, g, or t
  misc_feature (267)..(267): n is a, c, g, or t
  misc_feature (686)..(686): n is a, c, g, or t
  misc_feature (688)..(688): n is a, c, g, or t
  misc_feature (691)..(691): n is a, c, g, or t
  misc_feature (841)..(841): n is a, c, g, or t
gganatgatctttgtggcaccganaccgtggcnntggtatcgaatgggtgctgncccggntgtgctgcaccangangtgnaggcgagggtccacgaggagctggaccgggtggtcgggccgaaccgggccgtgaccgagtcggacnccgcctcgctcgtcttctccnngccgtngtcaaggaggtcctgcgccttcacccaccnggcccactgctgtcgtgggcgcggcttgccacgtcngacgtccacgtagatgggttacntgtncccgcggggaccactgccatggtcaacatgtgggccataacccacgacccagccgtgtgggacaagccggcggagttcaagccagaacggttcctcgccgggccatcgtcggaccacgccgccgccggcgctgagttctctgtaacgggttccgatctcaggctcgcgccgttcgggtcgggcaggcggagctgccccggcaagtcgctcgcgatcgccaccgttggattctgggttgccacgctgctgcacgagttcgagtggacgccgccgtcgtccgacgggccaggtggcgtggacctgtctgaggtgctgaggctgtcgtgtgagatggcagctccgctggaggcaaggctgaggccgaggcgtgctgtgtgatgacgtggctgggccatgcgggcagggtagacgttggcctntnctnctctactactatcagtgcgtgtagtgtagtggtaatgtagtgtcccgctttggaaatgtacctgctactacaataggtccggtcctggtacgtgtactgctgtcctttactgttcttagcagggtagatgtttaattacgtagttatganctactatcaggaagtgagtgtgacagttttcttgtgcttccggtttgctgcctagagatgtactacaagttcctatgtaaaaatatttattttaatgcaagtatcccttgtgttagagtt

SEQ ID NO: 1535 - DNA, 1861 bp, Brachypodium distachyon
acttgcattaatcgcaccccatgtccatgcaacaaccgacgtgtaccacccttcccggcgccatgtcgctgatcctcacggccgccgtggcgttagccgtggccgcggccgtggtgcggtacaatcggaaatacaggggcctgaggctccctcccggcccgccgggctggcccatcgtcgggaacctcttccaggtggccttctcgggcaagctcttcatccactacatccgcgacctgcgccgcgagtacgggcccatcctgacgctccggatgggcgtccgcaccctcgtggtcatcagcagcgccgagctcgcccacgaggccctggtccagaagggccaggagttcgcgagcaggcccgccgagaacgctacccgcaacatcttctcctccaacaagttcaccgtgaactcggctgtctacggcgccgagtggcgttccctgcgccggaacatggtgtccgggatgctgagcacgtcgcggctccgcgagttccgccccgccaggcgccgcgccatggaccggttcgtgtcccggatgcgcgccgaggccgacgccggggatgactccgtgtgggtgctccgcaacgcgcggttcgcggtgttctgcatcctgctggacatgaccttcgggctgctggacctggacgaggcccacatcctgcggatcgacgccgtcatgaagcgcgtgctgctcgccacgggtgtgcgcatggacgactacctcccgttcctccgccccttcttccgccgccagcagagacgcgcgctggacgtccggcgcgagcaggtggacacgctgctgccgctcatcaaccgtcgccgcgccatcctccgggacagggacacgcgtccggcggaccctgacgtggccgcgcccttctcctacctggactctctcctggacctccggatcgagggccgggacggcgtggcctcggacgacgagctcgtcacgctctgcgcggagctcatcaacggcggcaccgacaccacggccacggccatcgagtgggccatggcgcgcatcgtggacaacccgtccatccaggcccggctccacgaggagatcatgcagcaagtcggcgacactcggcccgtggacgagaaggacacggacggcatgccgtatctccaggccttcgtgaaggagctgctccggaagcacccgcccacgtacttctcgctcacccacgccgcggtgaagcccgggagcaagctggccgggtacgacgtgcccgcggacgcgaacctggacatcttcctgccgggcatctccgaggatcccaagctgtgggacaggcccgcggagttcgacccggacaggttcctgtccggcggcgagacggcggacatgacggggtccgcgggcatccggatgataccgttcggggccgggaggaggatctgccccggattgtccatggggacgacgcacatcgcgctcatggtggcgcggatgctgcaggcgttcgagtggcaagcgcacccgtcgcagccaaagctcgacttcaaggacaaggtggagttcaccgtcgtcatggaacagccgctgctcgccatggtcacgccccggaagatcttcttctgatatgatcgatccccatcgcgcgcgcacacgcacaacgtgcacccctgctttccgttagatcgatcatcagcacgtacgtaagctacgtgcacacaagtgttacgtatagtagttaatagctgtacgtacgtttatacggttatgtacgtgtgccagaggcaatactaggcagatgcatatgcatgcatcgacaattacgatcgctctcgagtttgtatgattttgaagtagaactattatatactgctaagtacgtatttggttgtcga

SEQ ID NO: 1536 - DNA, 1978 bp, Zea mays
aaccaactcatgctcgacagaccacctcgtcggggcttcgcatttatcgtgccgtccatgtccatgcaagagccgacgagcgccgccacccagcttcacgccgcgatggaagcgtcattgtcgctctcgtcactgcagctcgccttcacggcggtcgcggcgatcgcggcgctgggcgtcgcggtgaccgtcacgaggtacaaccggagatacatgggcctgaggctgcctccgggcccgcccgggtggcccgtcgtcggcaacctcttccaggtggcgttctccggcaagctcttcatccactacatccgcgagctccgcaaggagtacggccccatcctgacgctgcgcatgggggagcgcacgctcgtgatcatcagcagcgccgagctcgcgcacgaggcgctggtggagaaagggcgggagttcgcgagccggccccgggagaacaccacgcgcaacatcttctcgtccaacaagctcaccgtgaactccgcggtgtacgggcccgagtggcggtcgctgcgccggaacatggtgtccgggatgctgagcacgtcgcggctcagggagttccggcacgcccggaggcgcgccatggaccggttcgtgtcgcggatgcgcgccgaggccgcggcgtcgcccgacggcgcgtccgtctgggtgctccgcaacgcgcgcttcgccgtgttctgcatcctgctggacatgaccttcggcctgctggacctccgcgaggagcacatcgtgcgcatcgacgccgtcatgaagcgcgtgctgctcgccgtcggcgtgcgcatggacgactacctcccgttcctccgcccgttcttctggcggcaccagcgccgtgccctcgccgtccgccgcgagcagatcgacaccctgctcccgctcatcaacaggcggcgcgcaatgcttcgcgacatgcagcagaggcagagctcatcgccgccgcccgaccccagcgtcgcggcgcccttctcgtacctcgactccgtgctcgacctccgcatcgagggccgcgacgacggcgcgctcaccgacgacgagctggtgacgctctgcgcggagctgttgaatggcggcaccgacaccacggccaccgcgatcgagtggggcatggcgcgcatcgtggacagcccgtccatccaggcacggctccacgaggaggtcatgcagcaggtcggcgacgcgcggccggtcgacgacaaggacaccgacgccatgccgtacctccaggccttcgtgaaggagctgctccggaagcacccgcccacgtacttctcgctcacccacgccgctgtgcagccgggatgcaagctcgccggctacgacgtgcccgtggacgcgaacctggacatcttcctcccgaccatctccgaggacccaaagctgtgggaccggccgacggagttcgacccggacaggttcgtgtccggcggcgagacggcggacatgacggggtcggcggggatccggatgatcccgttcggcgcggggcggaggatctgccctgggcttgccatggggacgacgcacatcgccctgatggtggcgcggatggtgcaggcgttcgagtggcgcgcgcacccgtcgcagccgcagctggacttcaaggacaaggtggagttcacggtggtgatggatcggccgctgctggccgcagtgaagccgcgaaacctcgcgttctgatcggacgggcggacggacgcgcgcatgcatggctacagtgtgcgcgtgtcaggtagcgtggcagtacgacatcgctcgtacgtgtgctctgcacgcccagctgcaccacgcatcgccgtttggccatgcatgcatgcatgctagccgcccatgagttgtggatgccactactgtcgtgtactcgtgtctgtatgatgtaacatacacggaaatgctagacgtcgtttgcatgtgtgtgtggatgtgtacgtactacgtatataagaatgaactcttttgtgta

SEQ ID NO: 1537 - DNA, 2110 bp, Sorghum bicolor
catttactccgcccccgcgtcaccggagcgctatatctagggcggcagcgcggcactgacttctccaaccaactcatgctccacagaccaccgcagttatcgtggcgtccatgcccatgcaacagccgacgagcgtcgttcacgccgcgatggaagaagcgtcactgtcgtcgctctcgttcctgcagctcgccttcacggcggttgcggcgaccgccgcgctggccctcgccgtggccgtcaccaggtacaaccggaggtacaccggcctgcggctgcctcctggccctcccgggtggcccgtcgtcggcaacctcttccaggtggccttctccggcaagctcttcatccactacatccgcgacctccgcaaggagtacggccccatcctgacgctgcgcatgggggagcgcacgctcgtcatcatcagcagcgccgagctcgcgcacgaggcgctggtggagaaagggcgcgagttcgcgagccggccccgggagaacacgacgcgcaacatcttctcctccaacaagttcaccgtcaactccgcggtgtacggcgccgagtggcggtcgctgcgccggaacatggtgtccgggatgctcagcacgtcgcggctcagggagttcgcgcacgccaggcggcgcgccatggaccggttcgtgtcgcggatgcgcgccgaggccgccgcgtcgcccgacggcgggtccgtctgggtgctccgcaacgcgcgcttcgccgtcttctgcatcctgctcgacatgaccttcggcctgctggacctccacgaggagcacatcgtgcgcatcgacgccgtcatgaagcgcgtgctgctcgccgtcggcgtgcgcatggacgactacctcccgttcctccgccccttcttctggcgccaccagcgacgtgcgctcgccgtccgccgcgagcagatcgacacgctgctcccgctcatcagcaggcgccgcgccatcctccgcgacatgcagcagcggagctcctcgccgtcgccgccaccggaccccaacgtcgccgcgccattctcgtacctcgactccgtgctcgacctccacatcgagggccgcgacggtgcgcccaccgacgacgagctggtcacgctctgcgcggagcttatcaacggcggcaccgacacgacggcgacggcgatcgagtggggcatggcgcgcatcgtcgacaacccgtccatccaggcacggctccacgaggagatcatgcagcaggtcggcgacgcgcggccggtggacgacaaggacaccgacgccatgccctacctacaggccttcgtcaaggagctcctccggaagcacccgcccacgtacttctcgctcacccacgccgccgtgcagccggggagcaagctcgccggctacgacgtgcccgtggacgcgaacctggacatcttcctcccggccatctccgaggacccgaagctgtgggaccggccgacggagttcgacccggacaggttcctgtccggcggcgagacggcggacatgacggggtcgggcggtatccggatgatcccgttcggcgcggggcggaggatctgccccgggctcgccatggggacgacgcacatcgcgctgatggtggcgcggatggtgcaggcgttcgagtggcgcgcgcacccgtcgcagccgccgctggacttcaaggacaaggtggagttcacggtggtgatggaccggccgctgctcgccgcagtgaagccccgaaacctctccttctgatgatggaacgcgtacgtacgtgttcggtgttcccatggctacgtacggtgtgcgtgcgcttgccaacgcatgtcagctagcgtggtggtacgacgtcgagcgtacgtgtgcaggcggccgacccaactgcacatgctgacatgcacgatgtatcgcgcgccgtgtggccatgctagtcgtcgttcatgagttgtgaacgcgccaccatattgtcgtgtactcgtgtgcacgatatgatgtagcatatatataaatgtatacgcggaaatgctagacgtttgcatgtgtgggcgtgtacgtagtagttcacgatgtataagaatgaactcttttgcgaatttgaatgtgccatcagttgaccacca

SEQ ID NO: 1538 - DNA, 2099 bp, Panicum virgatum
ggcggcactggcttctccaaccaactcgggcagtgcttgatcgtcgaccacctcgtcggggcctcgcgcatttatttatccccacgtccgtgtccatgcaacagccgacgagccgcgccaccaccgccgccggccagcttcttcacgccgccgcgatggaggaagcggcctcgttgctctccgtcctgcagctcgccttcacggcggcggtggcgactgccgcgctggccgtcgccgtcgccgccgcgaggtacaaccggcggtaccggggcctcaggctgccccccggcccccccgggtggcccgtcgtcggcaacctcctccaggtggccttctccggcaagctcttcatccaccacatccgcgacctccggcgggagtacgggcccatcctgacgctgcgcatgggggagcgcacgctggtgatcatcagcagcgcggagctggcgcacgaggcgctggtcgagaagggccaggagttcgcgagccggccccgggagaacacgacgcgcaacatcttctcctccaacaagttcaccgtcaactcggcggtgtacgggcccgagtggcggtcgctgcggcggaacatggtgtccgggatgctgagcacgtcgcggctccgggagttccggcccgcgcgggcgcgcgccatggaccggttcgtggcgcggatgcgcgccgaggccgcggcgtcccccgacggcgcgtccgtgtgggtgctccggaacgcgcgcttcgcggtgttctgcatcctgctggacatgaccttcggcctgctggacctccccgaggagcacatcgtgcgcatcgacgccgtcatgaagcgcgtgctgctcgccgtcggcgtgcgcatggacgactacctcccgttcctccgccccttcttctggcggcaccagcgccgcgccctcgccgtccgccgcgagcaggtggacaccctgctcccgctcatcgacaggcgccgctccatcctccgcggcgcggcgtcgtccccgcccgaccccgccgtcgccgcgcccttctcgtacctcgactccctgctcgacctccgcgtcgagggccgcggcggcgccgcgcccaccgacgacgagctggtcacgctctgcgcggagctcatcaacggcgggaccgacaccacggccaccgcgatcgagtggggcatggcgcgcatcgtggacaacccggccatccaggcccggctccacgaggagatcgcgcggcaggtcggcggcgcgcggcccgtcgacgacagggacacggaggccatgccgtacctgcaggccttcgtgaaggagctcctccggaagcacccgccgacctacttctctctgacccacgccgccgcccggcccgggtgcaagctcgccgggtacgacgtccccgcggacgcgaacctggacatcttcctgccggccatctccgaggaccccaagctgtgggagcggccggcggagttcgacccggagcggttcctgtccggcggcgaggcggcggacatgacggggtcggcggggatccggatgatcccgttcggcgcggggcggaggatctgccccgggctggccatgggcaccacgcacatcgcgctgatggtggcgcggatggtgcaggcgttcgagtggcgcgcgcacccgtcgcagccgccgccggacttcaaggacaaggtggagttcacggtggtgatggaccgcccgctgctcgccgccgtcaggccccggagcctctccttctgatcgatcggatcgcccgtgtgcccgcgcggcgagctgcacatgcatgcatgcatggccgcgggctgcatgctgccttgatttccgatcaggacgcgtggcgtatgggtacttgcgagctatagctgctccctcctaccagccagtttactaccagtagtgtgagcagtgaacgcttccatctccatgtgtgtgtgtgcgtctctgagcttgccgtgtgttgcgtgcgtagtgtagcatgttaaatcgaaatgctacacgtttgcatgtgcgagtttatagaaactagtatagttcactatgtataataacgaacccttttttatcccctgaatttccaaattaaagtatacgcgtcgtttgttgacc

SEQ ID NO: 1539 - DNA, 2014 bp, Triticum aestivum
  misc_feature (1098)..(1098): n is a, c, g, or t
gccacgcactacgcctctccatctcgtcgagcacttcattaatcgcgcccatgtccatgcaacaacaacagcaacaaccggcgcgtgccaaccttctcggcgcaatgcctgcggcctccatgatcagcctcgccttcacggccgccgtggctaccgcggccttatgggtggccgtcgctgtggcgaggtacaaccggaagtaccgggggctgaggctcccacccggcccgcatgggtggcccatcgtcggcaacctcttccaggtcgccttctccgggaagctcttcatccactacatccgcgacctgcggcgtgagtacgggcccatcctgacgctgcggatgggggtgcgcacgctcgtcgtcatcagcagcgccgagctcgtgcacgaggcgctcgtcgagaagggcacggagttcgccagccgccccgctgagaacaccacgcgcaacatcttctcctccaacaagttcaccgtcaactccgcggtgtacggcgccgagtggcggtcgttgcgtcggaacatggtgtccgggatgctgagcacgtcgcgtctccgggagttccgcccggcgaggcttcgagccatggaccggttcgtggcacgcatgcgcgccgaggccgcggcgtccgccgacggggcctccgtgtgggtgctccgcaacgcgcgcttcgcggtcttctgcatcctgctcgatatgaccttcggcctgctcgacctggacgaggagcacatcgtgcacatcgacgccgtcttgaagcgcgtgctgctcgccgtcggcgtgcgcatggacgactacctcccgttcctccgccccttcttctggcggaagcagctccgggcgctcgccgttcgccgcgagcaggtcgacacgctcctcccactcatcaaccgccgccgcgccatcctccgcgacatgcagagctcgccgccagatcccaacgtcgctgcgcccttctcttacctcgactcgctgctcgacctccatatcgagggccgcgaaggcgcagacgacgagctggtcacgctgtgcgcggagctgatcaacggcggcaccgacaccacggccactgccattgagtgggccatggcgcgcntcgtggacaacccgtccatccaggcccggctccacgaggagatcatgcagcaagtcggcgacgcccggccaatcgacgacaaggacatcgaaagcatgccctacctccaggccttcgtcaaggagctcctccggaagcacccgcccacgtacttttcgctcacccacgccgccgtcaagcctgggagcaagctcgccggctacgacgtgcccacggacgcgaacctggacatcttcctcccgaccatctcggaggaccccaagctgtgggaccggccgacggagttcgacccggacaggttcctaaccggcggcgagaccgcggacatgacagggtccgcgggcatccggatgataccgttcggggcggggcggcggatctgcccgggcttggccatggggacgacgcacatcgcgctgatggtggcgcggatgctgcaggagttcgagtggcgcgcgcacccgtcgcagccggcggtggacttcaaggataaggtggagttcacggtggtgatgaaccagccgctgctggccacggtgaagccccggaagatgtcgctctgatccatgtgcatgcatgcggatcggggtggccggcagtcgtacgtactcgatcgtacctacgtcgaatgcatgcatcgcaaccactccgctcgttaggtcagcacgtaagccgcatgtgccagtaccatacctactgttaccgattccagcattatgagaaagtatctagtgtgctatagatagcttctctagtcgtttatctatgtgcacggtatacacacctgtattatgtgcgcgaagtagcacagtcacaaatgcatcaagcgagtttgtatgattttaaattgaagaacttatttctatgtgcatggattgctcctaccaagatttccgaatataatgacttttattta

SEQ ID NO: 1540 - DNA, 2050 bp, Saccharum officinarum
  misc_feature (706)..(706): n is a, c, g, or t
  misc_feature (826)..(827): n is a, c, g, or t
  misc_feature (837)..(837): n is a, c, g, or t
  misc_feature (974)..(974): n is a, c, g, or t
  misc_feature (1704)..(1704): n is a, c, g, or t
  misc_feature (1884)..(1884): n is a, c, g, or t
ccttttcatcccgtgttctccctctagtgcggcaactgggcgaccgctgacgccggcgccctacgccaggtgcccaggccttcatgtaccttcccaggccttagtcgcgttcttcgccggcgacgaccaccctggagcaagtcttcagcagccccctcgctcccgcaccctccacgagcgaccgtgccggcgcacccccggcgccgggtgccagcggcccgtgctgcctgctgcctactgcagcgcatcacagctcacgatggcaagaacaattaattccttgatgtacaaaggatctattcccgatgcaattaatcaatcaagaagggagaagaagctctttgtagtctacatatccggtgaagatgaggcttcgagtaatttggaacagtcaacactgattgacgaaaacgtggttgaagtgatcggtagatgttgcatcttattgcatctcaagcaaggcaatgttgatgcatcacagttttcagctatctatccccagaagtctgtaccaagtatatcagtgattggactgaatggagttttgctgtggaatcatgatggatatatcaactctgaaaatctgaaagaaagtatcgagaaagcttgggctgcccttcatctacaggagacagcggcgaccttgttgacagcatcgcttgcttcaagaaatgctgaatctgtgaatactgctactactggtttnggtagctcaagggggctcttctactttagaaaatccttctgattcatccagtcaatcaccagatgtttctggtgccagtggagttgctcattcaactgatctggtgtctcaagttcctannagcaccaccntttatgaacctcttgagattaatggaaaagaaggttcaaaatcagactcgggtgatagaactgttgagaagctaggttcaacaaatactgaatttaattgtgatttggttgatggttcaaggaagtcaaacacggtnagttctgcagatccaaaaggagaagacattacaccatcagcgaaaagaaagaacaaagatgatggaagtcacacttctgtccccttggaggatactcctagtacactcactaatagaggagtttcttcccagtcacttgtggaacaagacaaggcaacaacttctgccccccctcttatttctgtgcagtcagatgatattcagcttagtattcgtatgcccagtggaaatagactggagatcaaagtaacaaaacaagatgttttgaggaaagtgaagaatttcgtggatgaaaacaaaggcaatgagcttggctcatatgatctttctctggtttatccaaaaagagttttctctgaacaagatatggaagcaacactatctgagctgggtattcaaaaccgtcatgcaatgattgttgttccacatcggcagcctggtcaggtatcaaggcctcagtcatcagcatcttatgatgtgggtggcaattcaggtgcggggggatactttggttacctgagaaccatgctgtcttatgtgaatccactctcctacttgaggggaaatacgaactcatcaaatccagagctacagtcaaatgaaggcctgcagcagcttagacatggatctggtcagccacggcctcttgttggcaataggggccatgaagtgactgatgcagactctgcaaacacgctgcgaaggcggcccagaccatttggtgctaatntccacactctggggagcgaggatcatggtccatctgatgaaagaaatgttttctggaatgggaactcgacagagtttggaggcgatgacagaaaataagttatggtgtggcagggccacgaacgacacaatcaggcagaatcgaagttgggaacagacacctgaaacaaatgcctcaacntgcttattgaggaatcaagtgttgagaacttgagattatagtggcgaaagtaatcgctaaattgtgacgtttacatttgtggaaacattatacggtcgctggataagtgtactcgttatatatatagtagatagatatattaaatctgaaacaaaaaggaaaacac

SEQ ID NO: 1541 - DNA, 1622 bp, Sorghum bicolor
tgcggcttaaacccttatcgccaccgccgcgtccccatctctcatctccgcggcccgtctcgtctcccactagggtttggcactttggccgccgccatggcgtcggcgtcgcgcgcgctcctcctctcccgtgcgctccaggccggcgccgcgtcccgccgcgtccccaccctcctgcgcccgctcgctgcggccgcgagcctcctcccggcggcggcggcggcggccgcccccggcgctggggtgcgctgcttcgcgacccagccggcgacgtcctcgctgcgggactcgtccccgaactggagcaatcgcccgcccaaggagacgatcctcctcgacgggtgcgacttcgagcactggctcgtcgtcatggagccgccgcctggtgacgcctccaaccccgatattacgcgcgacgagatcatcgatagctatatcaagaccctcgcccaaatcgtcgggagtgaggaagaagctaggcaaaagatatattcggtgtctactcgtcattactttgcctttggtgcccttgtatctgaggaactctcttacaaactcaaagaaatgcccaaggtccgctgggttcttcctgattcatacttggatgtcaaaaataaggactatggaggagaacccttcataaatggggaagctgttccttatgatcctaaataccatgaggagtgggtgagaaacaatgcccgtgccaatgaaagatcccgtagaaatgataggccccgcaacttcgacaggtcaaggaactttgagaggagaagggagaacatgcagaacttccagaacagagatgggcctcctgcgcagggtttcagtggccccccacctccacctggccagaaccagatgccacctcagcatgttcagggtaacatgccgccaccaccaccacatgctggtggtggtcagccaaactatcagccccaaatgccaaacccacaggcgggctacaaccctggtggtgctcctcactaccagcaaggtggtgctcctggctaccaaggtggacctccggggtatcaaggtggtaaccaaggttaccaagggaacccaggcccggcctaccaaggtggtaaccctggctaccaaggtggcccacctggttaccctggtggcaacccaccacctccacctccctaccaaggaggcaaccccaatgcaccgccataccctggtggtggcaatcctggctaccctggtggcagcccaggctaccaaggtcaaggaggcaactcgaacttccaatgaacatgaccacgcctaagtataagtaggcacccctgttccagagtagccttctgggagagatggtgtgcagtagcataaatcgaacccttgttgctatctgattttcatgcactgtcgctgtatgcacctaattattatgttctatatagtactcaactgtgcttggtgtctgagtgatgcacccggaattctgaaactatggatgatgtaccatcagctcttctgctcttgaattcccttgctgagccatatgctcagcagttgtcggctttgtctgtctttgttcgttttgaatgattttttacccacaaacttgttacagctcatcctgctaaattcatgtgatattttttcctgca

SEQ ID NO: 1542 - DNA, 1896 bp, Aquilegia formosa
ggggtgaaaaagagagcacataggtatggatggaattagggaaatggggcttcgaaatgttgcttcacaatgctcaatctcggaggttgatgattacgacttgtcaaagcttcttgataagccgaagttgaatattgagcgacaaagatcatttgatgagagatcgcttagcgaattatccgttggtttttctagaggaggactggaggtctttgagactgtatattctcctggaggtcgatctgcttttgacactcctgcttcctcagctcgtcattcatttgagcctcatcctatggtagctgaagcctgggaagctctacgtcgatctttagtttcattccgaggacaaccagttggaactgttgctgctcatgacttctccgacgaagttctgaactatgatcaggtctttgttcgagactttgtgcctagtgctttggcctttttgatgaatggagaacctgatattgtcaaaaacttcctcttgaagactctacacctacaagggtgggagaaaagaatagatcgttttaagctcggagaaggcgtgatgcctgctagtttcaaagtacttcatgatccagctaggaaaactgattctttagttgcagattttggagagagtgcaattgggagagttgctcctgttgactctggcttctggtggattattttgctccgcgcctatacgaagtcaactggagacttatctttggcagaaacacccgagtgtcaaaagggtatgaggcttatactgtccctatgtttgtcggagggatttgacacatttccaacccttctttgtgctgatggatgctctatgattgatcggagaatgggtatttacggttatcctattgaaatccaagcactcttctttatggccttacgatgtgctttgacattgcttaaacacgatacagaaggaaaggagtttgttgaaagaattgtaaagcgcttgcatgctctaagttatcacatgagaagttacttttggctcgactttcagcaactcaacgacatttatcgatataaaacagaggagtattctcatacagcagttaataagtttaatgttattcctgattccattccagaatgggtatttgattttatgccaactcgtggagggtacttcattggaaatgtgagtcctgcaaggatggactttcgctggtttgctctaggtaatctttttgcgattctgtcctctcttgcaactcctgagcaatctgttgctattatggatttaatcgagtcacggtgggaagaacttgttggagaaatgccactgaaaatatcttatccagcaatagaaagccacgactggagaattgtaacaggctgtgatcccaagaatacgagatggagttaccacaatggaggatcttggccagttcttctgtggatgctgacagctgcctgcatcaagacgggaaggccacaaattgctagacgggcaattgatcttgctgagagccggctgctgaaagacaactggccagaatattatgatgggaagcttgggaggtatgtcgggaaacaagcaaggaagtttcaaacatggtccatcgcaggatatctggtagcaaagatgatgttggaagatccatcacacttgggtatgatatcccttgaagaagacaagcagatgaagcctcttattaagagatcaagctcatggacttgctaagtgctcaaacaaacacaaagagagaagaagaataatagcaaaagcacagaggaaaagtgagttgttagttatcacacgactatacgtggtgtgagctttatgtttttttttttcccaatattttgttttaaatctggctttgtgtacaataacatcatatttggcagtcacctcgctttcaaatagaaagacattttggt

SEQ ID NO: 1543 - DNA, 2049 bp, arabidopsis lyrata
gttttgtattcttcttccttacttgttcatctatctataaaacaacaacttcactcatcatgactcttttttcccgttttcttactcttttgccccttcttctctcactctccggcgaaatcgccggcgagtttttgacacttccgttgtcttctcagttgttgttgttgtttatgactgaacctatagatcttgttctatccattaaaaccaaagaaatggaaggtcataaagaaccattgtggctaagagttgaaggatcacattgttcattatcagagatggatgatttcgatcttactcgggctttggagaagccgaggcagctaaagattgaacggaagagatcatttgatgaaagatcaatgagcgagttatcgactggctatgcaagacaagacagcattttagaaatggctcattctcctggaagtaggtcaatggtggacactcctctctctgttaggaactcgtttgagcctcatccgatggttgctgaggcttgggaagctttgagaaggtcaatggtgttcttccgtggtcaacccgttggtaccattgcggcttatgaccatgcctccgaggaggtcttgaactacgatcaggtgttcgtacgggactttgtaccgagtgcattggcatttctgatgaatggagaaccagatatagtgaaaaacttcttgctcaagacacttcagctacaaggttgggagaaacgggttgaccgattcaagctcggggaaggagttatgccagcgagtttcaaggtgcttcatgatccagtccgtaaaaccgacacgattgttgccgattttggagaaagcgctataggaagagtagcaccggtggattcaggattctggtggataatacttctccgtgcttacacgaaatctaccggagatttgactctttctgagacaccagagtgtcagagggggatgaggcttatactctcactctgcttatctgaagggtttgacactttccctacgctgctttgtgctgacggttgttctatggttgataggagaatgggtgtttatggatatccgatagagattcaagctctgtttttcatggcgctgagatgcgccttatcgatgcttaaacctgacgaggaaggtagagagttcatagaaaggattgtgaagagacttcacgccctgagtttccatatgcgcagttacttttggctcgactttcagcaactcaatgatatctacaggtacaagacggaggaatactcacacacggcggtgaacaaattcaacgtgatgccggactcgataccagattgggttttcgacttcatgcctctccgtggaggatattttgtcggcaatgtaagcccggcccgtatggatttcaggtggttttccttaggaaattgtgtctccatcctctcttctctagcaactccggatcagtcaatggccattatggacctactcgagcaccgttgggaggagctagttggcgagatgccgctcaagatatgttacccttgcattgagagccacgagtggcggattgtcactggttgtgatcctaagaacactaggtggagctaccacaacggcggatcttggccagtattgttgtggacgctgacagcggcatgcatcaagacaggcaggcctcaaatcgcgagacgtgcgattgatctaattgagtcacggctacaccgagattgctggccggaatactatgatggtaagcaaggaagatacgttggaaaacaggccaggaaataccagacttggtcaatcgcgggttacttggttgcgaagatgatgcttgaagatccttcacatatcggaatgatctctcttgaagaagacaaacagatgaaaccagttatcaagagatctgcttcttggacttgctgatttttgttttcttgcttttcttgttttgtattataaatttcattattaagagttgcaaaagacctttaatcagccagagaatagttctgttgcacttctctttgatccaactatgatttattttaacttgaggcttaatataatctctttctagatc

SEQ ID NO: 1544 - DNA, 1998 bp, Artemisia annua
  misc_feature (590)..(590): n is a, c, g, or t
  misc_feature (597)..(597): n is a, c, g, or t
ttctcactttccggccaccggaaaatccctttttccggcatttcatatcttacagattattgttaggtttaaagggtgagtaatatggacgctcctaaagaggctggacttcgtaatgttagctcagtttgctccattccagaaatggatgattttgagctcacaaagcttttggatacaccgaggcttaccatcaaaagagagagatcatttgacgagaggtcacttagcgagatgtctatatcaaggggtcttgacaatttggatattgcatattcaccaggtggacggtctgggttcgatactccagcttcgtccactaggaactcttttgaacctcatccaatgattgcagaagcttgggattctcttcgtagatcattggtgcacttcaggggtcaacccgttggtacaattgctgcttatgatcatgcatcagaggaagttctaaactatgatcaggtgtttgtaagggattttgtaccaagtgcactggcttttctaatgaatggcgagcctgatatagtgaagaattttctattgaagacacttcaacttcaagggtgggaaaaaaaggttgatagattcanacttggngaaggggcgatgcctgctagttttaaagtactccatgaccctgaacgtaaaacagatacaatagttgcggattttggtgagagtgccattggaagagtggcaccggttgattctggattctggtggattatattgttgcgtgcatatacaaagtctactggagatctcactcttgctgaaacaccagactgccagaaagggatgaggcttatattgaatttgtgtttatcagagggttttgatacgtttccaactctgctgtgcgcagacggttgctcaatgattgaccgaaggatgggaatttatggttatcctatagaaatacaagctcttttctttatggcattgcggtgttccttggcaatgctgaaacttgatgcagagggaaaagaatttgcggatagaataatgaagcgcttgcatgcattaagctttcacatgcgaagttatttctggattgacttccaacagttaaatgatatctaccgctataaaacagaggagtactctcacacggctgtaaataagtttaacgttattcctgattcaatcccagattgggttttcgattttatgccaactcgtggtggttactttgttggaaatgtgagtccagcaaggatggactttagatggttcgctttaggtaactgtgtcgctattttatcttctcttgcaactcctgagcaagcttcagcaatcatggatctttttgaagcacgttgggaggagcttgtcggagaaatgcctatcaaaatttgttatccagcaattgaaagccacgaatggagaattgtaactggttgcgatcctaagaacaccagatggagttaccacaatggaggatcatggccagtgcttttatggttgctaactgccgcctgcattaaaacggggaggccacaaatagcaagacgtgcaattgaacttgctgaaagccgcttgctaaaagacgggtggcctgaatattatgatggaaaaaatggaagatacattggtaagcaagcaagaaagtaccaaacttggtcaattgcaggttatttggttgcaaaaatgatgttagaagatccatcacacttggggatgatatcccttgaagacgatagacaattgaaacccattattaaaagatctgcctcctggacttgctgaagagctgaaactctaagaaaacaggtgagtaatctattttcatcatgagaaaaatggaccatattgatttctgtattgtttaggttggattgagtctttcattttgtgtacgttagcatttgacatgcatgtcttattgcttcttctaataaaaaacactaccaatgtgattctcttatgtgtgttcaaattttcatcaatgctatgagatattgtatgtagaagttggagtaatatttactgtttttt

SEQ ID NO: 1545 - DNA, 1887 bp, Brassica rapa
gttttttcccctttttccactcacttgtccccttctctcccattctccggcgacatcgccggcgatcgttttcaccaccgccgctataaattatcctcgtctccttagatcttgtcctgtccgttaaaaccaaagaaatggaatgtcctaaagaaccattggaatcacagtgttctttatccgagatggatgatttcgatctgactcgagcgttggacaagccgaggctcaagatcgaaaggaagagatcgttcgatgagaggtcgatgagcgagttatcgactggctactcaagacatgatctagacatggctcattcccctggaagcaggtcgtttgtggacacacctctctcttatgttaggaactcgttcgagccccatccaatggttgcagaggcctgggaagctctgagaaggtcgatggttttcttccgtggtcaacccgttggtaccattgcagcttatgaccatgcctctgaggaggtcttgaactatgaccaggtgtttgtacgagactttgtgccaagtgcactggcgtttctgatgaacggagagccagatatagtgaaaaacttcttgctcaagacacttcagcttcaaggttgggagaaacgggtcgaccggttcaagcttggggaaggagttatgccggcgagcttcaaggtgcttcatgatcctgtccgtaaaaccgatacaatcgttgcagattttggagaaagcgctataggaagagtggcaccggttgattcagggttttggtggatcatacttctccgtgcctacacaaaatctactggagatttgactctgtctgaaacaccagagtgtcagaggggaataaggcttatactctcactctgcttgtctgaagggttcgatactttccccacgctgctttgtgctgacggttgttccatggttgataggagaatgggtgtttatggataccccattgagatacaagctctgtttttcatggcgctgagaagtgccttatcgatgctgaaacatgacgaggaaggtagagagttcatagagaagattgtgaagagacttcacgccttgagcttccacatgcgtaattacttctggctcgactttcagcaactcaacgatatctacaggtacaagacggaggagtactcacacacggcggtgaacaagtttaacgtgatgccggactcgataccggactgggttttcgacttcatgcctctccgtggagggtactttgttgggaatgtaagcccggctcgtatggacttcaggtggttttcattgggcaactgtgtcgccatcctctcttctctggcgactccggatcagtcgatggccattatggacctcctcgagcaccgttgggaggagctggttggtgagatgccgctcaagatatgttacccttgcatcgagagccatgagtggcggatcgttaccggttgtgatcctaagaacactcgatggagctaccacaatggcggatcttggccagttttgctgtggatgctgacagctgcgtgcatcaagaccggtcggcctcaaatagcgaggcgagccatcgacctgattgagtcacggcttcacagagactgctggccagagtactacgacggtaagctaggaaggtacgttgggaaacaagcaagaaaataccagacttggtcaatcgcaggttacttggttgctaagatgatgcttgaagatccttcacatattggaatgatctctcttgaagaagacaaacagatgaaacctgttctcaagagatctgcttcgtggacttgctgatttttaaccttttttcttgtattatataatgtcatttgagacttgtcctttattcgagattaaaggaatgcaaagacctttcgtttgttttgtttaa

SEQ ID NO: 1546 - DNA, 2410 bp, Brachypodium distachyon
cctcgagattcgcgcggccgtgttactggctcggcttccgttgtctagcgtcccaagctagatctctctccctccccctgctctcgccctcccggcgctttggcggctttatagatctggctgctggggcgacgacgcggaggccggccggagattcttcgtgaggccagggggaaggggaagccatggagctgggggccggcgggatgcggcggtcggcgtcgcacacctcgctgtccgagtcggacgacttcgacctctcgcgcctgctcaacaagccgcggatcaacgtcgagcgccagcgctccttcgacgaccgatcgctcagcgacgtctcctactccggtggccacgccagggggggcgggggcttcgacggcatgtactcccccggcggcggactccgctccctcgtcggcacgccggcctcctccgcgctccactccttcgagccccaccccatcgtcggcgacgcctgggaggcactccgccgatccctcgtcttcttccgcggccagcccctcggcaccatcgcggcctacgaccatgcctccgaggaagtcctcaactatgaccaggtgtttgtgagggatttcgtgcccagcgccatggcgtttctcatgaatggtgagccggagattgtcaagaacttcctgctcaagaccgtgctgctgcaggggtgggagaagaaggtcgatcggtttaagctcggggaaggggccatgcccgccagctttaaagtgcttcatgatgataagaagggcactgataccctgcatgctgatttcggggagagcgcgattgggcgggttgcgccggtcgattcaggattttggtggatcatactcttgcgggcctacacaaagtccaccggggatttgactctggcagagaagcctgagtgccagaaggcgatgaggctcatactgagcctgtgcttgtctgaggggtttgataccttcccgacattgttgtgcgctgatggttgctgcatgatagatcgcaggatgggtgtgtatggttaccccatcgaaattcaatcccttttcttcatggcactgaggtgtgctcttctcatgctcaagcatgatgctgaagggaaagacttcgtggagcggattgcaactcgtctccatgctttaagttatcacatgcggagctatttttggctggatttccagcagctaaatgatatttatcgttacaagactgaagaatattcccacacagctgtcaacaaattcaacgtcattccagattctattccggactggctatttgattttatgccttgtcagggtgggttttttgttggtaatgtcagtcctgcaaggatggacttccgttggtttgcacttggaaacatgattgccatagtatcatctctcgctacacctgagcaatctatggccataatggatcttattgaggagcgctgggaagagctaattggtgaaatgcctctgaagatatgctatcctgctatcgagaaccatgaatggcgaattgtgaccggatgtgacccgaaaaatacgagatggagttaccacaatggaggatcttggccagtacttctctggctgctcaccgcagcaagcatcaaaactggacggccgcagattgcaagaagagcaattgacctagctgagaggaggctgttgaaggacggctggcctgagtattatgatgggaagcttggaaaatacgttggcaagcaggcaagaaaattccagacttggtccattgcaggatatttggttgcaaagatgctgctggaggacccttcgcatcttggcatgatagccctggaggaggacaaggcgatgaagcctgttttgagaaggtccgcctcatggacaaactaagatatcgacgaatacttttaggggagcaaagtcggattgaaacacgaattctttcgggtaggacatctctgctcatcccttcctttgactttcctaaccggaaaggtttattttccactggattccttggttgtacaatatcccagctcattccttgagtcaaaaaagaagcaattgtggaagtgagcgttttgttttctcgtgttttctttcactccattgtaagaagatactctgattcttgcttgggtcaccctgaagttatggatccttttggttggactcaaactttgttgtatgagttgactatatagatgagtaggctgattccagctctctgtgatgaacagaagtgccactctaacgaataaagatctccccattttctgcagtgctacatgcctgcgaatcaattgccttcagtgtgctgcctatgatctctcaaggcgggtcaaagtgtgcgtgctgtgctactttcttgtaactttcaagttgtacttgtgttcaagaaaaaatgctcaaaagattccttattttctaataaa

SEQ ID NO: 1547 - DNA, 1996 bp, Brachypodium distachyon
cgactgcggcggtttgcgggatggaggcggcggcggcggcgacgacgacgaataaggcgccgtccatggcggacccggaggacgacttcgacctgtcgcggctgctgaaccaccgcccgcggatcaacgtggagcggcagcgctccttcgacgaccgctcgctcggcgacctgtacctctccgccatggacgggcgcagcggcggctacatggacagctacgacaccatgtactccccgggcggcgggctccggtcgctcagcggcaccccggcctcctccacgcgccactccttcgagccctacccgctcgtcttcgaggcctgggaggccctccgccgctccctcgtctgcttccgcggccagcccctcggcaccatcgccgccgtcgaccactccgccggcgaagtcctaaactacgaccaggtgttcgtgagggatttcgtgccgagcgcgctggcgttcctgatgaacggggagccggagatcgtgaagaacttcctgctcaagacgctgctgctgcaggggtgggagaagcggatcgaccggttcaagctcggggaaggcgcgatgccggcgagcttcaaggtgctcaaggaccccaagcgcggcgtggacacactgtccgcggacttcggcgagagcgccatcggccgcgtggcgccggcagactccgggttctggtggatcatcctgctccgtgcctacaccaagtccaccggcgacctcaccctcgccgagacgcccgagtgccagaaagggatccgcctcatcatgaaccagtgcctcgccgaggggttcgacaccttcccaactctcctctgcgccgatggttgctgcatgatcgaccgcaggatgggcgtgtacgggtacccgatcgagatccaagccctgttcttcatggcgctgcggtgcgcgctgctgctgctcaagcccgagggggaagggaacaaggacacggtggagcggatcgtgacgcggctgcacgcgctgagctaccacatgcgggcctacttctggctcgacttccagcagctcaacgtcatctaccgcttcaagacggaggagtactcccacacggccgtcaacaagttcaacgtcatcccggagtccatcccggactggctcttggacttcatgccctccaagggaggatacttcgtcggcaacgtcagccccgccaggatggacttccgctggttcgcgctcgggaactgcgtcgccatcctcgcatccctcgccacgcccgaccaggccgccgccatcatggacctcatcgaggagcgctgggaggacctcgtcggcgagatgccgctcaagatctgctaccccgccatcgagggccacgagtggcagtccgtgaccggctgcgaccccaagaacacccgatggagctaccacaatggaggctcctggccagtgctcctgtggctcctgacggcggcctgcatcaagaccgggcggctgaagatcgcgaggcgggcgatcgacctggcggaggcgaggctggccaaggacagttggccggagtactacgacggcaagctcgggcgttacgtggggaagcaggcgaggaagcaccagacgtggtccatcgcggggtacctggtcgccaagatgatgctggaggacccgtcccacctgggcatgatctccctcgaggaggacaaagccatgaatcccgtgctcaagaggtctgcatcttggacggtgtaacaagatatctgatcaatgctggtgggcgaccatgtgggcaaaaagagcatgttcatttttgggtctagcaattctgttcttcgcaccattgctttcctaatttggaaagacatgttttggttgtctcccttgtatggagtagcaaaaaagtaagagggcatcgaagaaatggcttttcggttttcagtctcatgactcatggtgagaaggaggatccaaattgtcgagttgttatcaagtgatgtgtacctatagtttttttacaatgatctgactttatt

SEQ ID NO: 1548 - DNA, 2178 bp, Manihot esculenta
gctttaagacatgctctttttttctcctctctctctcattttttcttccttgtctcttcgccgaccgtttaccggcgacaccgctttttggttcccgccggggagtctctctcctcgccatttttatgctttgcaaagaacaaaaatagtcagtgcatttttcaagattagaaaaagataaacaaatggatgggactaaagagataggacttaggaatgtgagctcaacatgttcaatatctgaaatggacgattttgatctctctcgccttctggacaagccaaggctcaacattgagaggcagagatcatttgatgaaaggtcactcagcgagctctcaattgggctcaccagaggaggtcttgatatctatgagagcacatattcacctgggggaaggtcaggattcgacacaccagcgtcatcgactcgcaactcatttgaaccacatccaatggtggctgatgcctgggaagcacttaggcggtctatagtgtacttcaggggccaaccagttggcacaattgctgcaattgaccatgcctcggaggaggttttgaattatgatcaggtttttgtacgagattttgtacctagtgccctggcttttctgatgaatggtgagcctgagatagttaagaacttcctcttgaagacacttcatcttcaagggtgggaaaagagaatagatcgattcaagcttggtgaaggggcaatgccagctagctttaaagttcttcatgatcctgttcggaaaacagatactcttattgcagattttggtgagagtgcaattggaagagtagctcctgttgactctggtttctggtggatcattctgttgcgtgcatataccaagtctactggggatttgtctcttgcagagactccagagtgtcaaaaagggatgagacttatattgactctgtgcttgtcagaggggtttgatacatttccaacccttctctgtgcggatggatgctctatgattgatcgcagaatgggaatttacggttatcctattgaaattcaagcactttttttcatggcgttgaggtgtgctttgtcaatgttgaaacatgatacagaaggaaaagaatgtattgagagaattgtgaaacgattgcatgccttgagttatcacatgcgcggttacttctggttagattttcaacaattaaatgatatatacagatataaaactgaggagtactcgcatactgcagtaaataagttcaatgtaattcctgattcaatcccagattgggtatttgattttatgcctacacgaggtggctattttattggtaatgttagtcctgcaaggatggactttcggtggtttgctttaggtaattgtgttgccattctctcatctcttgccactcccgagcagtcaatggctatcatggatcttatagaatctcgctgggaggagctggttggagaaatgcctatgaaaatagcttatccagcaatagaaagccatgaatggcgaattgtaactggttgtgaccccaagaacaccagatggagttaccataatggaggatcttggccagtgcttttatggatgctaactgccgcatgcatcaaaacgggccgaccacaaattgcaagacgcgcgattgatcttgctgagacccgtctgctgaaagatggctggccagaatattatgacgggaaagttgggagatttatcggtaaacaggcaaggaagtaccagacatggtcaattgctgggtacttggtggcaaagatgatgctagaggatccttcacatttggggatgatttctctagaagaggacaaacaaatgaaaccagtgattaagagatcaacttcatggacttgctgatgaagagacaaacaagcaagcaagcaagaaaagaaaacagaaggtgagaaacgttggatttctttgaagcacaattcttttttgctggtttgtggttgcaggtccgattgagagtttggttgtgtacgatagtttttctgctaaggctaatgtctttgcttttaaaataagagaaacatgttgctgttgtattaaaaaaaaaaaagaaattttgaatggcattttggaaatgctatcgtcaatttatattagcatttgacagcagaaatggaacaacatttatcttcattgcctattacttcactttttgtttgtttct

SEQ ID NO: 1549 - DNA, 1924 bp, Manihot esculenta
ataaacatatggatgggactaaagaaatggggcttaagaatgtgagttcaacatgctcaatctctgaaatggacgattttgatctctctcgtcttttggacaagccaaggctgaacattgagaggaagagatcatttgatgagaggtcactcagtgagctctcaattgggcttactagaggaggtcttgataactatgagaccacatattcccctggtggaaggtcaggattcgacacaccagcctcatcgactcgcaactcttttgagccacacccaatggtggctgatgcctgggaggccctacggcgatctatagtgtacttcaggggtcaaccagttggcacaatagctgcaattgaccatgcctctgaggagattttgaattatgatcaggtttttgttcgagattttgtacccagtgccctggcttttctgatgaatggtgagcctgagatagttaagaacttcctcatgaagacactatatcttcaaggatgggaaaagagaatagacagattcaagctcggggaaggtgcaatgccagctagctttaaagttcttcatgatcctattcggaaaacagatactctaatcgcagattttggtgagagtgcaattggaagagtggctcctgttgactctggtttctggtggatcattctgctgcgcgcatataccaagtctactggagatttgtctttagcagagactccagagtgtcaaaaggggatgaagcttatattgactttgtgcttgtcggaggggtttgatactttccctacccttctttgtgctgatggatgctctatgattgatcgcagaatgggcatttacggttatcctatcgaaattcaagcacttttctttatggcattaaggtgtgccttgtcaatgttgaaacacgatacagaaggaaaagaatttattgagagaatttcgaaacgtttgcatgcgttgagctatcacatgcgaagttacttttggttagactttcaacaactaaatgatatatacagatacaaaactgaggagtactcacacactgcagtaaataagttcaatgttattcctgattcaatcccagattgggtatttgactttatgcctactcgtggtggctattttatcggcaatgttagtcctgcaaggatggattttcgatggtttgctttaggtaattgtgttgccattctctcttctcttgcaactccggagcaatcaatggctatcatggatcttatagaatctcgctgggaggagctggttggagaaatgcctttgaaaatagcttatcctgcaatagaaagccatgattggcgaattgtaaccggttgtgatcctaagaacaccagatggagttaccataatggaggatcttggccagtgcttttatggatgctaacggctgcgtgcatcaaaacgggacgaccacaaatcgcaagacgagcgattgatcttgcagaaacccgtctgctgaaagatagctggcctgaatattatgatggaaaactcgggaaatttataggtaaacaggcgaggaaataccagacatggtcgattgctgggtacttagtggcaaagatgatgctggaggatccttcacatttgggaatggtttccttggaagaagacaaacagatgaagcctgtgatgaagagatcatcttcttggacttgctgatgaagataggcaaataaattaagcaaattagaagaaaaaaatagtagaaaaagaaagaagaaggtgagaaatgctggatttggttaaagcagtattctttgcacatttgaaattgtaggtctgatcggaagttttagttttgtataatagcttcttctaagaactccactcttgcttttcaaataagggaaaacattatattagcttttgacagcaaaaataacaatatttatcttattttt

SEQ ID NO: 1550 - DNA, 1691 bp, Ricinus communis
aaaagagaacaacaaatggatatgggacttaggaacgtgagctccacatgctcgatttctgaaatggatgatttcgacctttctcgccttcttgacaagccgaggttgaacatagagaggcaaagatcatttgatgagaggtcattaagtgagctctcgattggattgacaagaggccacgataactatgagagcacatattcgcctggaggaaggtcagggttcgacacaccagcctcatcagctcgtaactcatttgagccccatcctatggtagctgatgcttgggaggcattacggaagtctatagtgtacttcagaggccaacctgttgggactattgctgcaattgaccatgcctctgaggaggtcttgaactatgatcaggtttttgtacgagattttgtacccagcgccctggcttttctgatgaacggtgagcctgagatagttaagaacttcttgttgaagacgctacatcttcaagggtgggaaaagagaatagatagatttaagctcggggatggggtcatgccagctagctttaaagttctccatgatcctgttcgaaaaacggatactcttattgcagattttggtgagagtgcaattggaagagtggctcctgttgactctggtttctggtggatcattctgctccgagcatataccaagtctacaggggatcattctctggcagagactcctgagtgccaaaaagggatgagacttatattgactctgtgcttgtcagaagggtttgacacattcccaacccttctttgtgctgatggatgctctatggttgatcgcagaatgggaatatatggttatcctattgaaattcaagcactcttttttatggcattgagatgtgctttgtctatgttgaaagatgatggagaaaataaagaatgtactgagagaattgtgaaacgtttgcatgctttgagctatcacatgagaagttacttctggttagattttcaacagctaaatgacatatacagatataaaactgaggagtactcgcacactgcagtaaataaattcaatgttattcctgattcaatcccagaatgggtatttgatttcatgccaacacgtggtggttattttattggtaatgttagtcctgcaaggatggattttcgatggtttgctttaggtaattgtgttgccattctctcgtctctttcaactcccgagcaatcaaatgctataatggatcttattgaagctcgttgggaggagctggttggagaaatgcctttgaaaatatcttatcctgcaatagaaggtcatgaatggcggattgtaactggttgtgatcccaagaataccagatggagttaccataacggaggatcttggccagtgcttctatggttgctaacagctgcgtgcatcaaaacgggacgaccacaaattgcaagacgagcaattgatcttgccgaggcgcgtctgctgaaagatggctggccagaatattatgatgggaaacttgggagatatatgggtaaacaggcaaggagataccagacatggtctattgctgggtacttggtggcaaagatgatgctggaggatccttcgcatttgggaatgatttctcttgaagaggacaagcaaatgaagccagtgcttaaaagatcaacttcttggacttgctgaagagggaaaccaagcaa

SEQ ID NO: 1551 - DNA, 1959 bp, Castanea mollissima
ctacgatctctctcgccttctcgataagccgaggctgaacatcgagaggcagagatcgttcgacgagaggtcgttgagtgagttgtcgatcggtctagccagaggaggattagataactttgagagcacgtgctcccccggaggaaggtccgggtttgaaaccccggcttcttcggctcgtaactcattcgagcctcatccaatggttgctgacgcttgggaggctcttcgccggtctttggtgtattttcggggtcagccggttgggactattgctgccgttgaccatgcctcggaggaagttcttaactacgatcaggtttttgtacgagattttgttcctagcgctctggctttcctgatgaatggtgagcctgacatagtcaagaattttctcttgaagactttgtaccttcaagggtgggaaaaaagaatagacagatttaaacttggggaaggtgcaatgccagccagcttcaaagttcttcatgaccctattcgaaaaacagatacacttattgcagattttggcgagagtgccattgggagagttgctcccgttgactctggattttggtggataattctgctgagagcttatacaaagtccacgggggatttaactcttgcagaaacgtcagattgtcaaaaggggatgaagcttattttaactttatgtctgtcggaggggtttgatacattcccaactctgctttgtgcagatggatgctctatgattgatcgaagaatgggcgtatatggttatccaattgaaattcaggcacttttctttatggcgttgagatgtgctttggcaatgcttaaacctgatacagaaggaaaagaatttatagagcgaattgtgaagcgtttgcatgcattgagttatcacatgcgaagttacttttggcttgacttccaacagctaaatgacatttaccgctacaagactgaggagtactcacatactgcagtaaataagtttaatgttattcctgattcaatcccagaatgggtatttgattttatgccaacacgtggtggttactttattggaaatgttagtcctgcaagaatggattttcgatggtttgcactaggcaattgtgttgcgattatgtcatctcttgcaacacctgagcaatcaatggctattatggatcttcttgaatctcgctgggaagagttggttggagagatgcctctgaaaataagttatcctgcaatagaaagtcatgagtggagaattgtaactggttgtgatcccaagaataccagatggagttaccataatggaggatcttggccagtgcttttgtggctgctgacagctgcttgcattaaaacgggacgaccacagattgcaagacgagcgattgagcttgctgagaatcgtctgctgaaggataactggccagaatattatgatgggaaaactgggaggtatattgggaagcaggcaagaaagtaccagacatggtcaattgcaggatatttggtggcaaagatgatgctagaggatccatcacacttgggaatgatttcactggaagaggacaagcaaatgaagccagctcttaagaggtcgtcatcttggacttgctgaaaagctcaagcatggaaaagcaaatgaggagaaaaagaatagagaaaaacaggtggtgaaacatcttgttatataaatcaatactattctttggtgcttcctgccttgtacggcttcattcaaagtttgcttgtgtacaatagcctgtgctgagactagttttgtgattttccaaataaaagatgcattttgttattcaagatataaactttgggaggcattctgcaaatgccatggtgccaatttttattagctctttacaggctaaatgttcggtgtcaagtctttgctttaccagataagagacattgtggatgatcttataaatatattgtggactttttattgaaaaa

(The sequence listing continues in the following parts.)

What is claimed is:

1. A method of increasing a trait of a plant as compared to a non-transformed plant of the same species, the trait is selected from the group consisting of: rosette area, rosette diameter, and growth rate of rosette area, the method comprising:

(a) expressing within the plant an exogenous polynucleotide comprising a nucleic acid sequence encoding the polypeptide set forth in SEQ ID NO: 246, wherein said exogenous polynucleotide is comprised within a nucleic acid construct and is operably linked to a plant promoter within said nucleic acid construct, and (b) selecting plants resulting from step (a) for an increased trait selected from the group consisting of: rosette area, rosette diameter, and growth rate of rosette area, as compared to a non-transformed plant of the same species which is grown under the same growth conditions, thereby increasing the trait of the plant as compared to a non-transformed plant of the same species.

2. The method of claim 1, wherein said exogenous polynucleotide comprises a nucleic acid sequence selected from the group consisting of SEQ ID NOs: 3487 and 7.

3. A method of growing a crop comprising:
(a) selecting a parent plant transformed with an exogenous polynucleotide comprising a nucleic acid sequence encoding the polypeptide set forth in SEQ ID NO: 246 for at least one trait selected from the group consisting of: increased rosette area, increased rosette diameter, and increased growth rate of rosette area, as compared to a non-transformed plant of the same species which is grown under the same growth conditions, wherein said exogenous polynucleotide is comprised within a nucleic acid construct and is operably linked to a plant promoter within said nucleic acid construct, and
(b) growing progeny crop plant of said parent plant, wherein said progeny crop plant which comprises said exogenous polynucleotide has said increased rosette area, said increased rosette diameter, and/or said increased growth rate of rosette area,
thereby growing the crop.

4. The method of claim 3, wherein said exogenous polynucleotide comprises a nucleic acid sequence selected from the group consisting of SEQ ID NOs: 3487 and 7.

5. The method of claim 3, wherein said selecting said parent plant that has been transformed to express said exogenous polynucleotide is for increased rosette diameter as compared to a non-transformed plant of the same species which is grown under the same growth conditions.

6. The method of claim 3, wherein said selecting said parent plant that has been transformed to express said exogenous polynucleotide is for increased growth rate of rosette area as compared to a non-transformed plant of the same species which is grown under the same growth conditions.

7. The method of claim 3, wherein said selecting said parent plant that has been transformed to express said exogenous polynucleotide is for increased rosette area as compared to a non-transformed plant of the same species which is grown under the same growth conditions.

8. A method of selecting a plant having an increased trait selected from the group consisting of: rosette area, rosette diameter, and growth rate of rosette area, as compared to a non-transformed plant of the same species which is grown under the same growth conditions, the method comprising:
(a) providing plants transformed with an exogenous polynucleotide encoding the polypeptide set forth in SEQ ID NO: 246, wherein said exogenous polynucleotide is comprised within a nucleic acid construct and is operably linked to a plant promoter within said nucleic acid construct,
(b) selecting said plants for increased rosette area, rosette diameter, and growth rate of rosette area, as compared to a non-transformed plant of the same species which is grown under the same growth condition, and
(c) growing a crop of said plant selected in step (b),
thereby selecting the plant having increased rosette area, rosette diameter, and growth rate of rosette area, as compared to the non-transformed plant of the same species which is grown under the same growth conditions.

9. The method of claim 8, wherein said exogenous polynucleotide comprises a nucleic acid sequence selected from the group consisting of SEQ ID NOs: 3487 and 7.

10. A method of producing seeds of a crop comprising:
(a) selecting parent plant transformed with an exogenous polynucleotide comprising a nucleic acid sequence encoding the polypeptide set forth in SEQ ID NO: 246 for at least one trait selected from the group consisting of: increased rosette area, increased rosette diameter, and increased growth rate of rosette area, as compared to a non-transformed plant of the same species which is grown under the same growth conditions, wherein said exogenous polynucleotide is comprised within a nucleic acid construct and is operably linked to a plant promoter within said nucleic acid construct,
(b) growing a seed producing plant from said parent plant resultant of step (a), wherein said seed producing plant which comprises said exogenous polynucleotide having said increased rosette area, said increased rosette diameter, and/or said increased growth rate of rosette area, and
(c) producing seeds from said seed producing plant resultant of step (b),
thereby producing seeds of the crop.

11. The method of claim 10, wherein said exogenous polynucleotide comprises a nucleic acid sequence selected from the group consisting of SEQ ID NOs: 3487 and 7.

12. The method of claim 3, further comprising producing seeds from said progeny crop plant resultant of step (b).

\* \* \* \* \*